United States Patent 7,745,391 (HUMAN THROMBOSPONDIN POLYPEPTIDE) - sequence listing, part 248

SEQ ID NO: 697776 - DNA, 394 bp, Homo sapiens
agaacagataagctatcagtacagttacaggatacaaaatcaacatttctatatgccaacagcacataatctgaaaaagaaatcaagaaagtaatcccatttataatagctacaaatataaaaagatacctaggaataaacttaaccaaagaagtgaaagatctctacaataaaaactataaaacactgatgcaagaaactgaaaatacaacaaaatggaaagatattccatgttcatggatagggagactcaatattgttacaatgtccagacttcccaaagcggtctacagattcaatgccatctctatgaaataccaataatactctttacagaaatagaatacataatcctaaagtttatactggcaccacaaaaaacctcccgtaggca

SEQ ID NO: 697777 - DNA, 1180 bp, Homo sapiens
  misc_feature (444)..(444): n is a, c, g, or t
  misc_feature (790)..(790): n is a, c, g, or t
cgtctcatccatggacttccgcggactcgcggccggctggacaggatggctggcggtgccgggggcatcttccaggcctatgctagacaccttgcggaaggagcctgcatgcaggacggaccactagagctggcgtgttgtcaggtatgctggtgcgcaggttcattgcggttgcgttgctgatcgtcgtaggtcatatcgtggcaagttaaaagtcctggagctaggaaggagtcagtcgagaggacgctggttgcgtgtctttgatttggtcctttagatgatttcctggtgaaagacgtgttgctcctgttggtccagggtttggtcaagcgatggccgttataatagatgaccacatccagactggtccaacttgactggacagccttggtgctgattagtacaggagttccaatgccaataaaccacgggggcccactnaatgtacgtgcacccgtgtgtaattgtgacccttgtcccctggggccatttggacccaagttctggaagtgccattacctaggtaacttgtcacgaagtcggggcttttaacggtacgtatcgagcaccaagggagcttaattcgtgcgttcacgtggctggggcacttaaggctgtcaaggacaaaatttcacgcaggcggtaagggaacgtggctgaataaaaaggaattgctgggggccagtagacaagtcttatggaccgttgggttaaggtactaggaagtttacccgttccatattcaggaagacaaggaatatgtggggggaatctgattggaaatggntaaagtaagccaaaggaccaaattttcgaatcttatgagccccattcttaaaaacttttacggacccccctatgggcttcatgcgagtatacatgcggccaaatcgtcgaatcggtcactttggcgagcaaccacgagtctgggaggcgctcacaatcagcacacgtccagcctagggcaggacacacaacgggttttaagcacctttgcccaagtggaagcctgattgggcacacggggcgtcttggggcggacatgcgacaacaaaaggggataaaggccgcattccacacagcagcagaccgcccgatctattaagcccggtacgggtttagtagacccccgcgggggttataacgtttggggcctttggcgccaacaactcgctag

SEQ ID NO: 697778 - DNA, 100 bp, Homo sapiens
accggggtgacgaaactgggactacgaacgctgaaaaaaacgggagcaacaacaacgacagcagccactaggtaccgccagaagacagagggcggagcag

SEQ ID NO: 697779 - DNA, 577 bp, Homo sapiens
gcacgagatgaaccactaaattttaaagagttcaaatgaagttttattcttttaatatgaagggaatagttgtatttctacttccgggcagttctactatcacgttgcacctggggcctctatgtctgagaggtgtgtgggttataccaagaaatcatcgatgtggacgattaccgtcactggcaatggtaacctccaattcagtcactggagaagagaggtacaatttagtgtggagtcatcctttcgtctcattcagatgcttaagagcaatgcttaccgcagaatcacattaggtagagaaacggttttgcatgaaggctccagaagaagcaagggaataagcagggaaaataaagcaaaggaaaggaaggtagtcgtcaagtgatgagctattattcaaacctaccgtctgcaggacaatctagtcgagggtcttcaacaagcggtcgaaatggggtgggattagaaccattgtatccgactatctttgagataatgtcatcacaagaaatcgattcgttactgcccgcatccatccgttatctactggcaaatcatttagtggcgaacttcc

SEQ ID NO: 697780 - DNA, 196 bp, Homo sapiens
cgagaatgttatcatgttacttatactaacattagttcttctatagggtgcatagattggtcccattgggtgtgcaggcagtcagttcatatgtttgggatattcaggtcagtgggtgttgaagcttgaaacgctttcttaattggtggctgcttttaagcctcactcatgggtgttaacttttttactctctact

SEQ ID NO: 697781 - DNA, 940 bp, Homo sapiens
tcccacaatgaaaggggaccttttttgggggccccgggccccggggcccggggaggggggtgcccttcagggaaaaacccccttttttggccctttttttgtggaccccgggtggtggggggcgccccccttttttttgtggggctagcacacaccgagaggttaagggaaatcataccagcggccgaaatcctaccgtgcccccagtgtgttatttccgcggaccaagccgccggggaaaaagaagaggtcccaataatatggcccccctccgcgagggcgcaacaccgaggtgcagagggtagacactcctcttcatggaaatggttggaaactactggacaaaagttgacgagccatccctcccagcttggtgtgcgcgcgaaataatatacaaaaccctgcggtgagaccacgggtagaaacctccctcctctggatcttgagaaattgagggattatcgaaactttccctccaagaggctgctccacgtggcgtctccacacccccaggagtgaagtgtttatggcaccaaggaagggttctttcaccaaaaaaattggcattgtttgtgcatatcacaaccacaaaccgcccccaacaacaccatctaccatccattcgtgcagccacaatctacccggacacacgacgctgtgcggaacgggctgtagaagtgtccccacacaaaagagtactccccgcgcccccaaaaacatgagcgggccccccgagaatgaccggccccccgaacaagacgcacaacacacagagctacggggggaaactgcagaaaaaggcgccctcaaaggagagacccccatcccagccggggcccactaccaaagcttcgccggggaacacacagggcgggcaagacacccactatcgggcgggaagaccacagggccggacccagggacacacaagacgtggggc

SEQ ID NO: 697782 - DNA, 148 bp, Homo sapiens
agtgttcggggccggagtcgatgtcggacccaggtcgaaaccgagaccgcgtccgaggtcgaggaagttggcgtggtcgaggaggtcctggcaccaacacttcttctaggctctgtgcactacccttcaccacagactcagagactgc

SEQ ID NO: 697783 - DNA, 965 bp, Homo sapiens
gctccgagcgcagggttgggactgtctgggtatcggacagagcgaaagcctacgcttgctcgactatgacgctgatagatcgtctgtatctctgatcaagtatgcctgacggaacgtgcacggcatgggacgaatggagggaggtggaagactttttgccattcaggcatgaaatagcccaattcaatgtaccctcaatcactcaagtaacctttcctaattgcacaagacaagggagaattttaaccgtgtcgaggacgttcagagtcatcttgaatgcattcctagatggccttgggaaccaatgatgcgtcgtatgcagagacctagaacaagtaccctatcgaaacgttggaacagagggataaaaggaggctggaaaacttgcacatcaatccgccagacccatcaggaacggtacccttgacttatggctaagaagcacaagaggcagtatgggacaatgaacaccaaacggctagattctacactaaagatcaactatataggagcacaccaatcttagaccaaaagcttctagggttaactacaacggcaagtatcaatgcgcagggcctctttcaagagcctgcggatagccaagaaccgatttctttaccccaatcggactaacgcagggccaacggatttgaagaggctcgatactatgaggcatctaatacattaaatctacattcggcagcagtaaatcatatggggaacgtgcggcccaaacgaacggaaaaacacgggtggcgcatctggagatggagagcacaacagcagaaaacggcaaaaccaacacccagcgaaagagggcagatgaaaaaaccaacaggccagactgggcaactttgaggagacaaggaccagaaaccaaccggacagctgggaaagaggtccccaactccaaacccagaatagccgggctcgcaaggcacacaccagacgacaggaaagccccc

SEQ ID NO: 697784 - DNA, 136 bp, Homo sapiens
tggattgtacacccactaagtagggaacgtgtaactgggattcgaccgtcgtgatataggttagtttgaacctcctgatgatgtgttagattgccctgggtaatcctagctcagtacgcgcgagaacccgcagatt

SEQ ID NO: 697785 - DNA, 150 bp, Homo sapiens
ggctatcttcaggtggctttcagctccgagtagaaataaccagaataggcttacattaaagaaacttcatctagaaataagtcctaagatactatctctatggctcaaaaataagaggaacccagatttctttccctataactaaacact

SEQ ID NO: 697786 - DNA, 342 bp, Homo sapiens
gtcgactactagagagatcccccgtattgacattcaacacaccacaatactatattcttaaaggtgatcgtggtaaaaccccacgatcacaggggatagggggctgccacctgaacgcaccatcagccggtcatatgtcctcatccagcgagacccttacaaagtgcaggtgcagacagacgcacctcagctgcttcaataaaccaaacggcacgtgaggttggcgccctacggctcccccaggctctggggacacaatgcggcccaaggtggccttgtggatagtgcccaccacaagatgccatgcacctaggggttcaccggtcccggatggccaggtgc

SEQ ID NO: 697787 - DNA, 484 bp, Homo sapiens
  misc_feature (5)..(5): n is a, c, g, or t
  misc_feature (16)..(16): n is a, c, g, or t
  misc_feature (30)..(30): n is a, c, g, or t
  misc_feature (60)..(60): n is a, c, g, or t
  misc_feature (79)..(79): n is a, c, g, or t
  misc_feature (110)..(110): n is a, c, g, or t
  misc_feature (173)..(173): n is a, c, g, or t
  misc_feature (185)..(185): n is a, c, g, or t
  misc_feature (310)..(310): n is a, c, g, or t
  misc_feature (322)..(322): n is a, c, g, or t
  misc_feature (401)..(401): n is a, c, g, or t
aactntgtccccccgngcctaaaaaatgcnagtggccccctgtcctggggccttaactgnaaacctcccaaaacccccnggttccaaagccaaaatcctccgtgcccccnagccctccccgaaataagcctgaagattaacaggcaccatgcccacccatgccccagcctaanttttgtattttnaagtaagagttgggatttccacccatgtttgcccagggtggccctcgaactcccagacctcaggtgatctgcctgcctcagccctccccaaagtgcctggaattacaatcatgagcccaccactncttagcctctanaaaaaaaatttttttagttagcaggtgtggtgatgtgcacctttagtcccaggaggctgaggtaggaagattgcttgancctggagaggtcaaggctgcagtgagctatgattatgccactgcactccagcctgggtgacagagtgagaccctgtctcaaga

SEQ ID NO: 697788 - DNA, 631 bp, Homo sapiens
agaggggaggaggaggaaaaaaacaaaacagaaacagtcacaggatagataaaaatacaccgacaggttaccagaaccttcagcatttaacaataaaacagaaagaaaaagcagaagcagtgagcatcgacatcaactgtacaagcattacaaagactcctgtgtcgaagagtcaattgttaatagctttccacagtgtccacagactcagtttcagggacagcctggactactttcctttcacacaaacaaacctccccgtgttctctcctgggccagcggccgcctccttggtgtggtcttctctgagtgaatgtcacaaggccggtgacaggagggggtggaggtgaggggacaaagtagaggccgagggtcagtgcctttggagaaagtccagagaggaggagcctgcacatctggacatagttggaaggggaagtgaacggtaaaaagctacggtaggtaaacaacagacagtgaagaatgtccaatataagctacaggctaatctctgtggaagcactggattccgaaggacagcagcagcggacaccctcgtctgtatacactaagctctctagaagacgctggaataaaatgccttaacgtccttgtgacaggactttatggg

SEQ ID NO: 697789 - DNA, 169 bp, Homo sapiens
cgtgtctttgcccctaaaactcttcctgctctatctccccccgacttcgccaggagctccctcaagtccttctgatggcttcatctcgctgtcgtgactacacagagttactggcacaagtttatcttcttccagatttcctttcagaacactcaaaggtccaggtatg

SEQ ID NO: 697790 - DNA, 136 bp, Homo sapiens
gtgaacaggctttacatctgaagaaacgtggagggctgagtttggagttaaggagaaaaaaaaaatgaagagcctcgattctcgaaagagtgcggttctctgtcccacgtgaggttagctgatcgcaacatagagt

SEQ ID NO: 697791 - DNA, 418 bp, Homo sapiens
tcacttgtttatctgctgaccttccctccactattgtcctatgaccctgccaaatccccctctgcgagaaacacccaagaatgatcaataaaaaataaagggataataaaaaggaaagaaaagaaagaaaaaagcaatgtcacatattgccacaggataagctaaggatgaaatctctccaggacttagtgtcatagaggtcattggtgactctagtgagggccactgtatatagtgggggcaggagccatagtgggttttaagctcaaataggaggtaaggacatggaaaacatgggaaggcacttgagaagtctgactatgaagcagagataggactgtggtcagatacaaatatgagaagcagatttcttctgatgagaatggtgcgttcaactgtccatgcaaagagccaatgg

SEQ ID NO: 697792 - DNA, 282 bp, Homo sapiens
  misc_feature (132)..(132): n is a, c, g, or t
atcttctctctctatctcatgagtaattgtttgattttagatccacagtagaagacatggactactggttcttgattaacatctacacattttcagttatttgcttgtacagttatatgttatactaatcgnaattagatattggtgaattaactgctaagatgattaatccattaagtacggggagcttgcttaactactttgtactttctggttctaaatgttagggttatatagctcatctcagcactaacattattccttacgcatgtattgaacttt

SEQ ID NO: 697793 - DNA, 201 bp, Homo sapiens
  misc_feature (62)..(62): n is a, c, g, or t
cgcaatggacgaacacgtcactgactcttcttgataggttcatctcctgacactgccttttnctgcagaactacaggagcatcactcgcagataagccattgctgttattcactgtgcttcgcataagtgtctctattaccctgcgccaatgtgtgactttgcttaggacccactcaagctgcagctcctctttattcctt

SEQ ID NO: 697794 - DNA, 230 bp, Homo sapiens
tttgaaggcccatgtagcatgcctggagggcctcatccctgaagataaggttgtgctactggcaggttctcccttacagaatgaagccaccctggtcagagtggggtggaagccctgacaaccctggaagtggttgccgcagctaggaggtgagtgggctacaggggccaccaaactgtgtccagggccatacacgacactaagacttacttggtttgccctgcacgggg

SEQ ID NO: 697795 - DNA, 968 bp, Homo sapiens
ggcggcgtccgtggtctgtcgggccgctaccgccgggtcacaagtgctattgcgctgcccggccgttcgccggccctgctgcggacgccagccttgcggagtacggcaaccttcgctcatgcgctccagttcgtgccggagacgcaggttaggcctgctggacaatgtggcctgtcgtgtggcctccgcagactagtcctctcagcccacttgcacggtggtgagtgtgtgattgatgtcggccagccgttttgagactgacgaagaataatgggcgcaggctactttttggcagcatctggctttcaagggaacaaaagaatcgggcctggcagtgccctggagaagggacggtgggagagcatgggggcccatcttacatgcctacaagcacccgggagcacacagctaactacatcagggcgctgtccacggatctgccgaaagctgtggagctcctgggtgacattgtgcagaactgtagtctgggcaagactcacagattgcagaaaggaacgtgatgtgatcctgcgggagatgcaggagaatgatgcatctatgcgagatgtggtctttaactatctgtcatgccacagcataccaggcacacctctaacccaggcttgtggaggggcccaggtgagaattgtcaggaagctgtctcgtgcgagacttgagccgagtacctcagtacacattacaaggggcccctcgaatggtgcctggcagcagctggaggagtgagcacagcactgttcgacctcgccagaagccctcgtggcttcctgacctatgcgatgacgctgttgccactcttacttccggccgttcacggcgtggatccggccgggtgatgtctcctttgccctggccttcggaaaggcctgtggccaccggcatgtgctgtggtgaatgcataggctttaagctatgggtggtgcatcccccacgtctggttgcacatccat

SEQ ID NO: 697796 - DNA, 229 bp, Homo sapiens
  misc_feature (200)..(200): n is a, c, g, or t
gagcggtctagttggtaatatatagtttttttcgggttgtggtttcttttgataggtgagattggctagctattagtataagggggaggagtcatgtggttagaactagctaggggtgctgatacgtgagtcggacgaagaatgttaacggaaaaattaaggctgttttcgccttatgttggtttagtagggatagactngcatcaggctaagtgaggagactatgtac

SEQ ID NO: 697797 - DNA, 813 bp, Homo sapiens
gcacaagcgatcaaccctgggcttaaacaggatattcctgggcactatcctgcacaggaccggcctgtccccccgcagaaatgccccagagccccctcaccgaagacgaagccatttaacgccttcagggcacagagggaccgacgggagagaagaaatccactttgtggagatccaaggtgatgaccacctccaatggggccccacccatggatgactaagctccttgaccagaagagtaaccctggagtcattccagccacaagaaaggtgagccaggcccacaggcccaacagcggccggaaccacccagatcaccatatcttattcatccaggcccagggagcgggagctggagactgagagaaccacccggtccagagaaccagctccagccccccgtccagacacccagccccaatatggattttagggctctggaactgattgctccccggatctcctgcccagccccgctggcctggccccccagcttcacctctgggacccccagctgctctaagccccggatctctttcccccaggaccccagccctcgcctctgcgagaatgacataatttgatagaattttcttaaccagttagaaaattccagctcctttctgtcctggagctagccaagacttgtgtgaagcctccggcaaggggctcctgagtttctggggtgggagttttgctctctgtccggctgtgatcaaatgttggaccctccccccccccccttttttttttttaaacccgggatgtctgttgaaataaaaccttccgtctgaccaaccaagaaaaaaaaaa

SEQ ID NO: 697798 - DNA, 1556 bp, Homo sapiens
tacatcactgcttatcgtgtgggcccatatattttcgaagaggagtgttttgtcccgccgcgccagatcataatgtgcgcccaatgtctctcgttgttgtggaccccccccctgtgctattgtgggtgagattcctccacagggaacgccttgttttggtgcgcttttattatagagggtttctcgtggcgccctctgtgggggccttcttttattttgtgcgtttctatttcgagagcgactccttttattgtcttcggccaacgtgtggcccccaccccagatgcggtcctcaccacgcccagcgacctactttttggggaccatcgtgagctctccctggtgaattttaaaggattgtggaatgaggaagcttgtgagttggcgctctttttatagggagtccttccgtgtccacactctgtttgttggtggacccacaaaaaaggggggggctgagaaatttttttgtgttttgaacaaattttggaagggacccatccgaatggaaggtaaatgaatatggcccctgtgtggaacaccctcttatgaaagctgcgctgtccccctctggtggaaagattgcgcccaacaatctcgtagtatctccacgtgtaagacctttggaagaggtaatatttcttcccacagtgagatactcttctgaatagtatttgtgattactagatatagatacacagtgagactcgcctgtgtttgtgaaagacaattgaaatactgttctgtgagagaacgccgctctctttacacactgtggcaccccaccacagtttgagaggagaagtacgacagtctctgggagactccccccctcggggcgacactctgttgtgttgtttctctgtgtgtgtccctctgtgcgaccacacttagaagagagtgtgtcactgtcgcgccacacactctcacacaaagggtgtgacacacactctgcgctttgagagcccccgacgacctctgtggacacacagcgcccggcacgcactgtcttcacttctcacaggcgttctcacgcacactctcccgaggagaatgtgagatttcaccgcttctattgaatatacacacttgagaatatacaccacgcggctaacacatcggtggcaccccgcggtttcctcttcctatagagaaatgtggcacgccccacttccacgcaccaccacgcgctttctgcacccacaattctctctcgagggtataaacccgcgctgggagggctccacgccacgcgcccacgcgaggcccacaaggacacacgcgaacttggcgacacctctgaaaccccacaaggaaatttcacacttgtggggcctccctctgtcacgcttctgctgtctgttctcacgaagccacttctggaatgaagtgtcccgacacccctctctcggagagcccgggcacaggagcccaccccagctggtcacgaacttctgaatgttgggtagactggcctctgtggggattgtaagtgccctcgaggccctctgtactagaaactgctcttaataataaccgtgattattggttgctgc

SEQ ID NO: 697799 - DNA, 327 bp, Homo sapiens
ccctgcctcaccgctgggcatggtgactcacgcctgtaatcccccagcaatttgggaggcaaaggtgggagaatcgcgtgagcccaggagttccagaccaggctgggtcacatgacaaagccccatctctccaaaaaaaaaaaaaaaaaaaaaaaaaagccagatgtggtggcatgcatctgtagtccaagctacttgggaggctgaagtgtgaggattacttgagcccgagaggtggaggctggagtgaacagagatcgcgccactgaactcgggtctgggcaacagatagcgaccctgcctgaaaataaatcgataaataaactc

SEQ ID NO: 697800 - DNA, 125 bp, Homo sapiens
cgagcgcactgaggagactgggggtgtacggagggtgtaggagggtgttacggaagcgtcgttacggagggctgttaggaggcgaggaggcgctcgatacggaggcgtgtaggcgctgttacgga

SEQ ID NO: 697801 - DNA, 747 bp, Homo sapiens
ctcccatgacccagacacctctgcacttcagcctgggcaacaagagcaagactccatctaaaggaaaaagaaaaagaaaaaaaaaattcccaaaaagaaatggccaataagcacatgaaaagatattcaacattgttagtcattaggaaaatgcaaatcaaaaacacaatgagaaaccactttacatccacaagagtgggtataataaaagaagtgttggccaggtgcagtgtaatcccctcatgcctgtaatccccaaactttgggaggctgaggcaggtggatcacctgaggtcgagacttcgagaccagcctgaccaacatggagaaacccctctctcctaaaaatacaaaattagccgggcatggtggtacatgtctgtaatcccaggctacttgggagactgaggcaggagaatcacttgaacctgggaggcagaggttgcagggagccaagatcatgccactacactccagcctgggtaacaagagcgaaactctgtcttaaaaaaaaaaagtgttgcgcaaggatgtggaaaaactgaaacaactgtattcactgctggtggaacatgtaaatgatcactgtggaaaatcgttcggtggttcctcaagaacttacatagaattactatatgatccagcaattccactcctaggaatagacccaaaagaattggaagcaggtactcaaattatttacaccttgaatgttcatagcagcacctagttcacaataaaggtaga

SEQ ID NO: 697802 - DNA, 339 bp, Homo sapiens
  misc_feature (184)..(185): n is a, c, g, or t
ttttgaaatacgtggttacttgcttatcctttcccaaatacttaaaagataggccaagcgcggtggctcacaccttgtaatgccagcactttgggaggctgagccgggcggatcaccctgaggtcaggagttcaagaccggcctcaacatggagaaacccccgtctctactaaaaatacaaaannatagccgggcgtggtggtgcatgcctgtaatcccccagctacttgggaggctgaggcaggagaattgcttgaacctgggaggtggaggttgtggtgagccaagatcgtgccgttgcactccaagcccttggcacaagagcgaaactccgtctca

SEQ ID NO: 697803 - DNA, 185 bp, Homo sapiens
tagtagatcaacacttcgctgggtgtggtgtctgtgaatcgtgtcatcccagctactcagggaagctgacccaggcgaatcgcttgaacccaggagatggcggttgcagtgagctgagatttgtaccactgcactacagactgcgtgacagagcgagactccgtctcaaaaaacacccccaacaa

SEQ ID NO: 697804 - DNA, 166 bp, Homo sapiens
tcctccgtggctgattacggtcttggcgaaatatctctgtgaattttcgtcatagctcattcctggtttgtgcttctcgcgcatgcgctcggccgccgcctgcctcacgcgcgcggagacagaattcaacgttgtcaatgtacacgtcctgccccatcgacgaagc

SEQ ID NO: 697805 - DNA, 389 bp, Homo sapiens
gtgccacatcatatgcgagctgggtttgtgatacttccaggattacactactaccctgtctctgactgcaacatcttgtatctctgcgatcttccacacatcatgcgaactatggtccagcatccaggttattcaagcttagattcctctcaactgcaattatgggtggcattgtaacctgctatgtaatattgtaacccaagagctgagtaagatgggtgcctctgaaagagtactctctttcatccactggatgcatgtagattttgaccatccctggcgatcactgcagtctcttaagtcatggtggtgtcctcactgaggccaacacatgttttcagaaaagacccggaagtaatattcattccctagacggtaagggagatgag

SEQ ID NO: 697806 - DNA, 789 bp, Homo sapiens
agcgggtgctcggccgggggctggcaggccccgcggggactccggactcccagtgtcaccaacgaggaaactgagtctcaagacatctgagggacctttgcccgaggtcgcagcccctccctggaggagctgaagtgcagagtagggagccccttgcggagaccctcctgggacctccttccgcaggggcctggggcgcctccctttccctgctctgcctgcgggcactgagctcccgaaagactccagcccctcgctctcccggtgacctgctggagaagacacctgggaggaacctgcggacaatgggtgtgtgtccttgggccgccagggtcacctttcagcctgtttccccagaggtgaaccaagagtcacacccaaggcaggagagcaagagtgatgagtccgctgcaccttctccggcaagcggaggttgtcccgccgccctcactctgtgatgcttgctgtgcttgcgaggcctacgccaaagccctgcgggcagccctgggctcccgcggacagccttgctgagctcctgggaaggaggcgtgccctccccttcccccaacgcccgctggctggggttctctgcagcccaggactgtgcatgtgtgcgcacacgggttctgtgaacacgaacacaaaagtgtgctcgtggacactgcgtggtactgtgtgcacacagcgcacgtctgtgaactgaaggaatgttcctggacaccaggtgcaagtgccaagtgtgtgtatgctggcccagtgtggtgccagggcgaactggaacggagaaag

SEQ ID NO: 697807 - DNA, 358 bp, Homo sapiens
caatcaacagccaagtccagtgcaagcctggcacggcgggcccagcatttgcatcccctatgttcagccaggcacctcccaggctcaaggcacatctccattttctcagctttgcatctgggttgtccagttgggcatggccttgcccaagtgcatggccaccgcaaaggccaaatttcttgttatgctcctccatcctgtcgcttattaatcattaagaatcctgcctggaagtttaggtcaaagaggctgctaggagccaacataccgtggatgtctcatcccaaaaaattcaagccgtcaggggtaacgagatcgacattacggtaatccatggatacatagatggttaccggga

SEQ ID NO: 697808 - DNA, 230 bp, Homo sapiens
ttttttggggttccccccccccttttttttttcccccccggccccccaaaaattttccccccggttttgcggttggtccccctccctgggggggggttttttgcccccccctttggaaaaaaaggccccccttgccctcccccccccccccgcccccgggggggtttttttttttccttccgggaagggggggggggtttttcccccctaaaaattttgggcccccccca

SEQ ID NO: 697809 - DNA, 641 bp, Homo sapiens
gagacgcatgatgtgaccgtccggcttgagaacagagaatgtgcgttgtgccacgcgactaaaaagagatagctaaagtcatgggtagagtagcttgacgacacgtgctacaggaacgagttcctcactatagtgacagtgttcctcagctgaccaccacctgttgcaacatgggatggcaacgcactaaagactgggtccaatatctccatggtctcttatgggccggacagacccggtcaggcccctgggactactctttacacatgccggccaagtaagaaacaaaagcgccatcaaatctgaggcgagcagtaattacacttgatggcagtatatgggagcaactcccaacgactgttacattctccttgtaacacacacacacttgcatcctccgatccgcgcattaagcacaggcacgcccccaactgggcccggacttaatagcctaaatctcaaaaaacaccttactacatgcactacttaatctggaccacctgccacatccatctacaaacccaccacactgtctccatgactccacacaatgtataccactccctttcactagataccatacccagacatcagatcttgaatgctcgcccgcacactcccgccaccaccctatctaacac

SEQ ID NO: 697810 - DNA, 490 bp, Homo sapiens
  misc_feature (314)..(314): n is a, c, g, or t
  misc_feature (345)..(345): n is a, c, g, or t
  misc_feature (350)..(350): n is a, c, g, or t
  misc_feature (387)..(387): n is a, c, g, or t
  misc_feature (393)..(393): n is a, c, g, or t
  misc_feature (411)..(411): n is a, c, g, or t
  misc_feature (424)..(424): n is a, c, g, or t
  misc_feature (452)..(452): n is a, c, g, or t
  misc_feature (469)..(469): n is a, c, g, or t
tttagactacaggaaacagcttttcaaaaactttataccaagggttgggtatgttgcctcatgcctttaatcccagcacttagggaggctgaggcaggcggatcacttgaggtcaggagttcaagaccagcctgtgcaacatggtgaaaacctgtctgtactaaaaatacaaaaattaggagtggtggcgggcacctgtatccaagctacttgggtggctgaggcaagagaatcatttgaaactggggaggcagaggttgtgggtgagccaagatcacaccattgcactcccagcctgaacaacagaacaggantttgtcttcaaaacaaacaaacaaaaaaaantttantatcttttcaaggattgagggttgatttaatggaacnttttgnaggttcttcttggaactngagggatttaagnccttttttaagggggtttttgggtaagnttttttaaaagttattncctcccaaatttgtccacctt

SEQ ID NO: 697811 - DNA, 1499 bp, Homo sapiens
gctcagttcttttgttcgaccgtgtttctactacccaccatatgttagtgtgggtgtgcaaacagacgacaactaatcactggcagttcacaccacagctggcacagagtaagattgcctcgttcggtacaacgttggggggatgcctcagtcggcggcaaatgaatacactagatttcaccaggggcgcccttgtggggttgttcgtgtcccttacaataaccgccccaacgttgttgtgttgggtgtctgtccggcgtcagtggccttcccaacctgcagtggccatgtgttggaagtagctacgtccttggtcctctcacaaattatggtgtgcagatagttcctctctgcagatggtgtgttggcttgcaatattcgcctataattgtcgcccaattcttttttctgcggagaattttgcggctcgtttggttctgtggtcccttaggatgcgctaatttgtggggggctcccattcccgcttgttctccgccgtgggggtatcaaacgtttgtccgcgtcataatggcgtcgtccgtcggggcggctctcctgtttttgttgcccccccctcccctctggggcttgccgtgagggtgctgcaatcgcagttggatgtctggttgtctcctctggtgggccgtacccaattcttggttggggggccaccttttttctcgctgctccttggttgttgtttggtcccactgttctcccactctctagtgggtatatccccacggatggctcgtcccctcagggtgttctgtggttgcgtgtgctctctttctgcttgtcatgtgtggccgccggtgcccctctcttgtaaatggtgagggaaccttgttgaggggaatttgggtgtgcaagcacacttgggggccgctcttcattgcaagcctgtcctcaggttatctcacgaagagcatgtctcccttggttccacgggtttattatagaatttttggcttttctcgagtgctcttcgtggcgatatttctgacataccttcacttttctggtcgtgatcataccacagagtgccccacccaagaacaccacaatgggccgcgcacactgtgtgttctgtcttatctgaccgtgtctctctgtgcccacataccacgccaccacccgacacgccttttaaagcacgcttctgggctccacctgccctgttgaccacaggtcttcacggatgctcacacggcctgtatctgggcccttttcctagagctccacggctgcacgccacgtccacgacgagagatagagcctgcccacggccttatagacccacccttgtcagcccacgttcagttctgccttaccacaagatgttctgagactcatacccactttggagccaagccccaccttgctgccctacccgggctgtccctgaggctggatctgttacaatatgagtcatgacactcataactgtaataaaagcacccttgttttctgcttgaaccaataaaaaaaaaaagata

SEQ ID NO: 697812 - DNA, 1311 bp, Homo sapiens
gggagaaagaggagaatcgcccaagcggcctcggaagtcccagtggagtggaggcccccgccgtggagcctgtgtggtgtatgtgtggtaacaccatgtctgtagcccctgctacaccgatgctgccacctgtgtcttggagctgagctgggaaactggcctgcggttatttcttttacactgtgacattgtgagaccacaagggcacagctagtggctagactgccactactaccaccaatccgagcatcccatcacagtcaatgtacaatcttgtaccccatgacgccataggatccactgatgcaccctcaaaccactgcaacgactgcgctgactgcacactccatggcctctcgaccctgactgagcgcgcctgacgatccacgcactgccaccagcagcgaccgacggcctggcaatcacacgacaggccagcccacgacacgaaccactcgacacggcccctctgccactctgcacgccacttgaacacactcgcacacgaaacggcgcgaatcccccatgcccccacacctccgaacactccgctacgcgtcgcgcgccacgaggacctctcaccaaccacgcggccagtgatgtgacccccctgatccacctacatcaccacctcgtgcccctttcgacccatggaacaccgcccaaacccctaacttgtgccctgcgcccatccggtctgcgccgcttcctgacgcccgcctcgcgccctgcgcctcctgaccacctcggccccctactccccacccgaccacggggcccacagcgccttaacaaccaggggcccaacgcctgcctcccaagacgagcgcaaccccccagacgcaacaccacatcaacccgttacacccaagcgactggcccccaacctgagacagcgcaagccccctcgccgcaaacagccaccgcagcgaccgactgcgccacccacgcaacaacgcaccgcccacaggagccgagcacccacatgaaaccccgaggaccactcagccacgcaccgacaagcgccacccccaccgcagctcccacccaggccacctgcatccccaagcgcccccaccctagacaacgcccaaagcgccgcacatcacccaagcgccgacacacaacgcgacacccacctaaacacgccccgcgacgaagatacggcactccacacgaggccaaccacaaacgcaccaccctccctcgcagacccccacgcaccccaagcggcgacacgaaaccacaggccaacaaggccaccggaccgcacaaccgcgcacaagccgcacaccgaacccagcaagccac

SEQ ID NO: 697813 - DNA, 359 bp, Homo sapiens
  misc_feature (40)..(40): n is a, c, g, or t
  misc_feature (47)..(47): n is a, c, g, or t
  misc_feature (153)..(153): n is a, c, g, or t
  misc_feature (232)..(232): n is a, c, g, or t
tactgggatcccgttaaaaaaacgttcaggggaactgcgncgccttnccaccgggtggggccccattgaagcccacgtcccttcatccctcagggctgtgcggccccgagcccaggtactacgtcccaagtggcggctcaggacctcacaganctacggggaactgagtgactggagtctccccgccactgcccacaatgagccctggttctcgatttcttggaaaaccagnaaaacaacttagtttcagcttggtgtaaaacttccgcatgagggacttcattttggtttagtcttttgggcctagtgcaggagctcagtccaaacccatggcttcctgtaaactttatttaacacca

SEQ ID NO: 697814 - DNA, 520 bp, Homo sapiens
  misc_feature (290)..(290): n is a, c, g, or t
ataatacataactagctgtgtgatcatggcagtgacttatctcctaggctctgtttctcaagaaaaattagatgactgtgagtccaccagttctaaaatcataatacaggatatggctccatcttgctgactttgtttcactagcaagtaaatgtgttaaaatttagagaacttacgaattttgaaatcctagttaatttaactaattcctatcactgggcataaattgaaagagcaaaactgtgaagcatcatgaaaacaactctatctactatctatactagaactgnagccttcctgctttaactatgccagccaggtgatggctcctcccccaaatgcctgtctttctttttaaattaaaaaaatatatgatgaaaagcaacttttggccacatcctcacaccattattattttcttttcttttttttttttttttttttttgggggggaagggggcccccctttttgccccgggggggggggcgggggccaaatccgggtctcggggaccctccc

SEQ ID NO: 697815 - DNA, 270 bp, Homo sapiens
acagtcattcacatgcatgtatcatgacactctgaacatgtattgtgactgcaaatcacatgactcgatactagcttaataatcaaacacagcaatcttgttctacactaatcacttcatatgtagctagtctttgatgacatgacggtctctgacaacctcatgagaagtactgagaacatcagtcttgtcgtataccttatctcccttggctgtgatatacttccatcaactaaatgatccagtgcctgtattctcctacacacatta

SEQ ID NO: 697816 - DNA, 511 bp, Homo sapiens
tgggaaaatacagggcctctttgggttacccaatggggccttcccttcccacctttgtttttaaaagcctaaaaatttttatccctttaaaaaacagggggaccaaaaattttaaaaaggccctccaattttaccgggaaaaaaaccaaattcttgtttcccacctcttgaaaaaaaaggatcgggttctggaacccaccccaaccctgggggggggtaataaaaagtcctgcccttaaatccaaatgttgggtaaaaccctgccgggtaaccattaactggaaggggctttaggccttgaacttaaaacccccaacctgggggggcccggcccattccccttaagagggtattcccgctctggccgtggttaaaacgaaggacgaggcgcaaagaagcgagccatgagagagggcggcgggcgccaagaggcagggcgagccataagagaagcgcaacgaggacgtgaagcgcagaagcagagcggaggggccgggaggatagggagagg

SEQ ID NO: 697817 - DNA, 731 bp, Homo sapiens
ctcccccaaccctctcctcaggagcctccccagtcccaggcaccccatccagccctccctgcctgggaccaccagtggcagcctcagcagtgtgccaggatgcccctgccccatcagctgcctccaaacgccccagtagtccccagccctgtgcttcaaagcccatccgaaggactgagggatgggggcagtgcccaaggctgccctctgacctcccactggcatggtgcagaggctttccactttaccccagaccctgagcagggtcctaggcactgcagtggagctagcgcttccctgggatgcttgagaggccttgcctctccctactgagtactagggagcagactaccacgcttcctccatagctacaaccaccagttataaatacaggtagtagctagactaggcagggagcgaggacaaccatcccccatgagaccaccatgctagcaccacacacaaggaaggacctgagtcctcccacctagatccccaggagaggccttgaaggggccttcgcgaacaaggatggcttcctaagcagaccgtacaaccaacctcagaccgttcatatccacgatccgttcagcaacttcccagaaccatcctagcgctctattcatagcccattgatggtcatgcgccaacaagcaaggggactgggaggaatctgcagacggagcgggggccacagtggcgagccatacagactagggagacatgaccac

SEQ ID NO: 697818 - DNA, 984 bp, Homo sapiens
  misc_feature (699)..(699): n is a, c, g, or t
tgtgtcgtccttgtcccgttatttttagaagaaaaaaaaacgaaataaaaaaacgaacaaaagagggcaccagcatgggtcgcttctttgtccgctgttatatctggcagatcctgcaggtgtgtgtgtgcgcaacacacggccttggttgaaaattgtttcgtcggccgcctttggtgcgcgtgttctcttctacgtattggtggcgccgtttttaccgtatgtttttgtgctcggttcgccccagtttggtgtggtgttgccccccccctgcgggtccagggggggagcctgtcggctccggtgttgttgtcgaggtgtctttggtcgccgcctcttgtcagacgagtttggcccccatgtgctttggactgcgtctttattggtcccttaatgtgtgctcgtggcgttcgggtcgaagcacgcgctcctcatccggggcatggtacgcgaccttcacaatgcgggctcaacagatttcctgaacatacttgggccacttgcggtatttggcctcacgacgaagattagtaatttcccacggagtcaattttcttgtctgtctcataaaagatgtctcctcggaatacattctgtgcgccccacgtcaggctccttctggcggagagtcttcaagacacccctctccctccccggtaacttctttgaggagaggaggtcgccacaccattccaaccnaatcaagaagggtctgtttttgttttgggtatgccagcgccgcccactcatttatggtagcattgatgaaggtcatctcgcactcgctattgttggagacgacgatttcttgagcaaaaagatactattccgcgcccctcaatggtagattcttcttttgtattggtgcttttcacaaccttcctgtggtggttcaagaagatttcaatatggagtattcgccccccttccatagcacataataaatacaaaaataaacagaccacaacaattagacaaagaagc

SEQ ID NO: 697819 - DNA, 277 bp, Homo sapiens
  misc_feature (24)..(24): n is a, c, g, or t
  misc_feature (46)..(46): n is a, c, g, or t
  misc_feature (67)..(67): n is a, c, g, or t
  misc_feature (84)..(87): n is a, c, g, or t
  misc_feature (102)..(102): n is a, c, g, or t
  misc_feature (106)..(106): n is a, c, g, or t
  misc_feature (143)..(143): n is a, c, g, or t
  misc_feature (169)..(169): n is a, c, g, or t
  misc_feature (193)..(193): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (237)..(237): n is a, c, g, or t
  misc_feature (239)..(239): n is a, c, g, or t
atagatatctatttctgttacatnttattactgtatggcacaaganagaagtgacattgggtatgtnagaaatgaaataaggannnnaaatgcattaccatntgtntaataattatctttacagaatgctagtttaatgactnttttaactgaattttttgaataaatnagaaatgtttgtattggtcacagntctatcataattgcttttctgatgcantnananataaatggaanantgaaatgtatattaccgatgcaaactgtggataaagtt

SEQ ID NO: 697820 - DNA, 462 bp, Homo sapiens
ccgcagctggcttggcccgcggtcgtggttcccgccgtcctgtgcctttaacggctctcgccactcatccagcatatggggctcctgctgtgtcgtgcccccagctgcacttgcgcctttagagggtcggctatggagaggttaaatgaggccccggtctgggtttgcggagtcacccaagacctggcgaaatcgaaacgggagggctcaaagagactgtatcctttcaccccctcatatgctggtctacaaggatgggaggccagaccgctgaccgttccccactctcgatagagttcagcgtgttgagcacacctcatgctgccaacgttgcatgctcatctctttcaggtgtggcattcccagggggcttgtgtcttgaaaaccgcaactgttaggaccctttatactcattaccttcagtactgcttatgtctccctaagttactgtcgccttcccca

SEQ ID NO: 697821 - DNA, 715 bp, Homo sapiens
tggcatccgatctggggtttatccaacacaattctcccactctacacaacaatagtacaaacccaaggtcatctaaaaggctccaagggttataaacactccaaaagagaatatttttatagtcactggcactggtgccaatggacaacgccaaaaaagaaaaaaatataaaacgcaatggtgcactttgttgcggccaaatatacacctggtaaagcacccacctatgacacgggcaaggcacacacctagagtgagctgtgcgtgtgatgtgtactctccgcgcagagagactgtgtgtctctctctccaaactctacactctcgccgcacattttctcacagagtataacacggtggtgtggcggtgtgcgcggtgtgtgtgtgcctctcggtgtgcagcggacaggacagaaacccccgcgagcacgagacacacttcaccagtgggtgtgcagagagagcactcattgtgaaggagcggtgtgtgtgcaacccttggagagacatctcagaaagagagagcccctcgagagagagtgtccccagagacccaataaacgagtggtttgtgggccaagaatgtgacaccaatacaaggcccgtgagggagacaagacatcacacttaattccaaaagagggacacaacggtgggcccccagacaaaaacagacaaaggggaccacggggcccgtggaacccaccaaaatcaa

SEQ ID NO: 697822 - DNA, 377 bp, Homo sapiens
ctgtacatgagtgctcagaaagcatataaatgactgcgttcgaagttggcatcctctaatctacgcagacacttctttatgcgcaatcatttcacctattacatatttaggataaccactgccttatttcatttttaattcaatttgaatggctagaaatgtcttccttatatttcagcaaaatctgagctgctctgtgtgatattgtcatccacgagtatcaccttacagaatgacaaagagaaaaatttcactccctttacaccttttttttttttttttttttttgggaaaacggggccctttttgggcccccgggtggaagtccggggaattatacttcttggctaccaggagaaccctccacccctcggggt

SEQ ID NO: 697823 - DNA, 239 bp, Homo sapiens
atgtcttatttttctttgtttaggaagcaagataggctctagaacttggactttgagttaacaattttaaattaatgagataattaaataaatctttgtttctttggttggaatgtagtcatagaaacctgaggctttctaacctaaattgaaagatggagccagagagagaatatgaataagaccaagggaaattgatagattataaactggttatagatttttgattcccctctatc

SEQ ID NO: 697824 - DNA, 229 bp, Homo sapiens
actagtccacgtgttgtgtgtcgatctgggtgttcgcacgtaagcttcgtgtatcaagtattgtgacctcccgaggagctggggtgaccaccagagttgcctaaggattgggtgaaccttgcccagtgtctggaaactggagcagtgtcaataactccctgtgcgtgatcatgtagtgtggatctgcgcgctgtgaatatgccacttgcagtggtacctgaggctcgaa

SEQ ID NO: 697825 - DNA, 447 bp, Homo sapiens
  misc_feature (116)..(116): n is a, c, g, or t
  misc_feature (243)..(243): n is a, c, g, or t
  misc_feature (370)..(370): n is a, c, g, or t
  misc_feature (432)..(432): n is a, c, g, or t
  misc_feature (439)..(439): n is a, c, g, or t
ccagacatcggttgtcagcaggtacccgcagagagcagaagggagactggaagcgtccccacaggaccggaacccatgcaagtcctggcagctccggtggatgtcgcatgcggatnccgtgcgcggatcagccttgtccctccacctctgtacccagaatgtcctgcactgaggccccacagcctatcccaagcgggtaccaccaccaccagcaccatcattgccttggggccaccgcgcgcntcagcatctctgtggagggtgacctggaatgcttggtgtgccgagagcctacaactgtgctcggtcccccaagctgcttagctgtcagcacaccttctgtgccgtatgcctgaagcttcttgctatntgtgcaggaagacacctggtccatcccctgtccgcttgtggcgaaaggtcactgctgtcccngggaggnctcatctg

SEQ ID NO: 697826 - DNA, 181 bp, Homo sapiens
gaggtattatcagcgagcagagtgatctccggtaacagaagtcagatcatgcctttctttgctactcacattcctgctaaagtgtcattctgagtaacttcattttacttgagtaaaagccagagtcctttccctgtgcccatgtaggcctgccagtgatccagtgtcctcctctcccctg

SEQ ID NO: 697827 - DNA, 395 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttctcaacgctttatacttccaagatcaagaaaaataagaacgtgaagtataagcgttga

SEQ ID NO: 697828 - DNA, 880 bp, Homo sapiens
  misc_feature (548)..(549): n is a, c, g, or t
  misc_feature (591)..(591): n is a, c, g, or t
  misc_feature (661)..(661): n is a, c, g, or t
  misc_feature (682)..(682): n is a, c, g, or t
  misc_feature (685)..(685): n is a, c, g, or t
ggaaggctgctaccatcccagtgagccaaagtctctaccattgcaggctcaatagatctgaagtgagatctttgacaagatccacagcctgctctctggaatacctgttcaatctggtgggcgctctgtgtctgtcacatcttaactcctacaggggctggacatttgttcaattactaatactggctagatatatcttgtgataacaacggcgaggaggaacgtggcctcttcaccagtgaagcagcagttcccgcagttgcaagttgtggcattccgggattctgggaagctccactgccaagatgtgggggacctcacttcttgctcattctacagtaaggaaagtgtccgttacgtcgtgtgtcctttgtctaatccgcatctttccaacggagggacatggcttgtggcacagactattcatagcggattgcttggttgaccacagtacaacggacttccaaaagtggagcaagcgaagacaaagcttttctaaaaacgcaattgtcagggcatgaatccgtctactacgactgctattcatnnccagctccggtggccatatgcgaaacccgacagcgagattcnaccctcatggccttaaatccatggcatggccgctaggttgggcacagaatttcttaaacattggcagccncttgtccagattgtgaacagncanccatccttcttttgaacttccttgggaaggtgtggtgggaaatgcccctcattgaaggcaattacacaggttccagttccctggaacgattgctaaatttctcattcaaacagagggacctaaactttcccaagaacttggaaggctattcacaaagctccaggaccagattgggctccctttcatacgccctcg

SEQ ID NO: 697829 - DNA, 572 bp, Homo sapiens
tgattagaggatcccatgccataacctccatctaaagtcaagaccaaagaaagaatcttaagaactatgagacaaaagtgtcaggtaacccatatgttaatctaacttattagattaaaggacatttttcagcagaaatctcacagatcagaagggattagggtcctatctttagctgccttaaacaaaataattgtcaggcaagaaatttgaatccagcaatcctaaggttcataaatgaaggagagataaattatttttcagacaaatgctgacagaatttaccacttccaagccagcactacaagaaatgctataggagttctaaatcttgaaacaaaacctcgaagtacaccaaaataaaaccttcttaaagcataaatctcacagggaaagcaataactgacaatggggggaaaaaacaaggtattcaagcaacaactagcatgatgcatataacagtgcttcacatcttaatactaatgaacgtaaatggcctaaatgttccacttaaaagatacagaatggcaggatcgataagaatccaccaaccaagtatctgctgtattcac

SEQ ID NO: 697830 - DNA, 697 bp, Homo sapiens
  misc_feature (28)..(29): n is a, c, g, or t
  misc_feature (628)..(628): n is a, c, g, or t
  misc_feature (663)..(663): n is a, c, g, or t
  misc_feature (667)..(667): n is a, c, g, or t
  misc_feature (676)..(676): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcactcaacgctttatacttctcaacgctttatacttcctcaacgctttatacttcctcaacgctttatacttcctcaacgctttatacttcctcaacgctttatactttctcaacgctttatactttctcaacgctttatacttcctcaacgctttatacttcataccggaaatgaaatgatttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 697831 - DNA, 127 bp, Homo sapiens
cggcacgttccaacacattccaacagtgcagaaccatcaacaggtgctgcagtcccgggtgcaccgtcaaaggcagttttgttgcaccattcaaccacatccaccacaggctcaagtgtcattcaat

SEQ ID NO: 697832 - DNA, 376 bp, Homo sapiens
ccagcttgtgacccagtctttctacagcagagcctgagctaggcaggtcacccattcgtggattccgctcagtacattaagctcctgactgaccttaagaactagctgcacattgaggtcaagcaaaatgccattggtgtagtgcacaatgtacagctgctcctctgccctctgggtctcatccatcctgcatcggttctggtgcacgtccagtaggtccaagcctttcgtgggctgcacatgtgcatgttgctcatctgtgcctgtgtccctctcgtcctaatcagccatcttaagtcatcgtaggcctccatggtgtacctttcgtgacctataacagtcacatctctatataggtcatgacaagttgtgttat

SEQ ID NO: 697833 - DNA, 353 bp, Homo sapiens
gggttttaaaaaaattttcccgggggaatccccggggtttaaaaaaagggaaaccccttttttaaccatggttttccgggtattttaaaatataaaataaaggttttcggggccgggaaattttttggggcccaaaggtttcccccggccttgggcccaagggcggggatttccccttttccgaaaatttttcccccccggccttttcccccgggggtttaggccctccccttttatagggggtggctttaaacccccaaaaaaaaaatggtttttttgtttgatttaaaaggggcccggggggttggtttcccaaaggtttttttaaaaaaaaaaaaactttttttggccca

SEQ ID NO: 697834 - DNA, 358 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcataccgggaaatatagagctgaggaagtataaagggatcctctagatcgccgcag

SEQ ID NO: 697835 - DNA, 481 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcactcaacgctttatacttctcaacgctttatacttcctcaacgctttatacttcctcaacgctttatacttcctcaacgctttatacttcctcaacgctttatactttctcaacgctttatactttctcaacgctttatacttccctcaacgcttctcatttcatttcccggtatgaagtataaagcgttgag

SEQ ID NO: 697836 - DNA, 379 bp, Homo sapiens
atatatatgtgtatgtctatatttatccatatatacaatataaatgtacagtatatgtaatattgcatatgtaatagctattaaattgtatactgtatataatagctatattttatatacacaatgaatatatttatattttaataaaatttgtgtatgtacattttatgtttatatatcaaagataatatatacaataacatcacacaatcattcataaacatcatattttgcatgcatatatcaatcacacacattcataaaattcatttatatcacaaatatatcatggaaacaatagctcattagttcttatttctcaatctagggtcagtccacagcacggggatcctactagcagtccgacctcgccaggcat

SEQ ID NO: 697837 - DNA, 370 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctgatacttctcaacgcttaacttctcaacgcttatacttcgctcaacgctttatactatgaccgggaatgaagaaga

SEQ ID NO: 697838 - DNA, 417 bp, Homo sapiens
  misc_feature (28)..(29): n is a, c, g, or t
  misc_feature (77)..(77): n is a, c, g, or t
tcacgcttcaaccctcaacgctttatannctcaacgcttaactttctcaacgctttatctatacttctcaacgcttnatacttctcaacgctttatacttctcaacgctttatacttacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcataccgggaaatatagagctgaggaagtataaagggatcctctagatcgccgcag

SEQ ID NO: 697839 - DNA, 346 bp, Homo sapiens
  misc_feature (34)..(34): n is a, c, g, or t
  misc_feature (231)..(231): n is a, c, g, or t
  misc_feature (334)..(334): n is a, c, g, or t
gcctgtaatcccagcacttagggaggccgagganggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcagggagaatggcgtcaacccgggaggcggaggttgcagtgagccaggattgtgcgactgcatnccagcctgggtgacagggtgaaacgccatctcaaaaaataaaaattaaaaaataaaaaaagaacctgggatcttcaatttaatttttcatattcttgccaatnaaatgggacttg

SEQ ID NO: 697840 - DNA, 357 bp, Homo sapiens
  misc_feature (1)..(1): n is a, c, g, or t
  misc_feature (168)..(168): n is a, c, g, or t
  misc_feature (229)..(229): n is a, c, g, or t
  misc_feature (338)..(338): n is a, c, g, or t
nttcggcacgaggaggtcccctgggaagctgtggtgggactggaaggtcgcaggacttccaaaatctaagttctccagaacagagctgctccaagctttagtctccactcaaaagggtcacttagtaagttctcaggtccctggcttagtgccagcttcccagtagtntgtatactagatgccttgggaataaaaccagttccctaaacctatcccgtgctcacccacnacccgtgacagctgccaaagggacagacgcaaaggctcctttcctcaaggccccctgcagacagcactttccacaatgaagggtgtcagtgacccagccagaaaacttntttaaccacttctgggtaa

SEQ ID NO: 697841 - DNA, 348 bp, Homo sapiens
taggtatccatcttgtatccctggtcttcccaagacttttaacattaaggggtgttggattctaatgagatgattatgtgggttgttttctttgagtttgtgtacatggtggattatgttcctagatttttgtatattcaaccacttctgcatccctgggatgaagcctccttgataatggtggttgatgtctttgatgtgttctttgattcgatttgaaactattcacttgagtgttttgcatcaatgcttataagggagattggtctggactttctttgttgagtctttgtgtggtttaggtattagggtgactgtggccgagtcttctgcaaaaaaaggaaatgg

SEQ ID NO: 697842 - DNA, 83 bp, Homo sapiens
tcaagcttctaacgatgtacggggacatgggctgtacccaagctgatttctcatctggtcaataaagctgtttagaccaaaaa

SEQ ID NO: 697843 - DNA, 274 bp, Homo sapiens
  misc_feature (45)..(45): n is a, c, g, or t
  misc_feature (61)..(61): n is a, c, g, or t
  misc_feature (198)..(198): n is a, c, g, or t
  misc_feature (207)..(207): n is a, c, g, or t
  misc_feature (216)..(216): n is a, c, g, or t
  misc_feature (226)..(226): n is a, c, g, or t
  misc_feature (244)..(245): n is a, c, g, or t
taatctgtaccttgcgggagtacagtgaagaaacagagacccctnaagcatccgtatctgnatggaactgtgaagacatcatgtgtttgactctaatactgtcactgacatgctcatgaccattctgtgcccgctttggcatcaccaatcatgatcaatattcattgcttcgagagctgatcgaccagaaaaaggagnatataacanggacctttngaccggacangaccattgctgcgcaatnngttcagaattacggtaccgatgctcgaag

SEQ ID NO: 697844 - DNA, 999 bp, Homo sapiens
gtgcccccaacgcagacagggggagaacccccaggtggccgcaaccaaatgggggcggcaaaccgcggtgcggagaaccggctgggcgcgcccacacccgagggccggggacgccggcgagtcctcggggccgccccattgccggccccctccggaggcaccaaaggggagaaagcgcccccacacgggcgcgcgagatcccgggggggctcttcggagagcaccccccgcgccctccctcccgggggggacagagggggccccacggctgccacacccacgagagaggtgccacaggaggcgcccccgcagtcaagacaaacggcggctgcaagcgcagctggctctggggggtcaacagggagacacaccaccttctgcggaagcgcccgcggcccccccgtacggagacagaccccctccgcctttgggagcgagcctgggcacaacacacgccctgtcccccaaccgggggggttccacgggaccacagcgcgcgggggggccacacacacccagggagcccttaggggggccccggcgcaaagccaacaccgggggattccgcgcccctccctatacccctgggcccacgtctcgtgccaaccttggaaggggttaacaaagcccccccctctgccaccgtttttgttgtgaaagagattttttttttggctgggaagcagaaactcgatgttcatagttgaaaagaaaaaagtgggtgtaatctaacacgcggagggcgaaaaaggggccatccccgcggaagtggcccccccccctgggactcatacagcccccggggacatctgtggagaggggagccccccccccctgccccccccccctttgcacccctacctggtgggaaaggaacccgccccctgagtttttataagaaggttaattttaaaaaggggtttgtgggtttggtgggggtttgttttttttatggaatctaatttaaggttaaaaaaaaaaggggtccgttaatttata

SEQ ID NO: 697845 - DNA, 995 bp, Homo sapiens
catatactgatgtccaacttccgccggcctctcctggggtataggtccccggacttgtgtttcgcactcgagggtggaactcaccaaagtaggccgggctcccaatgtgctacaccatgagtgaggggccccccccttttgtcggccctttctgagatccccccattctcatgggggctcaccagtagtgtaacctcccccccttgtcaccccatcctggtaaattcccaaatcatcctaggtgccccaccgaattgaatattgtgctttttggttggtgcctatgtctggctcccccaagcggtgcccgtatgtagccgtctacgggtgcttcgtattatgttcttgtgttgtcttattcgctcggtaactccccgcggggcttccctcgtggtacgtgggtataccccctttgctgggccaacctttcgtggccggttggccacgcgaaacccctgtcgcgcggggttcctccccccctgttctctcgtaagggtccttctgctgtctcctttcccgtgcaccgaatgggtccctacactgttgttgtgaacgaaacacttgacgcaacttgtgcgtgttcacctacaggagttcctctaataatcaacgggactccgcggactttggggtgggttgccacttgggtggcttctcgtaactggtggcgtcccacaccttcgctcggagagtgactggagtggcgctggcgtcggagcatcgtgatgtccagtatggcttcctggccattgagtgacccttgtgaaaaagaagaccacgtgatgctatggggcatcctagacagacagcagacgggtaagatatcacacagagtgcgcagcacgcaatgcggctcgctgccgtcggccagctcctataaagtcactaggcatggaccctctgccttccacgatgcccaagaaaccaaagaatgataaacccagtggactacaccgttcttagatcccatcccaagctaacacctgggccatacg

SEQ ID NO: 697846 - DNA, 315 bp, Homo sapiens
tcccaggttcacgcaattctcctgcctcagcgccccctaataatagctgggattacaggcatgcgccaccatgcccggctaatttttgtgtttttagtagaggtggggttccgccatgttggccagactgatctcaaactcgacctcaggtgatctacccgccttggtttaccaaagtgctgggattacaggcatgagccactggacccagccatggctgtatcttagttggcttaaccatttccttttattttaaacttttctttcgaactaattttagatgtacagaagagttggaaaaatatagcagaattc

SEQ ID NO: 697847 - DNA, 406 bp, Homo sapiens
ctctagcgttcggaggccggattgagaggtgctctcgcgagattgtgtctcattcctaagccggtgctcggcaagtactcgccagcgaaaaagccaatgctgcaagttacgagcgccagagatcgatgaaagccccaaaatggcgagcacaggccggacgtatttcgtactccggacgatctcccagggctctgtctgagaacgtggagtatggaatgtgcgaggaactcgaaggttgcgagactccaggggagctggaattattgacggagaggctacggagaatggaagattggtgggtggtgcgggaaagactaggtcataatcttagttcccgtgtcctccacactgattatcttttccggatcacatccgagtccggttagataccgcgaataggtgacaa

SEQ ID NO: 697848 - DNA, 124 bp, Homo sapiens
  misc_feature (104)..(104): n is a, c, g, or t
ggaggaggccagatgcggccagcgtctccaacagggtgaccatccgctcggcttgctgagcgtttaaacaaatgtttagacaggctgtggggactacactgatnctagtcttggccggtggtcc

SEQ ID NO: 697849 - DNA, 635 bp, Homo sapiens
  misc_feature (89)..(89): n is a, c, g, or t
  misc_feature (101)..(101): n is a, c, g, or t
  misc_feature (132)..(132): n is a, c, g, or t
  misc_feature (136)..(136): n is a, c, g, or t
  misc_feature (160)..(160): n is a, c, g, or t
  misc_feature (173)..(175): n is a, c, g, or t
  misc_feature (189)..(189): n is a, c, g, or t
gagttgcgtcatatccggcccttgcgatcagggcttgaggaacccgcgccatgaagtgcgtgtttgttaccgtagggaccaccagcttngacgacctcatngcgtgtgtgtcggcgcccgacagtctgcaanaaantcgagagccttggttacaaccganttatcctgcaaannnggtagaggaacggnggtacctgaacccttcagtactgagtcgtataactctggatgtttacccggtacaaaggattccttgacaacgcacgaccattccagaaagcagatctgtgtcattagtcacgcaggtgcaggaagctgttgggagactctggacacaaggaaagccactcgtaggtggttaataaacgcacacagttggatgaacaatcatcagctggaacctgtggacaaaagcagctacacaacagagggtcatctcttctatggtacctgcgagcacgctttccttgggcttggttacaagttcaattggaccttcatccaacacgtgacaagtgttttattcctcactggccaggccagaaaaaattttctggcatctaaggatagagtatgtgggattaacaaacactaacacactaaactctcaaaactttgaaaagacaacccccaat

SEQ ID NO: 697850 - DNA, 130 bp, Homo sapiens
cagctggccagactgtgcctggagaacattgacaaaaacactggagacgccatcaccgcggaaggcttcaccgacattgacctggacacgctggtgggtgttctggaacgcaacacccggcgggaacgca

SEQ ID NO: 697851 - DNA, 289 bp, Homo sapiens
gacggaggatctcgtcacttctctccgtcctctgcattcttcctgttccatcataagccaaatccatgagaaatgacctgaggtggtgaaggaactatcaagtagaacagactcacgctcaataaggtccagtgccacctccccttcagttctgatgcagccgctccaggtggtgatagcaacagtgatgtgcgccgccatgccaatcacataatcagaatcattgctgcagagctgaatgttcccttcatccagcccttctaatagctggtccctgaatgtatcgtca

SEQ ID NO: 697852 - DNA, 336 bp, Homo sapiens
tttttgggggcccctggtttttttttaaagtccccaaaggaaaggggcccttgttttttttttcccccccccccatttttaaaccccccgtttttttttaaccccctccgggttggttttaaccccccacccccgtttaatccttttttaatttttcccgtccctttttttttaaagaaaaaacccccaaaaaaaagtttgtccctttccccccccaaccccgttttttttttttccaatttttttttcccccattttttggacccccccacccccccccccccttttttagggccccccttttttttttttttttacccctttttttttttttta

SEQ ID NO: 697853 - DNA, 907 bp, Homo sapiens
  misc_feature (442)..(442): n is a, c, g, or t
  misc_feature (523)..(523): n is a, c, g, or t
  misc_feature (556)..(556): n is a, c, g, or t
  misc_feature (562)..(562): n is a, c, g, or t
  misc_feature (574)..(574): n is a, c, g, or t
  misc_feature (589)..(589): n is a, c, g, or t
ggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagagggcaagatgagaggggctgccccagggaagaagacatctggtctgcaacagaaaaatgtcgaagtgaaaacgaaaaagaacaaacagaaaacacctggaaatggagatggtggcagtaccagtgagacccctcagcctcctaggaagaagagngcccgggtagatcctactgttgaaaatgaagaaaccttcatgaacagagttgaagttaaagtgaagattcctgaagagctnaaaccgtggcttgtggatgactgggacttaatnaccagncagaagcagctnttttatcttcctgcnaagaagaatgtggattccattctggaggattatgcaaattacaagaaatctcgtggaaacgagagataataaggagtatgcggtcaatgaagttgtggcagggtaaagatctcacgtatgttgggtcccagttactctataattgagagacccaggatgtggattctgcgaatcttcgagcccagtccgggtgtgggcacatcggagttgggatgggatgcgtcccccggggaacggttttcattccaaccaacggaaatgctgttgcgaaaggtccccaagggcaccatgttcctctttaaggattggtaaccaata

SEQ ID NO: 697854 - DNA, 275 bp, Homo sapiens
atgggcggcttgtatgattatgggcgtagatatagtagtagttacaggttgaacatgtctgtggtgtatatatggtaataagagagggctcgggggaatacggttatgtgattaggacgtagggttaggatgagtgggaagaagaaagagaggaagtacagtttaattatgccttttagggttgaggtgactatggaggtggcgatctggtgctgtgaactcgctctaggtaatagcttccctagtcaggttcggtctaggatacagtacggaga

SEQ ID NO: 697855 - DNA, 480 bp, Homo sapiens
  misc_feature (324)..(325): n is a, c, g, or t
ccccccactgagcgcccactgcttgcgtcggggccatcaggaatagcagtgaggggggctctgtggctccctggagctctcagccgccttgcatatctccaggggcttctggaatggtctggatctgtatacagtttcagggtttccttgcttttccagtctgagactgaaactcatcctctaagcatttgaaagaaacaacaggaaaactcaatcctctttccttccacagcacatttagggtgagagcttcacagctgaaaatctcctttaaagaaaacgcggcccaaatgtgctgggaggagaagccagtggatctaggannggcgggttgccggctctgtctctgggctgacaacctggtttcagtattggtaagtgggtcaaccccagctccagcggctcctcctcacctctgccgattgagggccactgcaaatttcaagcagaataaaagagtattctgagggccactgcaaa

SEQ ID NO: 697856 - DNA, 676 bp, Homo sapiens
  misc_feature (93)..(93): n is a, c, g, or t
  misc_feature (197)..(197): n is a, c, g, or t
  misc_feature (229)..(229): n is a, c, g, or t
  misc_feature (271)..(272): n is a, c, g, or t
  misc_feature (279)..(279): n is a, c, g, or t
  misc_feature (284)..(284): n is a, c, g, or t
  misc_feature (289)..(289): n is a, c, g, or t
  misc_feature (299)..(299): n is a, c, g, or t
  misc_feature (324)..(324): n is a, c, g, or t
  misc_feature (345)..(345): n is a, c, g, or t
  misc_feature (368)..(368): n is a, c, g, or t
  misc_feature (388)..(389): n is a, c, g, or t
  misc_feature (413)..(413): n is a, c, g, or t
  misc_feature (429)..(430): n is a, c, g, or t
  misc_feature (439)..(440): n is a, c, g, or t
  misc_feature (442)..(442): n is a, c, g, or t
  misc_feature (447)..(447): n is a, c, g, or t
cgataactgttaaatgtggtgattaccctacccacgagcacagcagagctggatggctctaagtcctcagatgacaagggaatagtcagctanctctggactcgagatgaggggagcccagcagcaggggaggtgttaaatcactctgaccatcaccctatcctttttctttcaaacctggttgagggaacctacancttttcacctgaaagtgaccgatgcaaagggngagagtgacacagaccgggaccactgtggaggtgaacactgnntcccatngaaanacaancctggtggangatcatcttggatatcaacgtcagncagctaacgtgagaggctganaggggatgttcatccgccagatnggggtcctcctgggggtgcnnggattccgacatcattgtgcaaanagattcagccgtacannggagcagannanccaanagatggtattctggtgttcaaacacgagcctccccgagcagatcttcaaaggccatgaggtggcagcgatgctcaaggagtgagctgcggacagcccgaaggcagactttttgatattcagagccttggaagtctaacactgtcacatgtcagctgaactgttccgaccatggcactgtgactcgttcaccaaaacgcggtatcttgtgacccttttggctgggaactc

SEQ ID NO: 697857 - DNA, 138 bp, Homo sapiens
cggcacgaggcagatagtggtccctgcttatcccccagggcctgcctaggctacaactgacagtaatcccaagagctcccctttcagggattgacggagtgatgtcacctgtgtggactcagctgccacctgggattg

SEQ ID NO: 697858 - DNA, 122 bp, Homo sapiens
cggcctgaggtgtcggccggatccctccttctccggcgctcaagcggaagaccattcctcaagacttttgtattcaagggccaaaaggttgttacccaagatgatgaatgctgacatggatg

SEQ ID NO: 697859 - DNA, 162 bp, Homo sapiens
gctcctacagcatataggatgtaacatgtggtgtatgcatcggggtagatccgagtaacgtcgggacattccggataggccgagaaagtgtagtggaaagaaagttagatttacgccgatgaatataatagtgaaatggataatgagtaagtaaggtctaag

SEQ ID NO: 697860 - DNA, 102 bp, Homo sapiens
ctagccgagctaccatactatacctgggatacataggaaaatataccttacaaaatagtgcccccagataatatatatagcgaataagctaggaccataagg

SEQ ID NO: 697861 - DNA, 100 bp, Homo sapiens
gaccaactgtgagatagaaggcacaggtattcttttgtccagtctcctatccgagcttgggagccttttctactatcaccggcacccggtccgggtattt

SEQ ID NO: 697862 - DNA, 1150 bp, Homo sapiens
ggcaagatggcacgaagtagagcatgaagaagaatgcaccgttccggatggttcatctaccgcggcggtgtacctcgatcagctgcgtggacatgttctacgaagcgacgtgtgagtgcaggtgtacaggttgcgcgccaggggcggcggtgtgaaccggggcctgttggcggaagcagcacttccctgcatgaagcgtctctgcaggcaagggcgatgcaaggaggcgccggccatggagtaagccggaagtggtgaagacgcaccgtgcgggcacatgatcatcctagccgagatggtgggcaggatggtgggcgtcttacaaatgtgaagacccttcaagcatgcgtggacgatcagggccccgagaatgatcagaggcactagcctggtgcagaatcttcgtccatccaagctacaatgcgcgtagaatgcattgtgcctggccccgcgtattcagtggggccactccaattctctacaccagcttacagtccacttcttcgatgtaacttggtgctcagcctaagtaaagaggggcgtccaatacttgagcttcgaacacaagaggtaccttaagcaacaagtactattgacagattatctacacgagaacttataccggttgaacaataaacatttttacgcagggtcgtggcgttggctgcatagcggtatttacgcaccagacgagtgggagccaggcatcgacgcgtggaaccacccaaagagaccgtcaagtgtgagctgacaagaaggagggcaccccctggtagatgagaagaggagacgaagagaccaaagacgaggggcacagagagggagatcgcgggtgacatgaaaaccggggagcagcacacacggggagacacgcggcagaattgagcaaaaaaaattaatcaaagacaaagagaaatgcaacaaagaaccgtgggatgtgcgttcaaaacatcgaggagtgtcgatcgcttgaaaagaaaagagcatagcatggggatgacccgtaggtggaaatactaatagtaaccaaatccaaggagcaattaagaggaatattaagaacccccctaacggtttaaatctgtggaggtacgcaaatgatgtcactacatcagtgaagtataaaatgagaagatacattaacacacgg

SEQ ID NO: 697863 - DNA, 118 bp, Homo sapiens
  misc_feature (82)..(82): n is a, c, g, or t
ggcctacaaactagggtttttatattcccttttgttaatggctcaaaataatattttgtataatatgaaaattacgaaattntagtttctctaaataaagttttggaaagaactacca

SEQ ID NO: 697864 - DNA, 1126 bp, Homo sapiens
cccgcggagtgttatctctactgatcaatataaaaagctacacgtcgtgtttaatgaagccggccctcctccttctcagggggtttgttgtggttcaacacgcgggtctttgtgttgcccacaaaagtggttgtccccgacaaatactgctctcgtactgtgcacagagatgtttggatacaaccgtcacacgcggggcgcggggggggcgacacaaaattgcctcctcttcttgtaggaagacaattgatctcttcatcatcacacgcgggggggccggcatattatcctttctctcccccgacgcagcagaggtgtgttttggcgcggcagataataagtattatcctacagagcagccctgtttgttctcaagcacgcgcggagtcatcatcgtagaggcgccgcgcggggatgatattatatagcggtgttctcttgttcagagcgcacacacagatacctctcgctctctcacgaggggcgtttccactaggtagttgtgtgtgttagagaccccccggcgcctcttctcgtggaaagagaggcgccgcgcccaccacctggggagaaagcgcccacacagatgtgttacacaggtgtctcacttatcttctggggagggggaaatgtgggagacaccaggggcgtcgtttataaagacccgtgttttctctcctgagataatttgtttcaccacgtgggggcgcacccccgcggagagaaaatggggggagataaacgtggatgtaaatgtggtgttttcacacaccgcgaaaataatgagacgtggctatctgtgttgtttaagacgccaacacactggagatttgtggtggacgcttcttatttgtgggccaaggaggggaaaagagaaagttttagcggcacttttgtctggtcccaaaatgtatacacaggggcttttgtttagaagaattatttgggttgttaaatggggcaaaagagctttttgttgaagccaccagaggggtgttgttaaaaatacagtggggcacttatcacgcacaagggtttttttgcgcccccttttttttataaaagggtttttttgtttttttgggaaaaggggagggaacaaaaaaagggaaattaaaagggtgga

SEQ ID NO: 697865 - DNA, 126 bp, Homo sapiens
gactcatagagatacctgcaggatttggactcagctgcaggagcgttaggagggtcggagaaataggctctcgaaggggaaaattcaacgtgaggagcagtacaaggacgcccgaagcacagtgga

SEQ ID NO: 697866 - DNA, 551 bp, Homo sapiens
tttgtggttctggctcactggcgatcccactctccgtacatctcttcatcccatgctcctcgcgtcttcttagtcatcgaggctcatggatatgctcgggcttgtccattcctcaggctagcgagtctgtatcgatctatcgagtcttggcccgcccatcccagtcttccggttttgaagcatcaggatcctttatcttcttggctggcaggacgtcccaatcgtcttccaaggagccgcacatccacctggctgttgtcaatcttcacctcataggtgttgtctggccgactcaatcggtgtgatacaggtttgtaaactcatcatccttgacaacggatgtccttcttgatcagcacgttcttgcccttgtacttgaagatgacatgaaccttctttggtgccagaaccagaaatttccgatatttgtggtcctggccatagataaatacacgggtataacttctacaggcacggtatatgtcagagtacccggatttcaatgacaattgtccaatagctgtcctcgaaaaagatgcagtatgaatttc

SEQ ID NO: 697867 - DNA, 1410 bp, Homo sapiens
tgattatctgtttgcaggactgcggtgagacggttcgtgtgttgtagtttttgtgtctctgtcgatttgtgtgtaatattgcatgtgcgcatgtttggcttgtgtgtctggtctgtgtgtgtctcgctgttgtttttgtttcgtgtttgttcatgattgtcacggtcgtctctctacatattctttggtcgtgtgttatgtcgatcgacgcagggcagtagtctctttgttgaggagggagcgaggctggggtcttgttttttttataaggggatggggcctcttcttttttgggggggccaccctcttttttgtaccagatgggggtctctacagatggcgtctccaagaatattcataatcgcaagccgcgactccaacgaggggggggcccacaagaggacccggggacgcccggccgggggctctaccacagagagaccatactatgcgcacaatttgacccgctcttccaccccacaccggggttgaaaaacccccttccgcggcgtccaaggatgtccgtcgcgttcccccaaaggctcggtgtggtcttaaaagaaaattatggggggagaatttctcctctgtgaaccgttcaaaagtgtgagataaaaagggcgccctctccccggtgaagtcccccccccttccggtaaattcaacttcgcggtttctggatgctcttgtgtcaaaaacccacggcctgggaccgccttttcttgaaacctcccgcgggatgggcccctcgcttaactagaagcttctttcttctttaaaaggggaatgctcggttttttttttgaagggtgtttccaaaacaagtttgagaaagcactgtaaacctttttgagcgccccgaggccaacatgagagtgtttcacaaaaaaattcgcggggttgtttttgggttttttggtgttttgggtttaattctttggtgtgccttgccctctttttgttttaaatggggttgggccccacatcgagaagtggggtgccccacactccaactttcttctgaggattcggaccggagctcgtgaaatcccccttctttgtctggaagactggagccagactgtggcttttttccgaacatccgctgtgacagtttttggagatgttagatgtggttagggaccccgcgcgggtttggccagaccaactgccctgggagacccccagacccctgcgtccaatctgtgctgtgcgccccaccacgtagaacgtgcacgaacgtccctgagagggtttttgaagatagtttaatttatattgtccttttttaactggagaagaacgtaacgcactaactccactcgaatgttgtatttgccgtggctgaggaatttttgtacgcagttttttttggctttacgaaaccgatttaaagaccgtgtgaaatga

SEQ ID NO: 697868 - DNA, 1301 bp, Homo sapiens
  misc_feature (342)..(342): n is a, c, g, or t
ggcagcaggaggcaatggaagcgacggggaccggggatgatggtgccaggtgcctggggtcggggcgagagactgccgggactgtagggcagcggccctgggtcgcagggtatccggagcggccgacgggatcggatcccgggccgggcgggcgggcaaggatgcgtgagcaggttgatgagcggaagacagtcaggagcctgtgagcgtcgaggtacgggcatggcacccggtgcggctgcgtggtgacgaccgggcgatgtgagcaaccatggagccactaccatgagaaagacatgggcaaagcggccaggtaaccttgttatgaatcctatcctttgnccacccaggtctgacacctctaagctttgacgaccactactctactattgtggtgatatgccagcgtttggatatcacccccatgagttaactgcaaagtccgcgccttggcgctcgcggacattttaccagatacagtcttgtgagggtagaagaactagttgggaccgaatcacccagggtctcttcccattacaggcgaagtggtgcgattcctgtgggtgcaattgtttgttagttccttgggcaagcaaccccatgccctgctgtccgtgcaaaacgtaaagaagactaaacccgtggtgccacgatccggtcaaacaggcaaggtgaggacatgctctttcctttgcagacgaagttgtgtggcacattgacgtaactcctacttgggaaagaatggggtgcgacatcttcccccaaaggtggcttcggggtagctaaactaaaatcccagacacgcggtctgttggcctctttgacccctgagtgaattgttccgctcgactggggggtaccactgttctgggacgaagaggctaatgattgacatggcttaatttcgggaaggggttggcaaattaggaatttcaagtgggagtctaatgggggcatataactttgggaaagaaagtggcacaaaggtggtcattaaccagttggatacacgaataaagattggagagaaataagagtagaaatctaatacaatacacacacggggcgaaaacctccaggagggaagcagagcggcgaactcaacggaaatgagagcacgccccagcgcggaagcccaaacgggagactctaacaaagggggcgagaaccctggtaaaacacgaaaacggaaacgagactggtcaggagacggcgcaagcagcgtcccacgccagacaataggcgagcaacaccgacacgagcagcaccgtgcaaatagttaacaagcatgagcacacaga

SEQ ID NO: 697869 - DNA, 376 bp, Homo sapiens
actcgaccttcaatgcgccgtcagagccgggaagaaaattcccgtccgcccatatccggccaatgcgcgcgatcggtatgctcgacacggcgaccgcaagattggaagaatagctatacgtacgttgtcgcgagccgggttttggtacccccgttgacagtccgcctttcgatcaaatcgctcgcccatataaccgtgccggcaaacatcatcgtaccaaatatcgctggaattgcagtgccataactcgacgtttgcagttccagttcctgcaggcgcgggcccgtcgcgacgggggccatttccaactatagcgcgatcgagctgctagccaagcatggccccaacagcaccgccgacgggcccgccaatcgcc

SEQ ID NO: 697870 - DNA, 975 bp, Homo sapiens
catatcatactagcgtttagcgagtctcacgttcgtcggagtactagtatatcggtcacacctcatatcctccctactatgcctagaaggaatagtactatcgcggtcatgtatagcgtacgtctcataaccctcaacagccactccctcttagccaatatgtgcctattgccatactagtctttgccgccgtgcgaaaggagcggtgggcctagccctactagtctcaatctccaagccacatagtggcctagactacgtagcataaccgtaaacctactccaatgctaaaactaatcgtcccaacaagtatatattactacccactgacatgacgtttgccaaaagacacataggatttgaatcaacacaagccacccacagcctaattattagcatcatccctctactatttcttaagccaaatcaacaacaacctattccagctgtcccccaaccttctcgctccgatgccctaggaacccccgtcctaatactaactacctgactcctacccctcacaatcatggcaagcgaaagccatttatccagtgaagcactatcaggagaaaaactctacctctctatactactctcctacaaatctcctgattataaccttcacagcccacaggaactaatcatatttgatatcttccttcgagaccgacacttgatccgcgatcttggctatcagtccacccgatgaggaacagcacagatctgctgaatcgcatgcggcatacttcctattgtaacaccctaggtagggtccttaccctattcatcggctaaatttcaagttcacaacacctaggctcactaaatactactagtcgtctactgccgagagtatcaaactactggccaaaattaaatgactactaacaaagtataagacaccacttggggccactttgatcctaagcagggagccatccggtacaagtatgcggactaacagggaggtaagcc

SEQ ID NO: 697871 - DNA, 117 bp, Homo sapiens
acatgtctgacaacgctctgggggtctgggggggacgaagtacgaccaactacccctagattgtgggggggggaatgggtcactcgtaccccagatctcagacctgggtgctccccc

SEQ ID NO: 697872 - DNA, 1338 bp, Homo sapiens
tgggggggggggaaaggttaaaaaattttgggcttcttgaaaccaaagtttatattagtggctcctttatacactgtggaaaacaagacacacagaaaacagctgtgtgtccaaaagaagtaacattaaacctcaagcgaggggctcgtggtttctcaagaagcctttcgtggagtgttttacacagccgtgaatttggggaggggatatcacgagactctgtggtgtggcgccttttggcggagcccagtgtggtttaccgcccaaaatgttaatatagtatcattgtgtgagagaggatatacactctccactctctgtggggcgagaatattctccgtgaaaataagtcccaattcttcaaaagagtgtggggagatattctccctctccttcttataacttctctcttataatatattgtggggaccatgtgcagtgtgtgcgtcccacaaacgttgggggtatatctccaggtgaaatttttctatagtataacatgtagaacatatcctctatatatcactctgtgggaaaatcagcgtgtaaaagacagtgtgcgcacaattcacctgatggggaaatttttctcttcttctttataaaaaaacacgagttaaagtgaaaaaaactatattattctctccttttctcgcccaggcaagtgtgaagagtggttttaactatagacccaggtgggggggtggctcccctgagtgccacgtgtgaaaaaaaaacatggggggggaaaccttccaagagggggctcagggaaccagacacttctccaaaagccactttgtgccacatgtggtgtgttcccgggtgggcctttacaatttttttcaaatatttgccccccctttttttggggggtcaattgttctcccacaagaagacaacggttgtatcacaaacattacttcgtgcctcggtgcgcccacctttttttgtaactaacgcgttttacaaaaacgggagtttttctcctcggggccgttggaaaaattttgtggggctctcacggaaaaaaggaggcgcgcctcttttttccccctggaaaaagatgttttgagaagcaccttatagaaaacccgggcgttttacgcggttgttatacccccggtttttttgtgtaaatcccccccgtggtgggacacccaccacgtgggggtctttttaacacaaaaacatttcggctctgtgacccgccgagagggcttctaaacaacatatcattttgtcatcatataaagagagaatcataccacggtgcccaccaaaagttcttctctggcataaccacaaactgtgggcaataactagtaacgcgttgta

SEQ ID NO: 697873 - DNA, 368 bp, Homo sapiens
agtcacttgatacttctgattgtttcctccactttaagttaagcctgggcaacatgttgagatcctgatctggtttggctgtgtccccaaccaaatctcacttgaattgtaattcccacaattcccacgtgtcatgggtggtgactgaattatgggggtgggtctttccggtgctgttcttatgatagtgaatgagtcttacgagatctgatggttttaaaaaccatcagtgcagggagttgccctgcacaagctctctgcctgctgccctccacataagatgtgtcttgctcctctcgccttctgccatgattgtgaggcttcctcagccatgtggaactgtaagtccaattaaacctgtttcttgc

SEQ ID NO: 697874 - DNA, 897 bp, Homo sapiens
tggcctttatgaaacctaaatatttatatattttacattaaatggttacaatacaacttcaggcaaatgccaactggaacaccaagcccagaaattcagaggaaatactcttccaaacaaggaacaccaaggtaggatcttgcttccattccagccacaatactggtgatcataatggtgcctagtcagttatccagattatcgatgtgttcaccacatcatctattctcagaatgctccgaacagtttcagtcgcaagagtcagagcactgactgataccaccagaggtgtggacaaccagttcctccaaaatgttggaaataccaccctttcggacattaatgcctgcagatttttctccctgggcatgccggtttcttagttctgtcactgtaaaagatgggattcaggccggcattaacagtctagtgtatgataggaatgacctcgcatagaatttgcaaaagcaacgaacgcagtaggataccataccattcagtgtcgtgaatatcagttaatcgtagggccaactctattctgggcaccaacctcctgtaataagagccctctttttcactaaagacgaataacacatagggcatcatgaatggagcgccaggtgtttcaatcaccagtttgtaacccctgacacattggcactgtttcccgggctgcagcctgggaatctgaaccgttgcaaaaccttaatggcccccagtaacagaaacccacctgtggggaattgtcccataaacacggtgcgtcactgtccaaaaaacaacgtgtgcaaaacaacacaaggcttttaaagaggggacaacaccaaaaaaataaagaacctctgtcgcagaaaaagttcccgaaggaaaaatttgaaaaagtaataaccagaacca

SEQ ID NO: 697875 - DNA, 517 bp, Homo sapiens
  misc_feature (17)..(17): n is a, c, g, or t
  misc_feature (88)..(88): n is a, c, g, or t
cgggatcctcatccttngctccatcaaaaaactgcagaggtttccctcatcggcaagggggtattgggtgtcttccattatttctccngggttataatgaaattcaaatgatcacatccacctgattcacatttgaaaagaagagtacagtatatggtactgtggtaggataccagggtacatgtggtaggaagactaacaggagaacatggtctacccagttcagaaggctggacatgtcccacagtcaggtaggaattgaagaggaaggctgatggcccactaatggtggatgagagaattgctttgcatttacaaaggacatacgacatgctccttatttacttatttattttatcctttggcgtgttaatgagtacattttaaatgagacaacagctctcaatgatgtttaagacaataatttttaaaaactacttaaggtatttttacttattgtttcccgatatggcttttgcgccttctttacaagacattttaggtcatttttaaacca

SEQ ID NO: 697876 - DNA, 143 bp, Homo sapiens
tagaagaggctgcagaatatgctaaacttttggcacgagaatgaaggaggctaaggagaagcgccagtgaacaaattgcgaagcagacgctagactttcctctctgcgcagcttctcacttctaagtctcaaatgcaatcagt

SEQ ID NO: 697877 - DNA, 727 bp, Homo sapiens
gcaggcacagcccctccgtgtcctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagaggtctgggaagcccctgcggcttgggagagtgggggtcgccaggcagggggaaagcccctgtgccacctgctttttgccacgagactcacggctccagcagagtgcagtgagtggcatggtggggtgaggctggggccctgggcctgacctccacacgcctgcctggcctctctgtttgccatgggcatgacgagagcacagctgctggcgactcagaagcgggcgctggcagagttgacgagtgcgagcaaacggggcctggggctgcgggcttgtgacccctgggagcggagctttcttggagagccccctctacgatggtgcctctacgtgcggtgacgcgggtgcgggcgcttctgcacaaccttggtcagggcaacgtggagcgtggctcgagtgcgaacgagaccacccggctcagtcggggatgtgggagtggactgggctggctgcagactgggggtcgagcgccttctgacagtgaccggtgccgggaccgcgcatcggcacgcggccca

SEQ ID NO: 697878 - DNA, 468 bp, Homo sapiens
ggacagagcaggactctgtgaggacacaggcagaagacagcatctccaaggtacaggagagagacctcaggaggaatcaggcttgcccataccctgagtctcagacatccagcctccaggactgtgggatgaataaatgtcttgtgtgtaagtcatccagcctatggtattctgtgacagcagcctgaaatagactaagacatttcataagaagagatgagggcactagtacacacacagaggaaggactctgtgaggacacagggagaagacggcgtctacaagccagagagaaagcaagcctagcgacacggtgacctcagacatgtagcctctacagctgtgagagaataagtatcttttgtttaaaccacctggtctgtggatctctgtaacactcggcaaagctacaagacgaatacacggaccagagcattagaagcgccgcaggtggtccctggcagtcac

SEQ ID NO: 697879 - DNA, 1626 bp, Homo sapiens
tccacttctgtgattaagtaaatggatcttgctacataggttttctcaatgtcttcattcttcagattctccaggcttacgaatgaagacatgagaaaactaggtagcaagatccattttgtgattaataaatggacagacctcgacgatgcggtccacagttagtttactagagacacagatacgtggatctccgcttcacgcgctgtctccgcacacataccgtccgacagacttgcaccgaaccgctccagccaatacgcttggcacaagatccacggctgacactggactataattacgacaactacccagtgtagcaacaggaacaagcacgatactacgagacaggaaatcaaaagataacaaaggagcaccgcccacaccgaacgaacgcgacacgaaacaaggaaaacgcaaagggacagagcagacaaggcaacatcaagaacacacacggacacacgcggcagccagaccgcgaactaaacatcaaaaacaccaacacgcaaaaagagaccacagaacacgaaccacagaaagtaggacagacatacacaaacatagacgaacaaaacaaaacaaaaaaggaacagagcggaacgggacggaaagccagaagaagagagggggaagacgcagcataaaggaacgaatgcaacacgaaacgaggacaagaacgacgcagcgaggacggggacggaacgcccgagcagacccagagacaagacgaagagaaaggcgagcagagacagcgacacacgcaagaaaggcaccagaacgacagtaacgacaacacggaaagacaaaaagtgcaaagaggcacgccacacaccaggcgcagcacacaccaggaacagcaaagacatacgaagaacgacactccaaaaggacaggggcaggccagcgaaccgacagcacaaacagcacaacgagtacgcaaagagacaacggcaggagacagaggagagaagcagccaggaactagacggagaaagaacgagagaacgtacaacgaaacacagaaacagaagacaaacacctgcacagcccacaaccaatcagacggacccgtacctacaccgacgagcaccgaggcacaaggagaaagaaaaacaagagacaaggacacgacacgacacgactagcgaaagacgcaacgcgcgaccagacaagcacagccgagagggggagaaaacatagagacaacgacagacgacgagagacaagcaaacaccaaacgagacagaacacacgagagcgcacgcacagcccagcaacaagcaagcaagacccccacgacagaggccacggacagccgccgcccgagacaggagcgcgcgcacgaccggaggagacggaccagcgcgccgcaggccacccgccgcgcggagccacacacggcggacgctgcgagaagcgcagcacggcccgccagccacagacgacgaccacagagccagcaccgcaggagcgagccgcacgataggtccgccggccgagcccacgtgacgcgagacgcggagcgcgccagcgcgcgccgaccacgcgccgccacggacgacagaccacggacacgagcaccagacacgcaaccacacagcaacccagaggcgaccgagacgc

SEQ ID NO: 697880 - DNA, 385 bp, Homo sapiens
cgagaggataacgaccggcaggtgtactcccaccaagtcatccatgtccctgagaagggacatgatctcattcctttttatggctacatagtatttcatggcatatatgtaccacattttcgttctccagccggtaatcgacaggaatttaggttgattccatgtctttgttattgtactgtaatgaacatatagctgcatgtgtctttataatagaacaatttatattccttggggtatatacccagtaatggtatcactgggccgaatgatagttctgcttttagctctttgaggaatggccatactgtcttccacaatgaactaatttacactcccaccgacagtgtaaaaccattcctttttcagtacaacctgccggtgg

SEQ ID NO: 697881 - DNA, 272 bp, Homo sapiens
  misc_feature (103)..(103): n is a, c, g, or t
aagcatcgagtctcatgagatctgatggttttataagcatctggcatttcccctgctgcatttctctctccgcaacctgtgaagaaggtgccgcttccccttngccttccaccataatcataagtttcctgaggcctccccagccacgtggaactgcaagtctattaaacctcttttctttataaattacccagcctcaaatattctcttttttttttttttttttggggttatgaaaactcgggatgctccggggggactcctctagagtc

SEQ ID NO: 697882 - DNA, 867 bp, Homo sapiens
ggggagcggagcccagagctcctgtgaggtgccgctgacttatggctggtgggcccagccgggagacatgctctcatattcagaaaggccagacgtgaccatctatcaacggagcagatgcgagacgaggaagggaaaacggccccaggttgggggattccagggtcgccgggtaactgttaacctggcacgccttgactcatgtcctctagaccgatcgcatcctctccgtcccactagacaagcatgttctcgatccagtggtctgcaccatggcagcgggagcgaaccccattcaacaacgccaacaatcatgctagcatggtgcacagatgggtctcaggtcggaccaatccgacacgaatgcatccaccaaagggactcagcaagacgagagcacaagcacacacagaccagccacctatcagcaaatccgtgagctacgcacagtccagaacaagagagatacgaagtaccatggtatgggctggaacatttagtgggcgccattccacgatacggaacacgctcaattattcatttggcccaacatagcaacggttagagcactttacaaggaagtacatgagaggatcctttaaacagatacagatagagattacctaggcacacaacaaacaaactaagcattggctcaggagtcacacccccttgcggcatttatacagcttggacacactaggcccctagtacaactggcaagcagttcgggaaagacccacccaagcaaccggtacacaaccggggtggcaaattaattcttaacacggaggaattctccttcaacgagttaccccacttttaaaaacagaagggaatcgcggtcggtacccagatcgggttctc

SEQ ID NO: 697883 - DNA, 356 bp, Homo sapiens
actcacaggatcttctgctccctccctcttcagcaatggtgatacggatacctttcctcgggaagagaaatccatggtttgttgccttgccaataacaaaaatgttggaagtcgagttggcaaagctgttgccattgggatctttcacgtgaaccacgtccaaaagatccaggggtgcctctcttcttgttgggtgataccaaaccaattctttccttaggttaagcacctcccagtcacacatacacaggttacccagtgttccgaaacttgtatgaaaatcagtaactctttgccagctctctataatcaatcgtgaatggtatcattccaccttgaaagagggaggccagcag

SEQ ID NO: 697884 - DNA, 459 bp, Homo sapiens
ggagagtggaggttggagtgagccaacgatcacaccactacactccagcctagagtacagagcaagactctgtctcaacccaagcaaacagacaaacaaaggagaaaagtattatcaaagaacattaccctcaaaaaagacttacacttggccaccaagcccataacaagctgcccatacctcatcataagggaattgcaagttcaaacccacagggagatgacccaaggccacactcatgggttttgtcataaccttttttaaaacaaacagggacacgcgggcggggcccagtggctcccgcctgtaatccccagccctttgggaacggccgaggccacggcggttccccgacgtccgggagattggagcccccccgggctcccatggtgaacctcccgtctctactaaactttccaacactttacggtgggtgtgctagtgcttgcctgttttccc

SEQ ID NO: 697885 - DNA, 289 bp, Homo sapiens
  misc_feature (29)..(29): n is a, c, g, or t
  misc_feature (36)..(36): n is a, c, g, or t
  misc_feature (39)..(39): n is a, c, g, or t
  misc_feature (45)..(45): n is a, c, g, or t
  misc_feature (52)..(52): n is a, c, g, or t
  misc_feature (84)..(84): n is a, c, g, or t
  misc_feature (88)..(88): n is a, c, g, or t
  misc_feature (97)..(98): n is a, c, g, or t
  misc_feature (100)..(101): n is a, c, g, or t
  misc_feature (106)..(106): n is a, c, g, or t
  misc_feature (117)..(117): n is a, c, g, or t
  misc_feature (121)..(121): n is a, c, g, or t
  misc_feature (123)..(123): n is a, c, g, or t
  misc_feature (131)..(131): n is a, c, g, or t
  misc_feature (137)..(137): n is a, c, g, or t
  misc_feature (140)..(140): n is a, c, g, or t
  misc_feature (142)..(142): n is a, c, g, or t
  misc_feature (145)..(146): n is a, c, g, or t
  misc_feature (148)..(148): n is a, c, g, or t
  misc_feature (150)..(150): n is a, c, g, or t
  misc_feature (179)..(179): n is a, c, g, or t
  misc_feature (182)..(182): n is a, c, g, or t
  misc_feature (193)..(193): n is a, c, g, or t
gttggaccaagacgaggttccttccttanccccacnatnggggcnatggtcnatttattctccccaactcaccctcaacaaganactntcctgggtnnannctccncccttccctcncttntncttccttntccccnttntnatnnantnggcagggggagggggagggcacaggcaanaanagattcacatntcctggggtaagggggggttcacagtaatcatggtctactcctcttggccgtggctgggggtagacttaatttagagaggaattccaaaaaaaaaa

SEQ ID NO: 697886 - DNA, 357 bp, Homo sapiens
tatgtctgagtgtcgtgctcaagtttgaagatggccagtgtgagagcgaggaacctggactatgataccctcccggtcctgattcatgtgcaacgggccaaccaggctgcagatgcactacctggtgcccctacatcccgcgcttctggaccttcgaaacaggctgtaccgatgtgtgacgaaatggttgcgagcctcaggggcactaggaggatgacagctctagccaggggcctggtcggggtgttcactcgaacatgccgcaagcctgtcagtgtccctgttctaccagtggctcctgggattccactatccccagaaacatatgcgaattttcatccacaaccgcatcatccg

SEQ ID NO: 697887 - DNA, 436 bp, Homo sapiens
  misc_feature (28)..(28): n is a, c, g, or t
  misc_feature (37)..(37): n is a, c, g, or t
gcctcgctgtctaaagagttcaccaacntgcctgacnacagctggggtcagagagaaggcagatgttcttaatccagtcatcactgcagtgtttctagaggcctcaaacagcgcctcttacattcaagatgccttccaactcctcctgcctgtgctgcagatctctctcatcgagagcaagacagagtcatccacgtgtgagccacagtccagagacctctgacagaaccctgaggagcagagaagagtcctactgagatggtgatagccaagaaatctgactttgctcagggagccctgcagccagagcgaggcatagtactacgtgtgtgaaaggccagcagggcgcaggctcacaggggtgcttgcttctctgcgtagctgattgcctctgctgctcacactgctcttccagccttataagtaataaattatt

SEQ ID NO: 697888 - DNA, 362 bp, Homo sapiens
  misc_feature (29)..(29): n is a, c, g, or t
gtccgcttcccgggttcatgccattctcntgcctcagcctcccgagtagctgggactaccagcgccccgccaccacgcccggctaatcttttcgtatttctagtagagacgccacttcaccatcctacccagcatcctctccatctcctcacctcgtgatccgcccacctcggcctcccaaagtcctgggattacaggcttgagccaccgccactcagcctgagggagtgtaatttcgtctagctctgagttctcttcgtttgtttgttttgttttgttttgtttttttgagatggagtctctccgctctgctcgcccaggctggagtgcagtggcccgatctcggctcactcgcaacgtcc

SEQ ID NO: 697889 - DNA, 306 bp, Homo sapiens
  misc_feature (306)..(306): n is a, c, g, or t
ggatcctcgacggcgccggcagtacccaagtcagaagagagacaatagcagcgataggtaacttccaatgtccgaactaggtaggctggtatgggcccctcaaagccggtgtcatctccttccctgtcaaggctggcttaggtgaggattcccacaacactgttctgggcaccatttgagcagtgacagaggggggatgtgagagtgtcaaagagtgctccaaggccccccccccactttcctccctcctggcttcacaggcacctgaccaccaacaaaaagacaaggggggttagggaagatatn

SEQ ID NO: 697890 - DNA, 366 bp, Homo sapiens
agaaatatcagttgacgtcgaagcacatggaggatgaggacagcgactcaagagggggggagaagcgctttgggccatttgcagcagcacccctcctgctgctgaaccgtttccaaaagctcctggaactgcgacggggaggtcctgcacaggcctgccatcgaggtcagagtccactgccagctggttcgactctttgcacgaggcattggagagaatccgaagcccgactcacacagctgagaagccggggatctgctctcgaactgggaaagtgtgaaaagtatttaagataattattacagaccaattatgttgatatatacatttacatgtcgaagtttatttttgataggtaaatcttga

SEQ ID NO: 697891 - DNA, 362 bp, Homo sapiens
gaacatgcgagctcctctacaggtctgcagctgcaccagcctcaaactagaacatcagctcctccccgagtcttcagctgcatgaccctcaatctagaacatcagctcctctccgggtctgcagctgcaagaacctaaaactagaacattaccttctctccagggctccagttctatgaccctaattctagaacatcagctcctccctgagtctccaactgaaagaccctcaacgcgaacaacatcagctcctccccaagtcttcagctgcaagaccctcaaactagaacatcagctcctctacaggtcttcagctgcacgaccctcaaactagaacatcagctcctccccgggtctgcagg

SEQ ID NO: 697892 - DNA, 242 bp, Homo sapiens
agtgatcgatcaaaagagggactgaatgggagtgggtgaatggatcggtgcaaatccattaccactgctggagaaaccaccctggaaccctaaacatggttcactctcatgttatttttcctttgatcagcttttgtggaaaaacaggacagagatgtttttgtgtccttgatttttgatgtgatttttttttcagcactaaagaagaatttaaatacaaaatagaatgttaaaaaaaaaaa

SEQ ID NO: 697893 - DNA, 140 bp, Homo sapiens
ctttggtttactggaagtagagtgaggaagcatctttccttcactaagttgtctttctgtcttctggatagattgattttaagagactaagggaatttacaaactaaagattttagtcatctggtgggtcagaacataag

SEQ ID NO: 697894 - DNA, 535 bp, Homo sapiens
cgtcgtcatggcgacggtgaagggcgatgtgcacgacatcggcaagaacatcgtcggcgtggtgctcggctgcaacggctacgacgtgatcgatctcggcgtcatggtgtcgtgcgaccgcatcctgcagaccgcgcgcgaacacaaggccgacatcatcggcctgtcgggcctgatcacgccatcgctggaagagatgagccacgtcgcgtccgaaatgacgcgcgagggcttcgacattccgctgctgatcggcggcgccaccacttcgcgtgcgcacaccgcgatcaagatcgcgccgcattacgcgtcgccagtggtgtatgtgccggacgcctcgcgcgcggtcggcgtcgccaccagcctgctgtcgaaggaccagcgcgcggcctatgccgaagaagtggcggccgactacgcgaagatccgcgaacagcacgccgcgaagaagggccagaagctggtgtcgctgaacgacgcgcgcgacaacgcatactgctgcggctggggcagcgaagtgattcccgagcggccg

SEQ ID NO: 697895 - DNA, 495 bp, Homo sapiens
  misc_feature (162)..(162): n is a, c, g, or t
  misc_feature (165)..(165): n is a, c, g, or t
aagctcttctcagggagcgcccggaagtggtcccccagattgccccattctggagtgcccgtagcccctgccccctccccaagggggcccgggggccctcccttttttgtggccagccaatttggtggtaatggggggttgtgcctgggggcccattaaaanttncctttgttaaaggccctccaagaaaaaaaacccggccccggggccggccgggggagttttccccttggccccaaccctttttttttttttttttaaaaaaaaaaacttttaaaaaacccccctttaaaaccaaacctttttttgtttttgaccaagggattttccaaattttgttggggttttgttttcaaggctagggaatttttccccccataaaaccccccggtttttgccccttttatttttatgttttgggattggggggggggccggggttttttttttttttaaggggggggggaccaatgggaattaaaccggggctgttga

SEQ ID NO: 697896 - DNA, 126 bp, Homo sapiens
gtgcatgcattgggtcggttgtatagtcctaggcagtgggtgtgggtgatatcactagcagtggtgggatgaccctcttggactcaggtgatctgtgctggtgttggtggtaactacagctggcta

SEQ ID NO: 697897 - DNA, 271 bp, Homo sapiens
cccctttactctctctctctccctgtttatcttcttactctgcctcctactccctttccctctattctgttctctctctttagtcgtcaaccccctttactctctctctctccctgtttatcttcttactctgcctcctactccctttccctctattctgttctctctctttagtcgtcaaccccctttactctctctctccctgtttatcttcctactctgcctcctactccctttccctctattcgtcgacgcggccgcgaatttagta

SEQ ID NO: 697898 - DNA, 364 bp, Homo sapiens
  misc_feature (12)..(12): n is a, c, g, or t
caacgatggtcnctcagcttcacaagtagctgggattataggcacgcagcaccatgcccggctaattttgtgttttcagtagagacggggtttcaccatgttggccaggatggtctcgatctcttgagctcaggtgatcggctggctcgggctcccaaagtggtgggattacaggcgatagacactgggcccaggcgagatttatgtattatttaatgtgtgggggtatactcaagaatagctcttgtatagagtcacgagatttggccttggggagttactattggaggggttgtagtatcacttggagatagtctcatggtggtatgtgtgtactttaagtatgactattgggaataacaag

SEQ ID NO: 697899 - DNA, 148 bp, Homo sapiens
tcgcccaacacagaaagatccaagcctgtgataaactctctcacacctaaaaccaagtaaaaactcttagtccataggaggcaagcaactccctaaccgaaacaaaaaaaaaacaaaattggtcccagaagccccttctcaaggttca

SEQ ID NO: 697900 - DNA, 1120 bp, Homo sapiens
gtgtcgccgtgttcttttgtgtgtgcttttctttgcttgtgttccttttttggttgtcttttgctcttggaacccctttgctttttctttggtggttctactgcgtctgtttgttccctggtgcgtgaacctttctgggtccttttgtctgtgttctgtatgctggcttttctctgtgtgtcattctgggatgtccttgcagtgccttgacggtatatccatggctgcaagtttatggcaccattgtgttggacctcatgttgttcactgttgcaagttgttatgcctaggtatattgttagggtaaagtaggaagaatgggtcaacttgtgtctagcccttgtggtcttgagtacttcctgcaagggctggaggtacaggttcttagacgtatgattcaaccttggtaggaacctggggataagtggttatgtggaggttagaggaggtagactgagtaatctctgctatccccaggagctcatgcatacccagctcttttgatcatgaggagaggtatgccatgttgatctcatgaacagtgtggatggtaatggggttgcaggtgaccagcatcttcaatctagttaccaccagcttggctagaattttattgaacgcaacttgctagttatgacagagaaggatccagggtgagaactaatgctcaagagtagcaagattctgtaatcctcttgccctctcacatcactaattctgatatgccaaacatttggcccaatgagaatgactgatagacttgactgatgtgcatgtggggggatgaggtgtgtatatgcctttctcctgatctggccattcagtgttcaggctgtcattcaaattggataggagaaagttggtgaggaaggaatggagagagcaggatacctggactcactggtccccaaactccttgactgtcactatgtaattgtatataatttgtgtgtttcttgctccagttcctcatgctgtcatcctgtaagtctatctgggaagggtaaatgctgacacctattagataatagtgttctttcaactgtcccataccatgattgtatcatagatatgtcatgttataaactatagtgatatatatataatgttagctgtcggc

SEQ ID NO: 697901 - DNA, 226 bp, Homo sapiens
aatccgtctctagtataaatagaaaaatgagctgggcgtggtggcgggcactattatcccagctaacgcgaggaggctagaagcacaagaatcgcttgaacccaggaggcagaggttgcattgagccgagattgtgccactgcacctccagcttgggtgatatagcgagactcagtctcaaaaacaaaacaaaacaatcttcatatgtacccatatcctttctcga

SEQ ID NO: 697902 - DNA, 256 bp, Homo sapiens
gtgatggagtctcactctgtcacccaggctggagtgcagcagtggcgtgatctctgctcagtgcaacctcagcctcccaagtagctgggactatgtgcgtgtgccactatgcccagctaattttgtattttagtagagacggggttcaccatgttgccagactgtctgactccgacctcagtgatgccccgcctggcctccaaagtgctggatacagtgtagcactgccctcgccaaaacattttaaagcatgtgt

SEQ ID NO: 697903 - DNA, 358 bp, Homo sapiens
  misc_feature (64)..(64): n is a, c, g, or t
  misc_feature (109)..(109): n is a, c, g, or t
  misc_feature (191)..(191): n is a, c, g, or t
  misc_feature (351)..(355): n is a, c, g, or t
aaattccaggacacccccctaaatggattggtgaatgcctttggaaaaatttgtccatcccaanccccacagcccccacaaaagtaggcccccggccctgtgtgataanccctaaatggggatatgcccttcctaatggcaaagatttctgtaggaccccagagtcttgtaagttatagtgaaaatattgnggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtnnnnngaa

SEQ ID NO: 697904 - DNA, 253 bp, Homo sapiens
aaccaggcatcagtaccagcctcattttgacattgggagcggggggactcattcccagcctggggagtgaaatctcccagggtttggcccagagtcttaggctcggacagagctccttccttcgtctcagcaacaacctggttctaagagactggccttcatctctggtatggcatctggtctaagaccgggtctgggctttgggtgtggcctggtcttgggtacaggctaacaaagacagtagcctcctctg

SEQ ID NO: 697905 - DNA, 262 bp, Homo sapiens
agcggcgcacagctctcctgtggtggtttggaatccctgcggctgtgccggtcatgtcgtttggtgctgtgtgttggtgcaaagatagtcagggctcctatgtcccagatgtctgtcttgtagagcttctgttcctagaggagtcacagtcaagaacccgagcttagacgaaaaagtctagaggggtgacacattatgcacggggaagattatgcattgggagacgaagatttgtgtcctgcctacgttatcgctgaaaatc

SEQ ID NO: 697906 - DNA, 276 bp, Homo sapiens
cgtactcagcggctctcgggtcccagcgtccagccgcggcccgcgctcctccgccccggtcctcctcctcctctttctccgtcctcctcctctctaggcacccccgtgccttccttccagaggactgctgcccaccgaccgacagtcgtccgcgcttacttcgtatggagatcgaccgcagtggtcaccaccatcgtattgcgggatacagtctcgtgtcactgtgctgtacgtctcgcgtgtcctcctcgaggggtactacgtcttatcacgcct

SEQ ID NO: 697907 - DNA, 703 bp, Homo sapiens
gttccacatctaccacatgggccaggcctggcttccccgaagcgctgggccgtcttctacgccgcacgagatcttgctgtggcctaggaggacctgccactcgggagcgcatcagtgtaacagggacctgaagcccgagaacatcttgctggatgaccacggccacatctcgcatctctgacactgggactaagctgtgcatggtgccgcgagggccagaccaatcaaagggtcgagtgggcaccgtgggttacatggctccggaggtggtgaagaatgagacggtacacgttcagccctgactggtgggcgctcggctgcctccgtgtacgagatgagtcgcaggaccagtcgccctgtccagcagaggaagaagaagatcaagacgggaggaggtggagcggctggtgaaggaggtccccgaggagtagtccgagcgctgttgtccccgcaggccgcgctcactttgctgcacagctgcctcatgcaaggaccgtgctcgaacgcaactggggtgttcgtgggggcagtgcccgcgaggtgtaaggagcaccccctctttaagaagctgaacttcaagcggctgggagctggcatgctggagccgccctatcaagccttaacgtgagtgcagccacactcactgctagagggcggggccctagcgagggctaggggctcaggggctcattgtagtatcagg

SEQ ID NO: 697908 - DNA, 122 bp, Homo sapiens
gtttttgcggtgccgggggggagtatggttgccacgctcaaacttagtggatttgacgcacgtgcaccaccaggagtgtatcctgctgattaatttgacctagcacggtctccctcaccctg

SEQ ID NO: 697909 - DNA, 98 bp, Homo sapiens
tttatttttgggggggggggggggggacatttttaaagggttggggccccctccccctccgggccccggggggggggggcccccccttccccctttta

SEQ ID NO: 697910 - DNA, 445 bp, Homo sapiens
agtctagaggatctccgtcaggttgtgggatagtgggaaaacaggtgtgggacagtgaacgaaaccatctttctccctctactcacggaactttctgtctattaaggtgacaagaactgaagggcctggctcaaccatatgcgtttgatgagcagatgtgtcctgctgtagaccacaggacctgtttgccgccttgtccccaggttcgttgactgtgaaatactctggaggctggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggccggaggagctggagaatgggcacagcatggt

SEQ ID NO: 697911 - DNA, 94 bp, Homo sapiens
ctatcaactgaggcgattccgaagctgactttctataggcaattttgtacctttgtggagaaatgtgtcacctccctcatccggttatccaatg

SEQ ID NO: 697912 - DNA, 318 bp, Homo sapiens
ctgattttatgcagcgatatggaccacccccatcgggcccatcctgaaaatccctgggctgaactcgcccatccctgagagctgttccttagggcaccatgctgctggctggagcacacctccagtggatgagactggtaaaccgctctatgaagacgtgtttgaaaccaatgctgctgaatttcagaccaagactgaggaagaagagattgatcggaccccttggggggaactggaaccatctgatgaagaatcctcagaagaagaggaggagggagaaagtgatgaagacaaaccagatgagacaggctttactac

SEQ ID NO: 697913 - DNA, 663 bp, Homo sapiens
  misc_feature (210)..(210): n is a, c, g, or t
  misc_feature (357)..(357): n is a, c, g, or t
  misc_feature (373)..(373): n is a, c, g, or t
ctaactcatgcccccatgtctaacaacatggctttctcagcaaaaaaaaaaaaaaaaaaaaaaaaaaaaagttgtggtgggcggccctgcggccccttatagaaagctttcatgagaacaattccgctggggcggccgggggccccagttgaggttatgttgacccgtgtgtcacataggcgtgtctccctaagagaagaactcggtggnccagtgcagcatagtggcctgtggatttctcctcaccacacatataaaacaacacgcgccgcgcgggcggcacacacgaggcagcgcgtcttctgagaaccaacatctctcctagagagtgagagaggttctctgcgagagaggggnctcatatcagagcggngtgatgtctattatctaaaccaggcgagcgagagtcggcccgagacggcgcgacgagtcactcgcggacaatatatctcaaacataatttatagcgacccccgcggctgcctggctgtggttatttaccaacagccgtagaacgagatcgaccactacacaacaacaactacccaaacatagatccaccacatagaacccatgccagccaagacgagaccaccgaccaactaaactccaacacaatagtaaaatcgaacaacgacgcaaagcgaacgacaacacacggct

SEQ ID NO: 697914 - DNA, 616 bp, Homo sapiens
gtcaccaccccagttgaagccacgcactgtcactcgcatgggagaaaaaacccacttattccccgaattccccaccacgagtccacgccacgaagagaggacccccctgagaaaaggctgagaatttgagggctaccactgaagtaatatgcctcgtggaatgtttctcgtcacgctcacggagagggccaggcccaggatgcacggaccacgaggaacccacctatttacccaacgaggagcccctctataaccacgtatggagctgaaaatgagaaaacttcaccgtggccttcttcacgtgaggtggaaaaggcgttttgaatgccactgccgtttactcttaagagcactttgaagatgagaagaaggctcggatgggtgtggtggaggtgcgcccaacactgaactgctgcacaccactttaatgttctctatgagaaggagggtgaatttgttgccccgtttaaatttaccacgttctgctcatgccccatggccccatgcggataacccgtggtcccttcgagcctgacctctacaagtctgagatggaggtcccggatgcagagctaaaggccctcctccagagttctgccagtcgaaaaaccccaga

SEQ ID NO: 697915 - DNA, 132 bp, Homo sapiens
ctggaggaagaatcgagattcttatcactctccacacttgtttcaaaagagtggatgtcgaagtgcgcccagaatgtgttgatgatgaaagggtattctgctgcgtagataacgtgctgctgtgttgtgtgg

SEQ ID NO: 697916 - DNA, 161 bp, Homo sapiens
tcatcttgagagcagcacgagctgcccatgtgaaccggcgctgttgagcatgtcatggccaccttaaacccatctccgacctctccaaggatgttttcacacaggtatcttggtgttttcaaaatggacttcacaagtgttggagccccgaatgcctaatt

SEQ ID NO: 697917 - DNA, 512 bp, Homo sapiens
  misc_feature (117)..(117): n is a, c, g, or t
tactcaaaacaccaccccccccccccaattttaccccctgtttcaccgcacacaaaaaacaccgccgaacaccggaaaaaaaattaaaaagccccaccacccccccccactaccaanacaaactactccacattcccccccgacaaccccgactcacccccatacccgcctccaatcacgagcttcaccccaccactcccccacaacacccacaggacccacaaataaccaaccccaccccacccccaccccccccacccacccctccctccccgcactccttcaacatcaccacccacacacacaacgaccacctccctcccccacgcacaccaaacacccccaccacccaccactcccctcacacccacgcgcccccccaaccacccgcctccacaacccacccccacaacccgcacccccctcccccccacaccacaccaaacaaaccaccacaccgacgacacacacacactccacgcccccaacaacaccacaccccatccccccca

SEQ ID NO: 697918 - DNA, 1024 bp, Homo sapiens
  misc_feature (854)..(854): n is a, c, g, or t
  misc_feature (856)..(856): n is a, c, g, or t
  misc_feature (866)..(866): n is a, c, g, or t
gggagaaaaaccaaacttaggctaggtacgaggctgggtgtgaatcggccgagggatgcgggtcacggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggacccccaaagacacatgtgacccaacacctgacccaccaccccgtctctgaccatgaggccaccctgaggtgctgggccctgggcttctaccctgcggagatcacactgacctggcagcgggatggcgaggaccaaactcaggacaccgagcttgtggagacagaccccggagataaactncngaagtggccntgtgggggctctgggcgagccggttccctgcccgtccgcttggggctgccagcctccccgggtgggccttccgcccgccccgggttggtgccggcgccaccggaccccgcgcttttcaacctcggggggtacttcggccccgctttccggacgtgcgc

SEQ ID NO: 697919 - DNA, 143 bp, Homo sapiens
aagtagacagcctgctgacgtgccctctctttcagctctgacatcatgggacgcatgttggctgtggatctgggtcttggtctcgggaaagcttctgctccgagatgagaccagccccgtcttcatctacactagagaggctg

SEQ ID NO: 697920 - DNA, 295 bp, Homo sapiens
tgccggtacctataagagaagagacgagatgcaggatttcttcacgcctcccctttgtgacttcaagagcctctggcatctctttctgcaaaggcatctgaatgtgtctgcgttcctgttagcataatgtgaggaggtggagagacagcccaccccggtgttcaatggtaaccctggttcccattgttgactggttttccttcccaattcttcttcctcgtgttcccagaaaagggttggggctgggatggtctccatccttcgttcttctcattctggttccattcttcgttct

SEQ ID NO: 697921 - DNA, 214 bp, Homo sapiens
ggaagtggaagctgcagtgagccgggatctcaccactgcatttcagcctgggtgacaaaatgagaccctctctcaaaaaaaaaaaaaatctacagtacaccaggtatagtggctcatgcctataatcccaacactgggaggtcaaggcaggaggatctgcttgaggtcaggaattctaaactgacttggtcaacatagtaagatccccgtctct

SEQ ID NO: 697922 - DNA, 718 bp, Homo sapiens
aacccaaaaaaatcagggttttggctcccaaaaaatttggggagatattttttggccaaaggttctccttataaaaagaaaaacacgtgggggaatgttcgggcccgttttctcaaccaagtgggtggctaaaaaaagtgggggcccttttttttatgtgggggaaaaaactctttggtggaaaaaagggggggactttttttgggggtggttccaaaaaaaaaggtccaggggtttttatttgttttttctccccgtttaaaaaaccttaaaaacctttttttttttaggggggtattaaaaaacggggaattctcccccccccccccttttgggagattaaaagagcctttgggggatctttttttttaaaagggcacaccaaaatggtttgggtgtctcttgtaacaaaaaagttggggggttggaaaaccaacccaccctgtgggtccccttgtaacccttgttccccaggtgcacctggggttccctccccaggtaatctttctgtttcaaaagaggtggggcttgaatgtctcaatctctgtctcacttttaatgggcattaaggtgcaactttcttacctcccctactgaaaataagaatctgaataaacatttgtttctcaaaaatttgctatgaagggttgatggattaattaaataagtcaattcctggaagttgagagagcaaataaagacctgagaaccttccaga

SEQ ID NO: 697923 - DNA, 285 bp, Homo sapiens
ccccctaaggccaaattgaggttaaggggggtttcccaggattggttttaaaggcccaattgtgttagcttatcttctcccccttggggattgaccccttccgaattgaagttcaattgggcccttccgggaaaaggttgcgcttgggcttttgtcccttgatcacccccacgcacttgaaaactgtgcccaattgacttgcttgggagctttgccacccgacccttttgatttcattgggaaccttgtattaaattcttggaggggaaattcgtgtttaaaaaa

SEQ ID NO: 697924 - DNA, 569 bp, Homo sapiens
  misc_feature (228)..(229): n is a, c, g, or t
  misc_feature (236)..(236): n is a, c, g, or t
  misc_feature (249)..(249): n is a, c, g, or t
  misc_feature (261)..(262): n is a, c, g, or t
  misc_feature (271)..(271): n is a, c, g, or t
  misc_feature (277)..(277): n is a, c, g, or t
  misc_feature (292)..(292): n is a, c, g, or t
  misc_feature (300)..(300): n is a, c, g, or t
  misc_feature (305)..(305): n is a, c, g, or t
  misc_feature (334)..(334): n is a, c, g, or t
  misc_feature (336)..(336): n is a, c, g, or t
  misc_feature (340)..(341): n is a, c, g, or t
  misc_feature (345)..(345): n is a, c, g, or t
  misc_feature (353)..(355): n is a, c, g, or t
  misc_feature (357)..(357): n is a, c, g, or t
  misc_feature (367)..(367): n is a, c, g, or t
  misc_feature (372)..(372): n is a, c, g, or t
  misc_feature (375)..(375): n is a, c, g, or t
  misc_feature (392)..(392): n is a, c, g, or t
  misc_feature (398)..(399): n is a, c, g, or t
  misc_feature (406)..(406): n is a, c, g, or t
  misc_feature (408)..(408): n is a, c, g, or t
  misc_feature (417)..(417): n is a, c, g, or t
  misc_feature (419)..(419): n is a, c, g, or t
  misc_feature (423)..(423): n is a, c, g, or t
  misc_feature (425)..(425): n is a, c, g, or t
  misc_feature (445)..(445): n is a, c, g, or t
  misc_feature (448)..(448): n is a, c, g, or t
  misc_feature (452)..(454): n is a, c, g, or t
  misc_feature (463)..(463): n is a, c, g, or t
  misc_feature (567)..(567): n is a, c, g, or t
cgggcagtaactactacggtttaaggtgcgaggcctgggtggcgccgaggatggccgtcatggcgccccgaaccctcgtcctgctactctcgggggccctggccctgacccagacctgggcgggctctcactccatgaggtatttcttcacatccgtgtcccggcccggccgcggggagccccgcttcatcgccgtgggctgcgtgggcggcgcgcggttcgtgcggnncggcggnggggccgcgggcngggggggggggnngcgggcgcngggggnggggcggggggggcngggggggnggggngggggggcggggggggggggggcccgcgngngggnngggngggggggnnngnggggggcgcnccgcnggngcggccgggggggggcngggtcnngggcccncnggggggggngngggngnggggtggggtgcgggggggngcntgcnnngcgggggcngccgggtgcgcctgcggcggcgggggttgcatcgccctggggggggcctgcgctcttgggccgcggcgggcgatggcggctcgaggtcgccaggcgcgggtggnga

SEQ ID NO: 697925 - DNA, 293 bp, Homo sapiens
  misc_feature (190)..(193): n is a, c, g, or t
  misc_feature (198)..(198): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (209)..(209): n is a, c, g, or t
  misc_feature (212)..(215): n is a, c, g, or t
  misc_feature (218)..(218): n is a, c, g, or t
  misc_feature (221)..(221): n is a, c, g, or t
  misc_feature (227)..(227): n is a, c, g, or t
  misc_feature (233)..(233): n is a, c, g, or t
gccggccaggattccatcctctctggaacaggaaagatgattggggagggagcacaggtcagcgtgggaagagggtcatggtgcactgagctgtaacttcttccttccctattaaaattagaacctgagtataaatttactttctcaaattctctgccatgagaggttgatgagttaattaaaggagaannnncctanaanttnagngncannnnaantgnaacacntgaaanaacacactatattacgggggccagaacgcttcccccccccctgggcgcacggtaaccccc

SEQ ID NO: 697926 - DNA, 1582 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 697927 - DNA, 120 bp, Homo sapiens
  misc_feature (15)..(15): n is a, c, g, or t
actagtcacggttgngctcaggagtcataggaacaataaaggcgagatgaaaggttctgccattacaggaccagtagcaaaggagtgtgcagacttgtggccccggaatgcatccaatgc

SEQ ID NO: 697928 - DNA, 415 bp, Homo sapiens
caccgctagatgatgaagttcttaatactattctcctgttcttattccctgacgctgatcctgagaaaccattagatgggactacttcaacagataatagtaatcctccatcagagagtgaagactataatctctacaatcaggtcaagtctgcaccatctgacagtttaacatacatactggctttgcgtctctggatgatcaatttttaccatggagggttgaaaggagtggcacacctttggcaggaatttgttcttgaaatgcgtttccgacgggaaaacgactttctgattccaggattagcaagtggacccccagatctgaggtgttgtttactgcattagaactacagatgttaaattgttgtattgaaagaaagaagcacgtgatgaggggaaaaagacaagtgctt

SEQ ID NO: 697929 - DNA, 424 bp, Homo sapiens
  misc_feature (32)..(32): n is a, c, g, or t
  misc_feature (63)..(63): n is a, c, g, or t
  misc_feature (103)..(103): n is a, c, g, or t
  misc_feature (174)..(174): n is a, c, g, or t
  misc_feature (179)..(179): n is a, c, g, or t
ccggccgccgacacgctgcgagaagacgacanaggggagtataactggctggcattatatcanattcagtgagtgaaatacaactgaaatcacttcaggtcantgataccatcttccctatgttttctcttcttttgaaaatactttcaccgccccgtgccagtggctcacgcntgtantccaacatttgggaggccaaggtgggaggatggcttgagccccagagttcagaccagcctgggcaatgtagggtgaccccatctctacaataaaaaaattagctggtgtgatggcatgtacctgtagtcccagctactcaggaggctgaggtaggaggatagcttgaacccaagaggtcgaggctgcagtgagccaagattacacactgcactctggcctgggcaacaaagcaagaccctgtctc

SEQ ID NO: 697930 - DNA, 1951 bp, Homo sapiens
  misc_feature (1590)..(1590): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccagaaaaaaaanaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggcccctttggccaaaaggattttaaaattgggaaagtttaaaaatggggcccaaattgggggcaatttggcaaaattcccctaaaggggggcgtttaaaaaataaaggggcggggtttaaaaaaggtggaatgggaaaaaaccgggggttcccaaaataaaaccctttggaaaaaaacccctttttgcaaaggggggaaaaagcaaaaaggccccaaccgaaggccttttaaa

SEQ ID NO: 697931 - DNA, 1583 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 697932 - DNA, 558 bp, Homo sapiens
  misc_feature (483)..(483): n is a, c, g, or t
  misc_feature (516)..(517): n is a, c, g, or t
  misc_feature (529)..(529): n is a, c, g, or t
  misc_feature (541)..(541): n is a, c, g, or t
gagctatctgggtatgattgcagtcgactgatgtcccgcgtccctttagcctgattagctcaaaatcgcttgaagcgagtccgcgcggaacgaaaaaactttcattgagaccttcaatttgaaggtcatggaaggatggagccgatgactacatgagccaaggcgcagatcggaaacccagcgcccagacccactaggaaaccggattgaaccagccttggctaggcccaggcgtcacgtcgatatcactacccaaacgcagcctcatagccgaaagtgcccattcggctccagcacaattgctgtgccgtacacctaagaggagcgacagcggctacgtagagaaaccacaatcagaggcccatgaggtgcaatgtgcaaaatttgcacattgcgaacaccccactagaagcaacccagcgcctcagcgctcaaactcatagctgtagtcagtcgttacagacaaatccgctagcagatcgnccagcgatagcgaaagccgtggctcatcaaagnnttcaaactcagnaaagctcacagncaccgcgatccgcagct

SEQ ID NO: 697933 - DNA, 1411 bp, Homo sapiens
  misc_feature (1410)..(1410): n is a, c, g, or t
ccaagattgtgccactgcactccagcctgggcaacagcatgggactctgtctcaaaaaaaaaaaaaaaaaaaggaaggaaagcatcaatatcttctttcctcaagccaggctccggggggctcatgactggtggggaggccgaggcgggcgggactccacttgaggtcggggagttcgagaaccagcctgggccacacgtgatgaaactccggtttctcctggaaatatggctataaactgggctaaagcggtgggtgggctgtgacgcctggtaaatcccaaggtaacttgggcgaagctagaggctggagagaattggtttggggcccggggaggcggagtgttggcaagtggtacctggagatatgggccgcctattggcgactccaaagcctgggggctacacagatgtggagatctccaatctcaagaaacaacaaacaataaaaacaacagaaatatatctaatcttatatactatatctatattctattgatgtcttatatctcatattctgtctccactcttatcttataacactcttctcatttttccccccattttccaggtgacaagatgtttccaacaaaccacacaccgtgtctcattagaggggataggagaactacaggacagagagataacgatgtgtaaaccgaaatcgggtggcgaagggggaacaacagcgtgcgctggagaattgtgcgccaaaaatgcgtcagggggcccccccagagaaagacactaaggtcggcagaacttggcccataaacacaggtgtgcggcagggcggaggcacacacagaggaccactatagaaccaacgggggcgcacaacacaaagcactccaggaaagggggaaccccaaaggaaaggcgcaagcgaattaaaaacacaaaaacaacgaaagcccgggccaactgcacaaatccggaacaccccttggacaccgcggaggatacaaacgaacgcatacacacccacagggagaggccaagaaaggggaggagggaaacaaccaagagggcgacacacagaggataaggcttaagaaaagacgacacaatggcccctaaatgcggacacgcacctgtggatcgcacggctcaccgcagtgcacaacacacaaaggagcaaggcccacgaaaacccaccacgggaacaacagaacgcccccctttgctaacaaaaacaacaagggacggccaaaaaacgccgagggcgacgacacgcacactcctgtacaggaccccacagcgagcaaacaacgccggcgcaaacgcacgagacaagaaagcgactgtaacacactctgaatccgatgccacgaccagcacaaatgcattcgacgccgtaacacaattagacacgagcagcacgcacgcacagagcacacccagcccgagnt

SEQ ID NO: 697934 - DNA, 1580 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctagcagttgtggtcatcggagctgtggtcgctactgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 697935 - DNA, 493 bp, Homo sapiens
gacccacaggcaggtgtactggtagagggctcttcccatggggatcttaatccttcagcacttccagcagaaagagctgctctagcagccagagaaagtccaagggcagacaattgcaggtgctggcagttggaagccaggttggtgtgcgtggaaatgctaagtgtgggaaatacgggtggggtgcagacagtggtgctactcctgtgacacgcaatgtcttctagcttgttggttccacagtttgacattgtcttggtcatgtaatggatttacttgctgattgacactcgaaaacttctcatgcctcccctgctcctggttccatttattgttccccttcttccttgtcttttcacttcactcagttcatcaccatttgccttggctttggcatcaaagacctgtgggaagctatttccttttttgagcctcaatttttctaatctcaaggtaagaataatagtatatttttagggtttttgtgtggatt

SEQ ID NO: 697936 - DNA, 207 bp, Homo sapiens
cacatacacttgtgtcctgtggataatgtcccccatgctcgtagactgtgattatactcagacgttctccgatgtgtgtcagacagagcatgtaagcataaggtgatcgtgtctgatcgaccgaggagacacgctgcacagaagagatatgcgctgcttggttggttaacacacgagggctcagagatgctagtcgtgtatggtggt

SEQ ID NO: 697937 - DNA, 260 bp, Homo sapiens
gcagggaagagtttgattgagcatgaatggtagcacgtggaaattaggtatgcagttacgaattttgtcactgtccgatcagcggacatagtagagaagatggcacagaactcaaacatgagaaatagtaaacaaaataacgaagcagcgagtatatgctttacatgttaagaattaatccaaacaaaatagtgtgaagcacttctccgatttggaagtcttaaaatgtgatctcatgttttatttgagattttgtcgac

SEQ ID NO: 697938 - DNA, 1579 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctagcagttgtggtcatcggagctgtggtcgctactgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 697939 - DNA, 655 bp, Homo sapiens
  misc_feature (3)..(3): n is a, c, g, or t
  misc_feature (103)..(103): n is a, c, g, or t
  misc_feature (131)..(131): n is a, c, g, or t
  misc_feature (158)..(158): n is a, c, g, or t
  misc_feature (230)..(230): n is a, c, g, or t
  misc_feature (267)..(267): n is a, c, g, or t
  misc_feature (288)..(288): n is a, c, g, or t
  misc_feature (382)..(382): n is a, c, g, or t
  misc_feature (389)..(389): n is a, c, g, or t
  misc_feature (435)..(435): n is a, c, g, or t
  misc_feature (470)..(470): n is a, c, g, or t
  misc_feature (499)..(499): n is a, c, g, or t
  misc_feature (654)..(654): n is a, c, g, or t
ccntccccgattctaaacgaaaaggaatgggaatgacagtcacaaacaagatttcaccactaaatattgtgaagtgacttcagccgttttatatatgaaactnaaggaatcaactgcgttccaaaacagcnaaatatgcaggtccaaacaatgaagtnattttttaaactgccacattaactccgaagcccactcatctccttaagcatcccacagatgaagcacatgtnccgcttagctagaaaataatgaggtggcaaaaacgcngcaccgctgaaataacagganacctgcttataaaactagaattctgaagctgggctccagcttaattttaaaaggttatcatcctcatccgggagagcagttgtttgagcaaccnctaagtngtgctcatactgtgctgccaaagctgggtccatgaaaacttctggnggggcgagagcggggatgggaacaaattccaagtnagggtttccaatgagcttcctagcaagcnagaggaagggcttttcaaagtggtggttacttttggcagaaatgtggtagtactgaagattcttctttcggtggaagataatggatttcgccttcactttcctgtgcttaatatccactttgttgccacaaaacaaaatggggatgttttcacana

SEQ ID NO: 697940 - DNA, 113 bp, Homo sapiens
cgtgctgtatgaagtgacttttggctggtgactgtggacggtcatcttatcgaaagagctgcggccccagactggcgcagggtgcccgctgtgggagcacttccagagcctgc

SEQ ID NO: 697941 - DNA, 1010 bp, Homo sapiens
tacgagcaatttaccatctcacttctaggaatactaggtatatcgctcacacctcatatcctccctactatgcctaggaaggaataatactatcgctgtgcatgtataggctactctgcataaccctcaacatccactccctcttagccaatatgtgcctatgccatactagtcttgccgccgtgcgaacgcacggtgggcctaagccctagctagtcgtcaatctccaaggacatatggcctagacttacggtacataagctagacctgactcacaatgctaaaaactaatcggtcgccaacaattatattactagccactgacagtgactttccaaaaaggaggacatagattgagatcaacgagaacaggcacagcgtaattattagcgtcatccctctactattttttagccaaatcaacaagaactattaaggctgttgccccaagctgttttccgtccgagccgccgtaagaaccaccgcctcctaatagtaactaccgtgactcgctagccctcacaatcatggcagaggcaaggccaagttatcccagtgaaacactagtcacgaagaaaaactctgactctctatataatcgtcccctaggaatttccttaattataagcattcacaggcaagagaacctaatcatatttgaatatcttcttcgaagacagacaggttatcccagcggggtataatcaggcggagaaggacagcagaacaggctgaacgaggcaatactgccaatatgccctaggaaggtccctcgccaatcatggcggtaacagcacaaaacctaggtcaggaaacttctatagtacgctcacgggcagaaaataacgccgggcacaactaataggagctacacgaagtgagaaaagccctgcggaacataggcagcgagagccccagggagaaagcaggaaaacgggggagacgcatcacgaaacactggacagaaaacgcaaaagagagcgaagcgcgccaacaccacactctccgga

SEQ ID NO: 697942 - DNA, 287 bp, Homo sapiens
agccgatccctgcctttggtcggtcggcgtgctggataatcacctcgagaagatgtgcgtgtgatacctctcagtgaaaatccccccggggctggaaagatggtttacacgcgtggcagaaattaccgccctctgacggggcagctacccgtaagaatactgcaacgccctggaaaaaagtcgacaaaattgggcggtgcgcacgttaatgtcggcttggtgatagcggcgttcgcaaatcaattgtttaaacaggacacctttctcaaagttacctccacgaaagg

SEQ ID NO: 697943 - DNA, 935 bp, Homo sapiens
ggtctgcactgtcggctgactctcgtggttagcaccctatgatggctactctctgtgatccctgagctaacctgtctcttccttgtcctcaacactccagggtgagccgacagcaaaatgcagatctgagtgaatacgcttacggggaaggaatatgagcctcgaggttgcacagctgtcggtatgactgagtacgaaagaatgtaaggagatgatccgaggattaaggaaaggacattcctcctgatagagcagagagtgatcttggttgtaaagcagatgagataagtgagagcatgaacttaggtctggaatactatatagttactaactgaatgtacattaattcattagatgtttgtgtctgagagtttaagttggatgagggcgtaagaaataggatgactaagtttgacatccagtccaaaagaagaatatggtatataagaaagagggttgagactggtgtagtccgtgacttattctagatggagggtggaagaatggtgaatctaatgtcgacgtttcggtaagataagtgactgtgtgagagcaatgttggtgcaggggggtggtatggtgaagtaattttgaagacaatatggtggacgagttgttgtctaggttatgttattagaacaactgaagactagtactgggtttgagtattgaagtctgtcctgaatagaacttatgtggaagccaacaaaatttcttctgccgcatgaacagaagattacatcgaatgtccgtagaacgtgggccacaaaggtagggaatgagaagcgagaccaagggggaaacctgtggcgggattgacaaaaaggggggagctcttgttccagcggggttggaactagcttcagggaacaaaaaaacccgcgggggagaacactgggcgagaaagtaagataagactaaacaggaaagattcc

SEQ ID NO: 697944 - DNA, 124 bp, Homo sapiens
ggttaataagcatggtggaccatgacatgaaggacagatcttgatctaggcccacctgtagatccagatgaagactctgacagcagtgcaatttcatgtacaatggattaaatgacacctgtga

SEQ ID NO: 697945 - DNA, 1289 bp, Homo sapiens
ggtgcgcccttgagacgctcagcgggctatatacttcgtcggttggggccggcggtcagatctgcggcaatggcagccgagacggtgcagtgaaggagagtgggcgtctggcggggtccgtcagctttcgagcagagccgctgccagcccatggtcccaatcgaaggtgggagatgccagtcccagtcatgtggaggtgttgtgaaggggagccatgggaacagaggtgaagcctggtcgatcagtctgttcgaatggcgtcgaagaatgggtgtgctgctatggagtatcctgggtgccttcacccgctggatgtgccaatgacagcaccgtgccaggggcttatcgtgggacgttcgaggcttgaggcatctagaaaggccaaaggtggacgtccagtgtgtgttggcctagtcttgagtgtgtagtgactgcctttgtgacttggctgaggtggtggccgagctccaataaggccggaaggcctgggttcggctcctgggctgatcccactggggcccttgtggtgccacgcgaggacagactttcttgctggatgattcgcgtggttgtccatcttttgagtgcaatcgaccgtctcgagaggttctcccattgggtggtaccacgggtgggcatgacgttgaatggccctgaatggtggtgaactcgcgattggcacagggcctcacgtaggcggcctgggcacccaagtatcctcgttcacaagtcctgcagggccggggccgaaaattgttcttcgaacccgtcctattttaacctgggccaggccttgtttctgtgcgcctggggcttgtggatgtgtgcccgcaatgtggtggaaaagacccgttgtggttgcggcgcccccaaagaaaaaacactggcgtgaaaccgcacggagatatgtggtccgctcagtgaaacactccgtgtggtcgtctacatgaacgtcacatgttgtccacgaacaagaaaaccacagtcgccaactacatctggggagatagtaaatcagcgttcattcggcttggtcccgtcgtgtgttacatttccataacacaccgacatcaacaaccagactcaacataccaacaactatacacccaaaaacacaaagaccgacatactaacacacatacaccaacacacacatcaactcaagtccacagtacacttacaaaactaaaataacacaaacacaacctcataaaactaacaacgcacctgaacatcaaaccaatagctatgacaatcacacaacgacacaacatgtaaaacaccaacca

SEQ ID NO: 697946 - DNA, 554 bp, Homo sapiens
taggctagatggaagctccatatgggttgtggccacatctgtgtggttcttgtctgtgattactcagcacgtaagaggtgcttggtaatactatatttgtaaatggatggtagggagatatttagactagactgaggtcattggagggtagagacagtgtcccaccatgtatgggacaaaggccagattccattgtctcccaccatcattttttcccagccttatctcctgctcctctgaactttttcacttagacaggtggatttcaaacagctctacccttttccgaattctgccagtagttgcttggcctcctttctacctgtctaatgaatgttcccacctcatgggccacctttgaacttaggaaacttgtgaggaacacttatttgacacttagccatgtatatactatgagaatgttttcaagagcatccattgagacacctggtgtaagaaataatttttctatttttgtgagtttaggggacttttcctttgaacagaaattaaaaccttatttactagaagaataaagtgatgttaaattgaaa

SEQ ID NO: 697947 - DNA, 268 bp, Homo sapiens
ccaggcactgaagctggggcgacagagtgagactctgtctccaaaaaaaaagttttcctgtggtttaaaaaaaatctttcatgaaaagaatggtcaatcaacgtgacaaatttcattatggtcttattttaagaaactgcaacagccaccccaactttcaagcaccaccttgatcaacagccatcaacattgaggcaaaaccctccaccagcaaaaagattatgactcatggaaggcttaggctgaccaggctgtcagtgccttgacc

SEQ ID NO: 697948 - DNA, 1049 bp, Homo sapiens
agcggggtcgggactccgtttcagatctcaggtgcggcgagcaccaagatgtccgggaacttaatgcatttacggttctagggttgttacgattattgcatggacgcgagatgcgacggtggactgcaccgggatgttgattggtcgagatgagtctccgtgtgagtcgtgcagagtgctttagccagaggtgatggggacggcacgaacattcagatagtgatggcgctcaggtcttgggtgcaaatggtgcttgtccaatagacaacgtcgctaacatggtataaggaccgtcgtgggacttatattcaggtgccgtagtgtgtacgaagtggatagggattgcgcatggtatgtacatcgtgaaagcatgggtaagatcactagtatcggggcgcaatggaagcttttaggttattcgtgcgctggaagttatgtacgatagtagacgttgtaaacggtaaaacgcatattgagggtaaatccgttatatgggacacgggatgtgaacgactattcacttgggaaggagacaaagtttgggtggcgttaagtgcgaatatggaaggcttattattccgattgttgtgtaagcagattcacgaataacggggagaaatgtgagatccagtggagtgcaagcgcaggtttcgagttctaataaggttaacgagaaaaatgggcaaacatggttgtttccctataggaagtgtttcggatatttcgcccaacaacacattggatgtgtggggtgtggacaaaaaaaaaggtgctctgggcccacgacgcacagtttttttgggatttgagcacccagccggccaccgaagagtttaatacctattagatgttacgcccccccgaataatatggcttctaacgtaagatgacattatcggtcaaaaagagacgcatcgcaaaaaatgaggaccaccaaatatttgggtgatttacactggatgtggagggcgacatattaccattgtgaggagagacgcccacgattttatcaatgagtaatgctcataaatattaatttggggagatta

SEQ ID NO: 697949 - DNA, 435 bp, Homo sapiens
gaagaatcctctgctcaacctgttttggcccgaggtggatgagggtgctgttttgggcatcagccccctcagcaggcctttgccttttgcctgcagcaatggggagaactggtggtgggtgccagtggtggcaccacttttgggggcctatttagggggcatcatttacctggttttcattgggtcccccatcccacgggggcccctaaaattgggggattttggggggtataaagaccccgggaaaaccgtattgcccaagaggggattttatgaacccaggatttttcccctcacccccgtttttgtgagccctgccaacagattttcagtcccccctgcggcatttttacatgaatccagggccctagagcacttttaagcagagattatttgtgatcccatccattccccaataaagcaggggttgtccga

SEQ ID NO: 697950 - DNA, 415 bp, Homo sapiens
  misc_feature (146)..(146): n is a, c, g, or t
  misc_feature (189)..(189): n is a, c, g, or t
  misc_feature (230)..(230): n is a, c, g, or t
  misc_feature (248)..(248): n is a, c, g, or t
  misc_feature (261)..(261): n is a, c, g, or t
  misc_feature (263)..(263): n is a, c, g, or t
  misc_feature (297)..(297): n is a, c, g, or t
  misc_feature (302)..(302): n is a, c, g, or t
  misc_feature (307)..(307): n is a, c, g, or t
  misc_feature (309)..(309): n is a, c, g, or t
tatatctgtgatttgaatgagggagccctttggggcaaattcaggtgcccccattgcctcaggctggccctggtcccaggtggcagcggttgaggaggggtacagggctctcaagcctgaggttttcttctctgggcttaattttntccccccgcacccgcctcacaccccccacggtgtccgttgaanccacccccccccttttcaatacatgaccccttcagatcatntgtgcctacctcctgccnatcaggcgtctanantgtcactcagacacctgtggcatgtggaggagantgccntgtcntnagcctggcaaatgtgcaactgtctcctgcaacctgctgggcatgtgggcctggctgtgttcaattgcaacaacaatttttatgaaatggattaaagcttgtttttt

SEQ ID NO: 697951 - DNA, 273 bp, Homo sapiens
  misc_feature (218)..(218): n is a, c, g, or t
taccccattatgtgacatgttgatgcagacatgcaatacataataatcacatcatggtaaatggggtatccatcccctcaagcatttatcctttgagttacaaacaatccaattacattctttaagttatttaaaatatacaattaagttattgactatagtcaccctattgtgctatcaagtagtaggtcttagtcattctttctaactagtttttngtacccattagcagtccccgcctcgcccctactctctccctgccacgggtaccga

SEQ ID NO: 697952 - DNA, 156 bp, Homo sapiens
gcctgtcactcatccagaattcgagatctgctggtttaacaggtcatgcagtgtgatttgacagcgtgaactcttagagtccagccatttgacacctggcgctgtaatcctgaactttactcgcatattccgcgcggccacgtagcttagttaatt

SEQ ID NO: 697953 - DNA, 763 bp, Homo sapiens
gctgagacccgaaactcaccctagtgtgctccccgttgccccttgcattgagtccgcaaacctgggctgtgacggatctggagaagatgagttcacgtgctacgccgactaaattgctcaacggtcccatatccagtctaagcacatgcaggatatgcaggatctgaactcaggatcatgcattgtagtatgctgctgtggaccctttgctgtccatgtctgactgctgctgcttctaacattggacacatggctcagagctacgtcacgtcgagttctcacatggatgtccagtgcatgtccttgtgcattgactggttctcgcagacatccgacgtggcataggtgagggccctaggtctggtgcagtcacctggtcagtcggcggatgtgctggtagcagagcactgctccatgatgcaccaagagtccagcagcaatgccctgaggtggtgtctacagtggagcccagcgacccccactgttccctcagaaggagcacagacataagcaccttccggaatcatctccctctgaccaaggctcagccagacccagcaggaatgacagtggaagagcagccactgcccccgacctcaaaccaggaccttggggaggcctctctgcaggccaccttgctgggtctggcagccctaaaacaaggcctacccagaagtgctggctcagggacgcactgcccgtgtgacgcttacatcccctttggcccgacccctgcttggctgggaataccctgggccaggtg

SEQ ID NO: 697954 - DNA, 953 bp, Homo sapiens
  misc_feature (777)..(777): n is a, c, g, or t
gcaaaatcatggcggtcgaggctggtgtaattcggcactgaggcttgctctcgccgcccgaggccgcgcgctcgccatgtccggccaccgccaccgtgtgtcgcctcggtgctgggcaccatggagatgggtgcgccgcttggcacgcgcccgccatgtgtccgctgccgtgcgctcctttctggagcgcggcacaccgaactggactcggtgcttcatgtcagcgacggccagtccgagaccatcctggggcggtctggggctcggcgcatggtcggatggtgacctgcaaatgttgaacacattgtcaccaaggccaaccctttggcgcatgcgacaacatcactaacagcctgactattgtccggctcccagctggagacttcattgaagaggctgcagttgttccctcaagtggaccttcttcttaccgtacacgtcaccttgaccacgtgtaccccggtgcaatgagacagctggcattgcttgccatactgggtgccaccagagaggggaccaacgtccgtgtgagcttggtccttctccaaaatatgctagcttggagaagttggccgaaatctgtaccctctgcaacgaggcaatgggatggactcctgcccacgtgtgtaccagggcctttgtacaaggctatcacccggaaggtgggaaatgtagcttttcctgtgcctcaggcactttgccactgaggtactattgcctcacgaagccttcttgggttgggggcctgtttgacgtgggctgttcaccgacgttttnagggactaggacgggaaatacagcctgtggggccggttctgtgcggaatagctggggtttgagaccctacacggaatcgcttctgggaaggagcgaccagttcgaggacatttgcgttggttgcgaaagccctgaggccgcttattgggccagggcccccattgtgacctcggttc

SEQ ID NO: 697955 - DNA, 680 bp, Homo sapiens
ggaggcggtggggaccgcggggcgacgggagcgagtatgtccgctctgactcggtgggtcttcgctcgcgtgggaggccgcctttcagaagcggtgcgcacggactgtggagatggtggagtccggtcatgccgggtggtggtgtgcactatttgagcccgggtatagacagttcccccagtgaccagatcccaggtgttccagagcgagtcttcagcggactcatgtggttctgattctctggcgcttttgcatgatcagaagaggtgctgggtcactttccggtatcctgatccttcccagtgacagatgaagaattaggtatccctcctgatgatgaagactgaggtgtagactcagcctcactctgtacaagacgccaggtgagaatttcaaggattatcgacttcatatgggcacatttaaagttacaaatttacatgtggtgggcccaaaaaaaaaaaaaaaaaaaaaaaaaaaaatttgttgcggccggctgggggcccaggggagagtcttctaacaccattcctgtggcccccgggcccagagtgtagggaccgggcacagcgtggaccagagaactcggccagcgcagtggggggtcccaccaaaaaaccccggggacggggttcggcaccaaggtcgggcaacgtcacagggcaggcgtacccgggggg

SEQ ID NO: 697956 - DNA, 279 bp, Homo sapiens
ctgcggtggatgttgtacctgtgtgccggtgtcgtgatgctggggagcgctgagactcgcaggtgaacttctgaactgctggggagtcggggggcatggcagacagcgcggacggtgggcacctggccggccgacaccatctcgctcacaatctggccacttgggaagaaaacgtctatttattccccttctctgcatcactttttgggttactgtccttcatattctttaattttttaaacccatgatctttatccctgtgtccaagttgactgtgtt

SEQ ID NO: 697957 - DNA, 107 bp, Homo sapiens
  misc_feature (3)..(3): n is a, c, g, or t
ctntcaggacccccaccgctccagacatacatggttgggacacctagggctaaaataacttcaggtgctctataatgtcttgtagatgccaatgtactgtgatgttc

SEQ ID NO: 697958 - DNA, 134 bp, Homo sapiens
tttttacattgaatattatatggctcaatgattccgtagcacatgttgtaaaagacagggttcaaatgatgttcaaaacacgtcatctttgtttcatagctgatttctctattaatggtgtctcgaagaacact

SEQ ID NO: 697959 - DNA, 297 bp, Homo sapiens
ccgatttgacgcgtccctcctggaagcaggccaggacaagtccaggctcttaatcagctttgaatagcaaacacctatcattttttaagcagtgaagaaaaaggcaagggtaaaagccaaatgttattctgaggtctgaaatgaaacaagctgaaaatgagccagtttcacaagctctggccttttagagataaaaatcagaaaaaggaaagaaatgccttctaagaggcacatgaagggaaaacattctggactaacagtgaagagtattgagggcatattgctccctccctagaa

SEQ ID NO: 697960 - DNA, 138 bp, Homo sapiens
aggactagcattaattgacagctgaccgaggtgcaacacagaagtggatacagtgaatcaaggaagacagcagaagacaggataccaggaaccagtgtatgatgaagcaaggactgaggcacggtggagcactcatgt

SEQ ID NO: 697961 - DNA, 177 bp, Homo sapiens
gcttgagttaagcgagtttgcaaatgcgcgatgaggcgatattacacgttattcgttactatacgcgcgaagcagggtgcgcgaattagagcggcaattggcgtccatttgccgcaaagcggctcgtttgatcgtgtcagaagagaaaaaacgcgtcgtcgtgacggaaaaaaattt

SEQ ID NO: 697962 - DNA, 188 bp, Homo sapiens
cgtgagactgaggtgtttataaattttggagattaatcccttgtcagtcacttcatttacaaatactttctcccattctgtgggttgtcttttcgtttgtttagggtttcttttgctgtgcagaaacttttaaatttaattaagtcccatttgtttatttttgtttttattttcattactctaggaag

SEQ ID NO: 697963 - DNA, 305 bp, Homo sapiens
tccagcggttaccgattaggattgtgtgacgtatagtatggatgctacttgtcaaaatgatggtaaaagggtagcttactggttgtcctccgattcaggttagaatgaggaggtctgcggctaggagtcaataaagtgattggcttagtgggcgaaatattatgctttgttgtttggatatatggaggatggggacttattgctaggactgacggactggactacgtaactacggggcaacggaccgcctcctagtttgttacgggaccggagcgacgactctgtgcgggatcctctacgagtcg

SEQ ID NO: 697964 - DNA, 826 bp, Homo sapiens
gccttcacttcgccctccagctgctgcagctgcagcccgacgcgagcgtgccaagcggttcagcagctagcggagcggtggggcggcccccctcaggacaccaacagattcccctcttcccgcggctcgcatggggaccacggacagacttgcgcgcgtcaatgtgtatcctccatcatatgctgactgtggaaaagctgcagagatattttcaacaaaggattccggtttcgggttggtgaaactggatgtgaaacacaaagtcttgcagtggcgtgaattttcaacgtccggtccatctaatacaagaacagtggtaaagttatgggacctgtggagaccaaatacaagtggtgtgagtatggtctgactttcacacgaaaagtgaacatgataacactctggaacagaactcgcaattgaagaccagattttgtccaaggttttgaaactgacattgatactaccttctcaccaaaacaccaggaacgaaagtgctaacaatcaagtcttcttaccaagaggggagtgtataaacctggttggttattgttcgactttgatttggtggactggaatccatggttcaggtgtcttgggtatgagggtggtttgtggtaccagatgaactttggaagtgcaatcaaggtgacaggataacttgcaggggtaacgatgggatttcaattaacactaagtcatgtgggcgcattgggggtcattttccaaagttgggaaatttggcttccgaaacttgtggcatcggtacacgctcgttggtggggaaataatggccggcccttggagcacctctttggggggtccc

SEQ ID NO: 697965 - DNA, 1434 bp, Homo sapiens
  misc_feature (189)..(189): n is a, c, g, or t
gcacatagaccttccatgtacagtgactgcgggcacagacttggaagggactgctgtctgggccacctaaactcacgatatctggggcgtgtccagtagggctgagagagctcaatatcctacctttgacacacaaggtctgcgagaagctcgaagaacaatcgttcgaatcacgcgagatcactgtcntaagataatgctcgcgtcacgacccgtcaccgcctgaacaagagttacaggccatcggaactgctagtgtcgttagttcatcgcggcttcagcgtcccatgccgacctaaacatatcgtgagtgccagacagagtctacatctccgataggaaagctgagaagtgctatagtagtccatgtggtcattagactcgacatcaaggtagccataatttggaacctagcgtcgtgttgaatgaaagactttggtgctgaccagtatgaccgtggggaacgtttttgcacatgatgcactcgaatgctggctctagactttgcgcatgaaggacatgtgcggtagtgatagctgacgatgagccgtcctgtgatgtgtatccgaatcgccgtatttggaacctcgttggggctaaacagaaaagactttgaaggaaatctcttcgtacacaacttaaccacgcagttcataggcttaccgtgtcctttgctgtaataagtcctagttctaagtattcactccctaattcacccattaccttgcagagccccccccatatatttggtcaaacacaagggaaggaacagatcgttctggggttcgagaaaaccgggtaacttagcacaggaaggaaggtatgttaggcgctttgattgttcacatgtgttaacccaagagcagtgagcaaggggaaattttccccctggtataggcacgtatgaaaacacaggggaaagcacaataggcgactgtgaccataggggggaaagttccagagcagattgcctacctccttgtaaacgaaagttggacgtacaatatataggataagcgcaacttaagaccatatcagaaaggctccgcgaagtttgcacaaagaacgctcgtataccacaccccccagtggagaaataagacgcaacatacacctttgggatatccaaagggggattatggccaaacacgtgggcgcatatgggtaccctaccagaaggatccaaatggagaaggggacgccacgattatgacaaaggcaaatgggcccggggaacacattcctttgattgaaccaacatacccattgggatggcatgtggcacagtagacccaagttcctttaccacgcattcattaggaccccagccgtggcgaacattgggggtaggcctatggcttcagagatttgcgtattaggggcaacatatgtagtcaggaggcaggtcaagcacatatcagaattggcaccccc

SEQ ID NO: 697966 - DNA, 116 bp, Homo sapiens
tcccatggtttccatttaaaccccctggggacccaagggttccgggggcccttttttaatcgcttggccaaaaaaaggtccccgggggtaaatttttcccaaaaaagggttgccca

SEQ ID NO: 697967 - DNA, 895 bp, Homo sapiens
ggcagttcggcggcccgcgggtctgtctcttggctttcaaccagtgtgtggacggaacagatcggggactctcttccaagcctccgacgccctccgatttcctctcggtttgaacctctgggaccatcttctcggccatctcctgcttctggacctgccagcaaccgttttgtgtggtagctccttctgtgccaaccaaccatgagctcccagattcgtcagaattatcccaccgaacgttgaaggcaagccgtcaacagcctgtcaaattttgtacccttgaagggcttccataaacaatacctctctctgggctacctattttcggaacccgcgattgattgtggggctcctagggaagggcgtgagcacacttctcttcccgggagaaacgtgggccggaggaagaaaggcgcagagggacaaaacagaagggcggtctcccgtgaatgatggcaaaaacccccaaggggttgggggcacggcgacatcttctttcacagggacaatccaacgaacgcccggttgaaagatagactgtgggggaaaacaccccaaaggaggctaatgaaacatggttgccaagtggcccttgcaagaacaatcggtttgaagccaagggcctttgtggaatcttcaatggcacgttggggtgtctggcccgggaggggaccccccatattcgtttggtgacttcccgtggagactcattccataggttgaggagaggtgacgctttcatcaagcaggttgggtgcccattgacaaccctcaaaggggtgggtgcccgagatgtggggcgagtatattcagagaggtcacttcaagacgataagacatttggcaggatttggagggcctggaaaaaaggtccgaaagctccccgaaggggttt

SEQ ID NO: 697968 - DNA, 729 bp, Homo sapiens
  misc_feature (439)..(439): n is a, c, g, or t
  misc_feature (590)..(590): n is a, c, g, or t
cggcacgaggtttttccacaatttcagctctttctctacaggagataagactctcacttagggcaatcttagcagattttaggttcaatatctgcttctgaagcctggagctagaatccctgagttcatcattttctttcatgactttgtccactgaacttaggagcaaccaactagcttcattatgttccttggttttccacgtatggtcaattgtattatgtatagtcactgaactccttgcctctcacgagcgatgattcaggtgtgtcaaatgcatttattttgcataactctctaaacagttcacaccaaggactatcagtgttccctatactattagaagtacagtccttagcatttttgggtctaatcatattaaatagccaacttcagaaaccccaaaaccaatgaaagaacttcatccttaatattctgntcctctagaacaactcctggtaccaaaatctgtatcagtcaggattctctagagggacagaactaatggaaaatatatatatatatatgagtttattaagtattaactcacatgatcacaagggtccacaataggccatttgcaggctgangagcaaggacagccagtctgagttctgaaagacgtaggcctggaggctagggctggctctcttttttacatttttctggttgcaccctggcaacttggtagattgtgccacccagattaagaccggcttgcttttcaac

SEQ ID NO: 697969 - DNA, 216 bp, Homo sapiens
ctggaagaactagacttactggacgacttggatctggtggaagacacagattctttctggaacgacatggattagctggaagatctgtatttgatggaagaccttgaaacttattaggaagacatgcgctttcctggcaagacgtggcattttcctgcgaagatctggactttgcgtggaacgaccagctaacttgcatggacagactggactttg

SEQ ID NO: 697970 - DNA, 238 bp, Homo sapiens
attttaagtcaaggtagaagacaattatgaaggaaagacagccttttcaacaaatggtactataacaattagatatccataggcaaaaaaaaaaaaaaggattctggttcaagggcccaccctttttttaaattattttaaacctctgggccgggcccggggttcctggcttttattccccaatacacgggaaggttgataacaggcgtaatcccccgcgcccgggcttgcctttctt

SEQ ID NO: 697971 - DNA, 301 bp, Homo sapiens
  misc_feature (34)..(34): n is a, c, g, or t
ttttaagataaatcacctgtgtgataatattttnaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggg

SEQ ID NO: 697972 - DNA, 285 bp, Homo sapiens
gcagactttgcagtgagccaagattgtgtcattgcactccagcctgggcgagaagagcaaaactccgcctcaaaaaaaaaaaaaaaattgtcactggagacatgatgggtggagactctacataccttctttgaatacagaaacggatgcaaacacatgcaaattactttttttttttttttttggtgatgcatgaaaaaactttgacttgtggattacattaattattagtaacagttagattctgccgacttgtattacagtagggtcttatttccttaaaga

SEQ ID NO: 697973 - DNA, 112 bp, Homo sapiens
gcggtggcgacctcggccttcagtgtttccgacggagtgaatgcgcggcggcggctgggatgctgctgctgggcttgctgcaggcgggttggtcggttcttggccaagcgat

SEQ ID NO: 697974 - DNA, 198 bp, Homo sapiens
ctgacgttctctgtggcatgctggtctggctctccaggtggtcagagcggcccagtggtgccccagcacggtggtgcccgttccaggcctgtgattgacttgtacgattcactcctttgagtttttggatgtcaactcagccctctgatctggagcgcagcctgccgaggcctctagggacgagctccccactgcaga

SEQ ID NO: 697975 - DNA, 677 bp, Homo sapiens
gagaccgtaggaatgtggaattgtttggcacccatgtggactggtgagaagaagccgagggtgtctgtttttgttctaggcatccccagacaaaagacagaagtccggaatcgtctttctgaagaggacagtcatcaagctgagaagaaactgggcatccccaagatttcctctagcttagtcctgctggtcctctgaggaccgggatggctgacctgacttttcctgggtactgcaagaaagccagggacggcagatcttaccagttggctggattagtgtcacaatgttggatgttccggtatggatttggcaaagggcctcctggactgcagcacgcacgagggagagagagagaggaacgacaaaaaacagggaggatgagggaaaaggtgaagtgcgaacgaacagatggggcatgtggccagagaccctcaggatccaggaattaactcaagatgagctgctgttgcccaactgctatcctgggttagcaagagagcctctgcaccacagacaatcatcccgggtttgggcaccaaatgtagagttaaaggaacggaaagaaacacaaaacgcggctggcagattacagacaggttaattacagacaaaacctgagaggactcctggccgaatcagaaagaagtgtttacatttaacagaatagactatta

SEQ ID NO: 697976 - DNA, 165 bp, Homo sapiens
gcgtagaggatccccgcgaacaggacatgcaagcccctcactctcccccttcacacctctagacctggggcctccggaaccgccagctggctgcgcttatactagctcctgacttaggaaaagcctcgtgtcacaacacgtgtccctacaggcaaagtgtcctgg

SEQ ID NO: 697977 - DNA, 156 bp, Homo sapiens
cagagttgtgcagtgggtatcattgccgacgcggatgacattgacgctggcctctggtctggtacagcatccggttggccctcattgtgagatgagtagacccttctgggagaatgttgtgacaggagcaggtactttcctgagtttgtccgatgg

SEQ ID NO: 697978 - DNA, 131 bp, Homo sapiens
agcctgggccagcccacagcgttcctagtcaggcagccaccccttggtcctcattttggtcccttccaatttgaaacctcgtgcctggttcgtctgccccctacatttttctttccagctgctgttttgta

SEQ ID NO: 697979 - DNA, 1221 bp, Homo sapiens
  misc_feature (750)..(750): n is a, c, g, or t
  misc_feature (834)..(834): n is a, c, g, or t
  misc_feature (1131)..(1131): n is a, c, g, or t
tgcatgggatgcttgaaatgtgaatagtgcaaaaataatctgtctgatgtctcatcttgtggtatctacgttatatttgcaacggaagtggaatatacaattatatggttctactggacgtgcacttcctatactaccatcacacagaccaatatagtatgtcactctacgtcaaccatgtcctcttcatggactcccgtctaatactacgataggtgccgtgcgaaccaaatccgcctaaagatacctcctcatcattgtgaatctatctccacttcttcgtctcgcatgtggaacatacaattcctaggacatgcgtgaagattgaacatgccagcacctcgatacacatgatgaatatgggttgatcttgacaatattagttagagttattgtcaagaatacttttcacaagacaaaaagcacgtatgacgagtctcacagtgactctctccgattggtgatgcgcattctagggtgagaacccttgacataattagtgatacctctgaaacaccaagagttgaccaacacgttacttctttgagtaatgtcacactagatcgagttggattttcctcaccaaaaggcaataatagtactccatgtggtttcaaccttgatttcgactccggtggagtacgtgggaagtattcttagaacttgaacaacgagtagcgccttaaatataacactttgctcctctgtttgggtcgctgatcctaggctctccagatagatcgtcgatgnttacagcgtctgtaccatttggtaagagagcggagcctttcctagaaagtacttaacaggggtcacctggtaggacgcgtgtantcgagcgaatagtgagctgcgttcgtttcccactaagccaaattaacaggggctctgatcgacctcacgagagcacggtgtttgtaataccactacaaaaagaggtacttgccaccgtgacatataataatttcccaaggggaggtgtgcccggatttgacccaaaggggaaaatcttacactagaagatctacacttgtcgaacctcgcgaggatctcatgtgtctctcacaacacgccgcatcacatgtatgagaaaccctcctcctagcacgcctttttactgccatcagactnacatcagccctcatctctagagcggcgagccgatccatatgtgacaatcgacagaccgccatcgctaccagatatcaatacaccgacccc

SEQ ID NO: 697980 - DNA, 176 bp, Homo sapiens
ggcaatggctcttgagggagcactcggactctgtggaggacctgactgggaacaggtggagcaatgatctggacacctgtcccatgactctgtatgtaccgtcctggctaggacatctggagctgatgcttggacaatgacggtctcttaggtaatgaatggggatcccgcaaccc

SEQ ID NO: 697981 - DNA, 894 bp, Homo sapiens
  misc_feature (1)..(1): n is a, c, g, or t
  misc_feature (76)..(76): n is a, c, g, or t
  misc_feature (82)..(83): n is a, c, g, or t
  misc_feature (162)..(162): n is a, c, g, or t
  misc_feature (195)..(195): n is a, c, g, or t
  misc_feature (204)..(204): n is a, c, g, or t
  misc_feature (225)..(225): n is a, c, g, or t
  misc_feature (229)..(230): n is a, c, g, or t
  misc_feature (237)..(237): n is a, c, g, or t
  misc_feature (257)..(257): n is a, c, g, or t
  misc_feature (263)..(264): n is a, c, g, or t
  misc_feature (268)..(268): n is a, c, g, or t
  misc_feature (276)..(276): n is a, c, g, or t
  misc_feature (290)..(290): n is a, c, g, or t
  misc_feature (301)..(301): n is a, c, g, or t
  misc_feature (330)..(330): n is a, c, g, or t
  misc_feature (350)..(350): n is a, c, g, or t
  misc_feature (387)..(387): n is a, c, g, or t
  misc_feature (439)..(439): n is a, c, g, or t
  misc_feature (487)..(487): n is a, c, g, or t
  misc_feature (508)..(508): n is a, c, g, or t
  misc_feature (561)..(561): n is a, c, g, or t
  misc_feature (566)..(566): n is a, c, g, or t
  misc_feature (745)..(745): n is a, c, g, or t
  misc_feature (763)..(763): n is a, c, g, or t
  misc_feature (814)..(814): n is a, c, g, or t
  misc_feature (832)..(832): n is a, c, g, or t
  misc_feature (893)..(893): n is a, c, g, or t
ncctggctctccctggaactgcttccttgccatggaggactcacatgatctccgagggcctctggttttataagcntttttnntggccccttctacccctcagggattctaagggggggggggtgtgtgcttgggggggttgactgttaactgaatagggcnggggtgggacagagtagttcctggtctggtaangtggcagcnggggaagggggaggcagtggngggnngtctggnttttttttgttttttttggnccgggnntggnctcctggngggtggggccagcncagccccagtnacagtggcagctggggggcttcctatctncttggttgccgtctggccanaggtgtagataggtttccttctgttctgggtctcgcngggcacagcgcccgtggacatggcaccgctggtgactgaaggacatcgctgncctggtcacattgatcacataggggcccaaggtgtccaccaggttgtnatggagatgccagctctcctnctggggcaggtacctcccagatctccggtgtgtgaggtggacataggctaggncaggnaggggatgtcggtgcccaacaagggccacacggaaggcctcctccaggcgatgtcggacaaaggcctggtggtgggcaggtggcagcctgggtgggaggtagatgctggggaagagggcactggaggcggcccagagccaatgcagttgagtgttgcgggcaagggtggctgcatggcncgggccggtatagttggnagccatactatgccagccattgccacaggctggggtagtgatagaagcccngagtccatgggggccgtngtgcctggggccaccgcagcgtatcctccatcagtgcacgggccgcctgctcaagccagtnt

SEQ ID NO: 697982 - DNA, 136 bp, Homo sapiens
atctagtgtccgggcccggtctctggtctgaggctgtcgggtgtctggcatacggggaagcgggagttcggggaaggaggcagcgagcagcgcatcaggagctgtgtggggggatgatcagcgaacaaatgcacag

SEQ ID NO: 697983 - DNA, 173 bp, Homo sapiens
cagcattttttgggagctccaggacatcatcccctttggcaacaacccccccatccagccccctctttggttgaaccccccaagggacctggatttgggggccaagcaggcctttaatttatattgaactgtaaatatgtccctagagaaataaaatatgggcttcccattta

SEQ ID NO: 697984 - DNA, 189 bp, Homo sapiens
cctaattctatcatattcatggtattactgtaatgataggacatcttaacttcattctattcaatactcatgtaaaacgatgaaaggactgatatgtctcttatatcgaaaatcatcattcaatacttactatgatcagtatgatattatggttactctgtactgtacatattttaaaatgggagtaag

SEQ ID NO: 697985 - DNA, 124 bp, Homo sapiens
tgaacactccatatacttactaagtagactaaatacaaaatatatacactatactcattatacatacttcgtagtctaaagaaaggaggctactatatttataatttagtatataaagtagagt

SEQ ID NO: 697986 - DNA, 261 bp, Homo sapiens
  misc_feature (66)..(66): n is a, c, g, or t
  misc_feature (70)..(70): n is a, c, g, or t
  misc_feature (86)..(86): n is a, c, g, or t
  misc_feature (128)..(128): n is a, c, g, or t
  misc_feature (138)..(138): n is a, c, g, or t
  misc_feature (226)..(226): n is a, c, g, or t
ggaactctggctgccgaaatccgggcgctgcgggaggcctacattcgagacgggggccgggacccngttngctgggccagatatgnagtttgcaggtggaggcgtctgcactggagctgcagcggtcncagccgcagnagactaccaccctcatcatcagtatctttggtctgtgagctgcaggtctggcaggggctagcatgggctagggcaccacagccaaagntgtggggtctcacttggactatttgaccaagatca

SEQ ID NO: 697987 - DNA, 875 bp, Homo sapiens
tgagcgagcccgaggaggcggcggactctgtatcgggggcttaggcgcagaccgggctgagcgccgcctgcctgggcccggaggtcaccaccagcatgatacgggcaggtcgaataccggacggtcgctagcactgcagtgagacccagatggagtacctgagaactgcattggaggaaaacattcagacttctgccgccacattaccgtggatgttccactgacggggtatttcagttggtgtttgcaggacctgcaggcgaacatgtgtggagacccggggggaactggtgagcaggagagtctccttcaggcaccattgaaagactgttgcttgggcaaaggctgggagcgcactggggccctgggggaagaagaatgcacgcttccatggagagtcgtaggcgagcaagaacctggtaagtctcaatgagcttcaagccttgtcatgctgctgtggagaaacattggtgcctgtttatgaagagatgactgcttaggactgcctgctcctggtcgcattcggatacacacttgttgtatgtaggcagcagaagcaagctgccaccaatgccgaagtccttctttgcagaccaagagccttggactgtcagttgcctagtcgatgatgagataagcccagggctgacaggaaggtcaagtaccagagtcatcagaggtgggatcagggggtgttacatgaagactggggggagcaaagacggggttcccaaaaggcattcctgttgcctggtgcggatggtcgaaacgggacagtacaagcattagggggcccgtagaagtgtgccccggaggggtttggccccgaaaatgtgttgtttgtggagaggccccccttcgggtcctttcacacg

SEQ ID NO: 697988 - DNA, 439 bp, Homo sapiens
tactgccaggaaaacagagctgagcatgggtgtgggatgtctatgtgtgctgtatatctaaatcattttaatagactaagataggaagagacaacacatatgctgattgaaattatgtttggaattggacttgctattaagatcaaaataacacatgtaagcctcttcaactgtgttatacacagttctacatgttcggaactcatcaacggtgcaaatatttctatcttgaaccttgttttctctgatgattagtgcatttattagaagattaactactccttttaaaaaaaatctttaacaaaaattatctgacagcccaaggaattctcaagttccatttcagtgttcaggcaaaccaaattattatatttccagatttcctcttcttttgctgccattcacaatgaaggaggaaaaagcggactcctttgatgtg

SEQ ID NO: 697989 - DNA, 222 bp, Homo sapiens
ttgctctagaggatctcatgttatcgccaacacagtactaataattgagataatttctgtatacaaggtcttagtggttgtaactgtcttaaagagaccaattaaatgggaatggagtgtttctttggggaaaaggcgggaaaattgggttagattttaattatacagagcttgatacttagggaggaaagtagaagattctacttagtgaaactagaaaat

SEQ ID NO: 697990 - DNA, 246 bp, Homo sapiens
taacaaatgaagaagtgatttcgttttttaaaacaattctgtaggaaccagtctatcactgatgggcatttgggtggttccaagtctttgctattgtgaatagtgctgcaataaatatacatgtgcttgtgtctttatggtagaatgatttataatccttgggtatatacccagtaatgggattgctggaataaaaattattggattatggggggagaaaatacatacaaatggccaacagataga

SEQ ID NO: 697991 - DNA, 929 bp, Homo sapiens
cctccgccgctctgctacggtggagctgaatgcactgagctccgacctggggttgccagctttctctcccttgcgggggcgtcgaactcgcgcgtgcgcagcgcgtgagggaagggggccgggacctccttgctgacccgggcagggccaccggatagccggaggtgaatcgggatgagcttcccagcgctgcagctccactgagaaggaagcccaggcgcagagggtcgccggtcggccgcagtgcgtgaggccatggcattcctgaccgggcctcgtctcctggactgggctagctcgccgccgcacctgcagttcaataagttcgtattaaccggctaccggccggccagcagcggctcgggctgtctgcgcagccttttctacctacacaacgagctgggcaacatctacacacacgggctagccctgctgggcttcctggtgttggtgccaatgaccatgccctggagtcagctgggcaaggatggctggctaggaggttcacactgtgtggcttgcctggtgcccccctgcagcctctgtgctgtatcacctcttcatgtgccaccaaggaggcagtcctgtgtacacccggctccttgccttggatatgtgtggagtctgccttgtcgacacccttggagcctgcccatcatccactggactctggctgagaccgtggcttcgccagtgcctgatggtttcactgcctgtcaggtgtcccggtgagagtctcatgccctcacagtgccgtcggcttggtggaactggccccgtgtttgggctggtgggggcgggccaggtccgccgtcggcggcgttcgttgggcgtgatgtgccccccacggggggccccggccccgctgggggccccccggtggcggggcccacgcggggccacccgggggggcggccccgctcgctccc

SEQ ID NO: 697992 - DNA, 188 bp, Homo sapiens
attataaataaaatcttatttcactgatgtggagcctaacctgttttatttttttttggtttagtttagttggtttttataaaataaaatctcactccgtggcccaggttgaattgccgtggcaaattctcggctcaccgcaacctccacttgcggggtttaagcatttctccggccttagcttcccg

SEQ ID NO: 697993 - DNA, 570 bp, Homo sapiens
  misc_feature (78)..(78): n is a, c, g, or t
  misc_feature (384)..(384): n is a, c, g, or t
gcacgaggcaagatgaatctgagctctaatccctagagcatttaatatgttcttattattaaaagctcagatgcaaanaactctcttaacttttaatgttataaaaaaaatcaagtcttcattacattccccaatccacctcttgatggggctaataacctttccttaatgatagggtgtttctaaaaagatatatctggtcaaggtggcctgatactcctccttctccccacaacctcccaaacaaggaggaataactaccttttagtgatcatataccctaaatataaatatatttaaaataattttatacacatatatttaatgtcaatctatatatttaataacactaacacttctcttcattttcaatgaaaaatatanaatttataatattttcttcccacttccccatggatggtctaatcatacctctcattttacaaagtactgtttcttaaacattgaacaatatattcccaaccttgctaatttacaccaatcacctatagatactaattaaaacacaaattccactgtcacatacattactccatttaatcataatgg

SEQ ID NO: 697994 - DNA, 214 bp, Homo sapiens
gcggagaccccgctcatggcggccgacaccaggtggaggaggtccccgcgggcgggggtgggcagcttgagggagcggaaacagatgtcgtattttgcctcgttgccgatgcatgaggcctcatatcgtattctccaccagctggagcacagacagcgagtcgtgacatggctccaccaccgcgtctgacactttgtgcgagagcaccacgctg

SEQ ID NO: 697995 - DNA, 181 bp, Homo sapiens
aactttcaggaccagggccttcagaagagccactttggaaacaagtctggtttctccttgttttattctgtggtggtgtttggtttttccagacagggtttttctacagccctggctgtcctggaactccctctgtagaccatgctgacctcaaacgcacagggatctgcctgcctctgcc

SEQ ID NO: 697996 - DNA, 348 bp, Homo sapiens
gagtcggtcgtattgtgtgagcctgttggagtaccagtatactcgccctcgtagtctttgatcttagctattttctgtgtgaaatacgagtgtactgtagaggttcgtagactggtatagccctggcgatcagccttctcaatcatctctgtggagagggactatgtggtgtggtggcacacatctgaaatcccagctacttgggaggcttagacacgagaattgcttgaatgcaggaggtggaggttgcagtgagccgagatcgcgccattgcactccatcctgggcaacaagaacaaggctctgtctcaaaacacaacaaacgctgcacgctcggtgtggggcccc

SEQ ID NO: 697997 - DNA, 654 bp, Homo sapiens
atgggagctacaatccacgagaggcggcgccctccgccctccggtcttcagcccggccccgtggccccgcggcatttggccacgaatcttaacgcacagcctcctcccgggaagcgaccatgcccgcccgcccgccttggacggccggctctgcggcacaaaagcactggcagcgcgcgctgtccagcgggtcgcggtgtcccggtgcccagccttctctcagcaccaccctgcggggacggctgcgagcccgcgcgcgagagcctggcgccccaggcagccccgcccaacccagccgccgccacccgcgggacggggcccggggcgccaagcccctgcccaggtctcgcccacggcaggcccctcctgccaacaggaagcaggtccagagagccccccagaccatgcgatcctcgcacctagagcaccctaagggacacaacgcccaggatcggtgacaggaccgaaggagacacagcggaacgattcaaggggacaagcaagacatcacggcaaccatttatccgcaacatgtacggcagggcctggagaagagacgcgcactggacccagagggggacaacacatggaatacactatagaataccagcaggacaacacacggaaacaaagtgacagatccgcggagaggga

SEQ ID NO: 697998 - DNA, 139 bp, Homo sapiens
ctctgaggtattatcataattcctgtgatccacggagtgatagaagggagcatgacaagaaataagtgtgagcagttgtcatatggtgctgaagacatgctacttttcctgaggggggaagacagctgatgacggtggg

SEQ ID NO: 697999 - DNA, 998 bp, Homo sapiens
  misc_feature (812)..(812): n is a, c, g, or t
cacagtggctcacacttgtaatcccaacactctgggaggccgaggagggcaaactgtttgagcccaggaggttcgggacctacctgggcaacacagcaaaactgtctctatgcacaaacaaaaaaaaacccaattttttcaccgtgagaagttgtgcaacacagctttaaaattctcccattattcccagaaaaagctgaactggcctgaaacgcgtcggggtgcattattattcccgcgagcctttcacaagtatacgtatacgatacagatcactataccgggcggggcttcatggaaacgtcttccccatcatacatatattcgcccttcatagaacaagcgtccttctcccactaaacgagaacagtggtgcagggcgtgcaaaactgtctcaccattatgtgcactaactagagaaatttcaagcgctttacaaaagggcgcggagtatctccgtcattatctagccggggaagacaatcattcttcgttccacaacatctctacaagacggcactatactgttggacgccagcggattagcctacaacagtgaactatttgtttcacaaacattactcgccccgtacatgttagctagtttccaacacaacagacatttgagcgcgagcgcggaactggatgacaaagacacacttcgtgggtaacagaacacatcctcataacctttttgtcacgaacaacatgattatgttccccacgcacactgtagggccatcacattagaaacagctctctccactagcggcagtactcgccaccacacacagtaaggaagctgtcctccncatctttctgtcgaacaaaacgactcttctatcacacagagggggagttggcactagacggactgtgtaaagtaaggcatagacacgatctgtcacgcaacgcccgcaacaggtagactctcaactcactagttctttcatcatacaaggggggcgtggacatcacgtatccagtcagaccagacc

SEQ ID NO: 698000 - DNA, 177 bp, Homo sapiens
gactccccagacaacgggcggagcggctgggagaggctgcggagccgcggtcgccgacctcggaggcactggacgccgccactgtcggggcttcctcacagctgtacgtacggtcagcccgcgccgtctcgagaccttaatcccacagcttacacggtcctccggcctgagaacgcc

SEQ ID NO: 698001 - DNA, 689 bp, Homo sapiens
  misc_feature (212)..(212): n is a, c, g, or t
  misc_feature (231)..(231): n is a, c, g, or t
  misc_feature (470)..(470): n is a, c, g, or t
  misc_feature (473)..(473): n is a, c, g, or t
  misc_feature (520)..(520): n is a, c, g, or t
  misc_feature (550)..(550): n is a, c, g, or t
  misc_feature (666)..(666): n is a, c, g, or t
  misc_feature (673)..(673): n is a, c, g, or t
ggctccaaatgtccacttgcacattctacaaaaagagtgtttcaaagctgctcaatgaaaagtaaggttcaactctatgagatgaatgcacaaatcacaaagaagtctgtcagaatgcttctgtctaggttttatgtgaagatatttccttttccatgataggccccaaagcactccacaggtccagttgcagattctacaaaaagagtgtntcaaagctgctcaatcaanagaaacgttcatctctgtgacatgaatgcacacatcacaatgaaatttatcagaatgcttctgtctagtttttttgtgaaaatatttccttttccaccataggcctcaaagtgctccaaatgtccacttgtagattctacaaacagagtgtttaaaaactgctaaatgaaaagaaagattcaactctgtgagatgaatacacacatcaagaagaagtttgtcagaatgcttctgtctanttnttatatgatgatatgtccttttccacaataggccagaaagtgctccnaatgtccacttgcagattcaacaaaaagantgtttcaaagctgctcaatgttaaagaaaggttcaacactgtgagctgaatgcccacatctcaaagaagtttgtaagaatgcttctgtctagtttttatgtgaacatattcctttncccccantaggcctccaaaaggg

SEQ ID NO: 698002 - DNA, 218 bp, Homo sapiens
agaggatcccgtgctgcctgcgtatgcagaatgtcggtggtgtgcatcacttcaaccgaaaaactcggcaccagctcggctcgaataaggaggcttagagctgtgcttaggactccagcccatgcgccgaatagtaggtatagtgttccaatgtcttggtggtttgtagagaatagtcaacggtcggcgaacatcagcaacaaattagtcatgcagca

SEQ ID NO: 698003 - DNA, 1379 bp, Homo sapiens
gggcgctctggccaggaagctggaggacaaccccaagtccctgaagtctggagacgcggcatcgtggagattgtgcctgggaaagcccatgtgtgtggatgagcttctcccagtacccgcctctcgtgccgcttctgcctgtgcgcgacatgaggcagactggtggcctgtagtgcgtcatcaagaactgtggaatgacagaagagctggctgtgcgccggcaaggtcaccaatgtcggcgcagaagtgcgcagaattgctgggcaatgtgaagcgctgggcgccctgcgtagcggacctccccgtgggggggaggccgtaggcatcggaaaccccagggggcgcggggaacggagaacagggaggaagaggagagaaggagagagaggaggagagaggaaagaggagagagagagggaaggagcgagagaaggagaagagcggagaaagacgatagaagaaggagaaggaagaagagacgaaggaagagcaagacgaggaagaaagacagaaccgaaagaaacagagcgcgagctgggaagaagaaaggagagagagcaacaagcagaaagagaagacatgggagagagagggaggcaggggcgaggagcagcagaaggagcgagcaagacgaacagcagcaagagagggcgaagggagagagacaacgagaggaagcagagacgagaggcaggaagagagggaaggggaggagggggacggagaggaaggacagagaagacggaggaggacaaacgagagaggaagaagagaagaagagaagagacacgagaagagaaagcaacgcacggaaagagaaaagaggggacgagagaggagagaaggagagagagagagagagggaaaacaggagcagaaggaggacgaggagacgaacggagaaagacaaaggggagagaggggacgacgggacgaagaaggagacagcagaaaaaaaagaagaggggagcacgaaacacaagaaagacgaaggaacgagagggagagagcagaggcgcagaggggggcacaaagcagcgccaagagagggcgaaggacaagaaagagggcaggaaagacaagagaggacaggggaagaaacggaagggggggcaggaggagaagcgagggacaaaaagaggcgagaggggagaggagaagaggagaggaggacaagagcaggcagagagagaaagagaaagggagaggaaaagggcgcgaaccggagagaggaggacgagggggagagggacgagagaagagagagagagaagaaagggacgaaagaagagaggaggaaggggagagaagaggcgaggggagaaggagagagagaggaagggagggagagggagcgggcgaaggaggagaggagaaaa

SEQ ID NO: 698004 - DNA, 753 bp, Homo sapiens
  misc_feature (6)..(6): n is a, c, g, or t
  misc_feature (10)..(10): n is a, c, g, or t
  misc_feature (46)..(46): n is a, c, g, or t
  misc_feature (55)..(55): n is a, c, g, or t
  misc_feature (122)..(122): n is a, c, g, or t
  misc_feature (144)..(144): n is a, c, g, or t
  misc_feature (149)..(149): n is a, c, g, or t
  misc_feature (154)..(154): n is a, c, g, or t
  misc_feature (157)..(157): n is a, c, g, or t
  misc_feature (163)..(163): n is a, c, g, or t
  misc_feature (171)..(171): n is a, c, g, or t
  misc_feature (174)..(174): n is a, c, g, or t
  misc_feature (180)..(180): n is a, c, g, or t
  misc_feature (184)..(184): n is a, c, g, or t
  misc_feature (197)..(197): n is a, c, g, or t
  misc_feature (204)..(204): n is a, c, g, or t
  misc_feature (226)..(226): n is a, c, g, or t
  misc_feature (228)..(228): n is a, c, g, or t
  misc_feature (234)..(234): n is a, c, g, or t
  misc_feature (236)..(236): n is a, c, g, or t
  misc_feature (255)..(255): n is a, c, g, or t
  misc_feature (259)..(259): n is a, c, g, or t
  misc_feature (267)..(267): n is a, c, g, or t
  misc_feature (271)..(271): n is a, c, g, or t
  misc_feature (295)..(295): n is a, c, g, or t
  misc_feature (299)..(299): n is a, c, g, or t
  misc_feature (307)..(307): n is a, c, g, or t
  misc_feature (330)..(330): n is a, c, g, or t
  misc_feature (337)..(337): n is a, c, g, or t
  misc_feature (361)..(361): n is a, c, g, or t
  misc_feature (393)..(393): n is a, c, g, or t
  misc_feature (426)..(426): n is a, c, g, or t
  misc_feature (445)..(445): n is a, c, g, or t
  misc_feature (448)..(448): n is a, c, g, or t
  misc_feature (451)..(451): n is a, c, g, or t
  misc_feature (458)..(458): n is a, c, g, or t
  misc_feature (463)..(463): n is a, c, g, or t
  misc_feature (476)..(476): n is a, c, g, or t
  misc_feature (492)..(492): n is a, c, g, or t
  misc_feature (512)..(512): n is a, c, g, or t
  misc_feature (535)..(535): n is a, c, g, or t
  misc_feature (556)..(556): n is a, c, g, or t
  misc_feature (575)..(576): n is a, c, g, or t
  misc_feature (729)..(729): n is a, c, g, or t
tctttncccncatttaatttttattttgattttttttaatgctgcncaacacaanatttatttcatttgtttcttttatttcattttatttgtttgccgccgccgttttatttatttttacngaaagggagagggaacttttgnggccnttttnccnttttcngtaggccnccntaagcnttcnaaatttggaacanccaagcnagccgaagggaaaagggggttncncaaaancncccgggggaagggaaaggntgcnttgttaancatnccccatggggggggattaactgcntgtncaattacntttcacttttaattaattgtgcntaaggcnttaattaaatttggggggcccccncttaaagcagcccgtaccgacgaaggggcatnccccgaatgatgtcacggcagtcgttgaacacncggcggatgtccccagtgnccncancccaggngaaangagggtagcagtngtgacccccacccccnccggcagtgccgacccccanaaacccaccccgaatgaagtccntggcccgggtcacccgtgggncccccccgggcccgggagnngcacccccaggagtagtgtagcgagccaattctcggaaagtagtcctcaatcttcgatttcccagcaaggactttctcagcgagcagatcttgcttgttgaggaacaggatcacagagatggtgcgcccattctgttgttccagatgctcttnaagaggttcagagcctcctgcagg

SEQ ID NO: 698005 - DNA, 185 bp, Homo sapiens
gctcccccggtgtactgcaaaaacgggtgcttctacctgcgcatccacccctgtacggcctgagttgacgggctccgggagaagcagcgaccctcacatcaagctacaactacaagcataagagagcggagttgtgtctatcaaaggagtgtgtagctacccgttcaccgggctataaacggaag

SEQ ID NO: 698006 - DNA, 157 bp, Homo sapiens
gtaattgtaatggctagtaagcagcactgccagcaagcattcacaacaaaagacatgcagcagcaaaagcccagttagtggtgtgcaaacttccttcctttaaatgtcccatgcatgtaggacagtgccatgtttcaagatgcctgtgcagctcagg

SEQ ID NO: 698007 - DNA, 289 bp, Homo sapiens
ttcaacacatatgtgctgaccttaaggattcaaagaccgacatcattgctgccctgtgggagtttatttacccttacctactgcgatgtggaccatggatatagtaccacattgtgatgaacgtcatgaactaaagaaagcagctgggtgggcaccatggctcatgcctgtaacccctgcacttccagaggcggagagatggaaagatggctcctggtcacgagttcaagagcagcctgcgacacttagcgcgaccctgtctctactcactcaaaccaagagagaagaa

SEQ ID NO: 698008 - DNA, 1160 bp, Homo sapiens
tacagtaaacactgttacaaatcatcaggatcctcacgtcgatccttgtcaataaactctggtgcgccacgtcaggcgtacatgggacttcaatacactgctcacgctttttcgccttgctctctctattacgtctttttccccttgcagcggtgaaacctatggcgggagagtcccgccaacagtggctgttaggaaacatgcaagtgcgaccacctttcatgctaacatccagcgtgtttcatgtaactggggcctttggtctgtggctcccgggcccatctctccggaacctcacttcactctagataggacccattctgttccacaactgtacatggttctggttcacgtagataggtccttacactggtctggctttgaacccgacgtgactccgtaaccaaggctcgaagacagtctcaggagttgttctttctagtggctaaggattccttggccagactcataacggaacttggtggataccagcttactatagtagtagtgtggttccgagaaatcttcagttttaaatagaagtgtttcacgagtgcctttttttgcccccagtattgggttttcaatactctgttgtcatattacatattacagaacctttcaaacctgtattccgtgctttatactacaggaaaatgtcaccaagcaccctcctccccagttcacaaaaggaagaagatgaagattctgtctccctgctccccctccgccagttttccaaagtgtcttgagcatatgcctggctgtgcctcagatcatcaccatgccacagtccctgctccctacttcttggcagccaagaaaagccctttctacatgtctagaaggaaatacatccgagaaagttagcattggagtgttagaaactagcaggtagagcctctcgagccatccgagctgctgtgtcacgcccatcagcgtgctagggagtgacaagcccaagtcattcttgatgccaccccttctccacacccgcgagatcgccagggactcatcctgtgactttgtaaccacactcattcctttcaaacaacagaggaggaactattgcttcatcggactttattcaaatctagttatgtattggccgtaaattaatgttgtgcaaaatgtgaaatgtttttatttaaatatacgcc

SEQ ID NO: 698009 - DNA, 162 bp, Homo sapiens
cattgagccccttgatgccaggtgggatgtgttgatcacgcggcacttgagtgatgtccgtgaatgtaccgtgcacaacgtatctcgaaaggtcatccctggatgtgtgggacggggctgatgcagcggtaccgtccccacacaccatcccgcaggtctctt

SEQ ID NO: 698010 - DNA, 658 bp, Homo sapiens
tgcctggatgaggaccggcacagggaggaatgaggaagacaatcatgttggaagccatgatcaagaagaaagagttccagagggaggctgaacctgagggccagaagacaggggaagttcacgaccatgaagatgttgaaactgctaggaaacaaacgtgatgccaagagcaagtcccccatgagtacaagtagctaactagctacgagaagccaggttggcggactgccccctcctggtagcagacgtcctggcgctgtgcgtctgctttgacacggtgtggctgccgctgcatcccgctcacgtatcatgctcacggagcgcaaggatgactaaggtggagggatcctctgggtgatggcctcttcctcctcagggatcctctgcactgctctgtggcccacagaactctcttgtttcttctccgagccccaggcagcggtgattcagccctgcccaacctgattctgatgactgcggatgctgtgaccggagccaggggcgaatagggtcccagggtccagggaggggcgcctgctgagcacttcctggccctcatcctgtccagccctgccgatgagctctgggcttgggtctcctgctccagggttctgctcttcccaggcaggccagccatgttggcgctgggccacactgg

SEQ ID NO: 698011 - DNA, 208 bp, Homo sapiens
ctcccttatatgtgtaaagctaaatataataattcagttaaaataaaagtgggtgacaggaaaaaattagaaatgttgaaaatttttttaccttcactcgctacataaaaacgttggaggagactccttcatggtcttaatctctttggatctcttgggaacaatgaagctcttctgatatttttcaaatccaaatagaacataacaa

SEQ ID NO: 698012 - DNA, 818 bp, Homo sapiens
  misc_feature (538)..(538): n is a, c, g, or t
  misc_feature (544)..(544): n is a, c, g, or t
  misc_feature (553)..(553): n is a, c, g, or t
  misc_feature (577)..(577): n is a, c, g, or t
agcgggcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatnccaaanttgaatctntggccagagaggtttgcaaatctnctatacagagattaagaatgtgctgatgaaccggtgggacaaggttacatggtttcctgcttgatggatcaccgatggcaacaatcactgcagtatcagatgtcaccagtacattaccaagatgacgggcatcattttaagtgatttaccgattaaaatactggaggtctcatggatgagacgggacaagatggaactcaacattcttgaaatgtgcaagacatcaggcttgggcacaaaa

SEQ ID NO: 698013 - DNA, 369 bp, Homo sapiens
  misc_feature (39)..(39): n is a, c, g, or t
  misc_feature (99)..(99): n is a, c, g, or t
  misc_feature (233)..(233): n is a, c, g, or t
  misc_feature (340)..(340): n is a, c, g, or t
  misc_feature (359)..(359): n is a, c, g, or t
tattaattgaaaaggtcagggtacccacttcccaatgantgtagggaagcaagcagtagtggtgtttagaatatcaaggttagctgctggatgcgggtntcacgcctgtaatcccagcacctctgggaggctgaggtggacggatcacgaggtcaggagatcgagacaatccctggctaacacagtgaaaccctgtctctgctataaaatacaaaaaatcagctgggtgttgnacgcatgcgcctgtagtcccacctgctagggaggctgaggcatgagaatcacttgaacttgggaggcagaggttgcagtgagctgagatcacgtcactgcactctancctgggagacagaaacganctccgtctca

SEQ ID NO: 698014 - DNA, 103 bp, Homo sapiens
agggggaattttttaattttgaaaaaattttttttgtaatgggcaaaattttttttaatgtataatgtataccttgtaataaaaacaaatttccccaattccc

SEQ ID NO: 698015 - DNA, 167 bp, Homo sapiens
atctctgtgaagcgtgtgcgggggaccgcagacatcagagctctcctgtaaatcacctccgcaaaggctctttgtggtcgattcactgatgactcatttataatctggtttcaacattgtgagtcaaaatgcaccactttcattaaaaataacattcactggggtct

SEQ ID NO: 698016 - DNA, 356 bp, Homo sapiens
ccagaggattcgaattcgaaagttgtgcaaactggtaaacgtctgcttcggagcttgctgcttaataaatgtggtggaatgaatgaatgaatagatgctgtggtttgattatttctgttcttatttttttaagacggagtctcgctctagtggcccaggctggagtgcagtggcatgatctcagctcactgcaacctccgccacccgggtccaagctgttctcctgcctcagcctcctgagtagctgggatcaccaggcatctgccatcatgcctggctaattttggtaattttagtagagacggtatttcaccatgttggccaggctggtctcgaactcctgacctcaggtgatc

SEQ ID NO: 698017 - DNA, 134 bp, Homo sapiens
tgagtatcatagggcagctaacaacatgggccagctggttgttcagttccagagcacagggcagcagcagggcctccaaggatggaaaccaagctctttctgtaacttattcttagagtgggagccccatcaca

SEQ ID NO: 698018 - DNA, 201 bp, Homo sapiens
aaaaatgttaacggggagttggtgccagtccttaaaatctcctggacatcggccaggtgcggtggctcaagcctgtactcacagcacttggggaggctgaggcaggagaatcgcatgaacccaggaggcaggcggtggttgcagtgagccaggatcatgccactgtactccagcctgggcaatagagcgagactctgtctc

SEQ ID NO: 698019 - DNA, 261 bp, Homo sapiens
  misc_feature (52)..(52): n is a, c, g, or t
  misc_feature (66)..(67): n is a, c, g, or t
  misc_feature (84)..(84): n is a, c, g, or t
  misc_feature (105)..(105): n is a, c, g, or t
  misc_feature (117)..(118): n is a, c, g, or t
  misc_feature (143)..(143): n is a, c, g, or t
  misc_feature (158)..(158): n is a, c, g, or t
  misc_feature (168)..(168): n is a, c, g, or t
  misc_feature (171)..(171): n is a, c, g, or t
  misc_feature (173)..(173): n is a, c, g, or t
  misc_feature (190)..(190): n is a, c, g, or t
  misc_feature (204)..(204): n is a, c, g, or t
  misc_feature (216)..(216): n is a, c, g, or t
  misc_feature (229)..(229): n is a, c, g, or t
  misc_feature (235)..(235): n is a, c, g, or t
  misc_feature (252)..(252): n is a, c, g, or t
ggagagagagagagagagagagagagagagagagagagagagagagagaganatagagatctcgtnncgggattataggcgtgnagcacccgcgccccgtctctnatttcttaattnntagacattgcgtactctccggaganggtccctgagaaccnggctgatctnccncnctgcacccctcacgcgnatcctgttagctcncaaactgtcaancctgagcgaaacncagagncaggctctccaggacanagtgatata

SEQ ID NO: 698020 - DNA, 145 bp, Homo sapiens
gtcttgggggactcctgagctcaccttgttaggattgaggattctgtaagagctcggtgataggagggccaccccgcagcctggaacctgttgttcccacctggggggccctccaggcctccagcctgggaggaccttcttaacc

SEQ ID NO: 698021 - DNA, 208 bp, Homo sapiens
  misc_feature (168)..(168): n is a, c, g, or t
agccatatgagttgcttctgagtgctgcttggttagagaagtggcaggaggagctgaggcgctgttgctgggggggtgaagttggctttgcatgcgcagcgatgcgcctccctgtggatggcatcaccctggaaccggagtgcccttgctcactgtgttctgcatggnttggatctgaattaattgtcctttcttctaaatcccaacc

SEQ ID NO: 698022 - DNA, 523 bp, Homo sapiens
  misc_feature (17)..(17): n is a, c, g, or t
atgccattagctgtgcnttctgtgtgtcctcacctgactgccaaagcccaccctgtagttaaaagcatcctgtacgttggactgctagccactcctaactggtgcccacctcaggttcttcagtccacggcctaaaacccacatctggctctcttcatcctgtgccggatggacctgcctggcctctcatggcatatgggataaagccgacactctgttgtctggtatgggaggccctgtagctcggcccagcccaaccttccagccctgcctccagccacttagcccatttccctgaactgcatcccgtgacctcatgcactgaagccacacagcaggcactttcccatctctgttctttgactggacgcacttgttccttccagctgcagtcatatctactgtacttatgtacggtaccacccgcaactgggccaggaactgtgagagcccatggatttttttttttttttttctttttgagaccctgtctcaaaaaaaaataaaataacataaggccctt

SEQ ID NO: 698023 - DNA, 603 bp, Homo sapiens
agcgggagggcgggagggctggccaggtctcgggttgcgcgctgggcctggagggagggggcggccccgaacttggactactagcggccgagtgtattgctgagccgcgctgcacggaagcgaccacactgtgggaagtgcgctacaagggtcggacctgaccaggaaactccgttcagcaggtccggtggcggtcatggctacgcggtgcccaccgactcgtccctcagaatgacgctgaaagtcatggctgagggtgcgcctgtcgcaagatcatagcatgactctttctcctgcgaacggatggcttgggctggtgcgcctgcgtgggctcgtcggagtgatgtgtcggtagtcgctggtggagcagcttcgcgggatttggacctttggggaagtgggctggaggactgctttcagaggctgcatgttggggtgattcgagaagaggagaaggaagaaactgttgagaaaaagcattgagccagatgaacggaccaaaataaggactagttggtaaggtaggtataggtgtattggtgaagaaaatttgcacaaatggaaattggagcaaaaggagaaattccaaagaacattcgtcca

SEQ ID NO: 698024 - DNA, 144 bp, Homo sapiens
gttttttccccctttttttccccatcccccaaaaaaaggctaccccccccgccggggggcccgcttagccccctaaagcccccccgtaaatgggggcccccttttttttcccccccggcctaataaaattttggttggccctca

SEQ ID NO: 698025 - DNA, 310 bp, Homo sapiens
ctcatcactgcctccctcctcacctcttctgggctcctgcagggctcaccttgcaaaggaaccgctggtcttgccaagtctgagggccggtcgtgcaggtgcagaacagctgtggggaagattcaggctgtgagagcagctaagttcatgtgtgtctgggctctctcggccttagcaggcatgagctctccgggacttcagtactatggatttaggctttggaagcggggttttttctttgcatagaatgattcctgtggttggatcctcttgtttccagtctaaactctcgctctggaagagcttgagg

SEQ ID NO: 698026 - DNA, 1596 bp, Homo sapiens
ggggtctcattgaactcgcctgcagctcttgaggatatattttgatggcattccttcgattacttggagccaggcctacaccccagcaaccaatgatccaagggaccatgcaagattggtacttgactcttggacaccacacatacctcattgatagtagaggtagtaatatcccaagccactggcacaacagtcgcagcatcaatttgcccaattgcatccagggcacaacctgcacacccactccccaaagcgtcattgatcgccctttcaccggcacaaatagaaacaggatatgacatacggatagcatagacacgcacaacagccaatcacaagtttggccaaattggcacacccccccacacgcacacacacaaggtaataatagagattgcaccaaaactgtactgggcatttgggcacagcccagacatatttggcatagcaatatggcattatgtatggatcacaacaagatccgttggcattccatcgcaacacacgccattttggtagcgcccgtcatctcaattcgggctcggggtctggcaaaattggcattacgcattaagggacgcgagatgacagccgaaacaaggggatccccgcaaaagcgaatcaaagcaagtattcaaaacaaagggcggcaagccctaggcacacccaacagacaccacggcctataccgtttcaatcacccaaaggacaagtcggacaggcggttgggtacattttcccatacaatttagggggtgttccttgcgggcacctcataagaacggccattgcgcacaacaggcgggccgacaacatgttcttgtgcacataagcaatcagacaccctatacaccacccttaatggacagggcatacagtgcacaatattagtgtgattcaacaccccaacagaattggatcaatggcaactgagtgtaatccaccacccaacgactggtgtacgacccacactagtgatcattttattaatgctagtatgcctatacaacgcactttgtgcacagcctgttaccattataacacagaggcctgcatatctacagtagaatgagtcattatacactcctcagtacagcacagtaacatatctggccgaatgtgagcgatacaaaccaaagttagacatttgtgtgacatgtggagtgactacacatactcaagcaagaaggttgacatatcacatgtagtcaagccaaagcaattcataagcttttagatcaattggtcaagggccaccaatcaccatatggagccacatgactaatgagcacacattagcacttggcgcatcatacacacaacgggagcgactagttagacgacacagcaccaagcacaaacaaggaggaatcaagagaaacacaacacacacaccaagcaaaacacacaggcagattgcacgctacaaacacatatagtgcggcacccacaagagggagaagagagtagcgcaaccccaactaattagcacataggtagcaacacaaaaacacaccagaccaagccaaacatagcaacgagcaccacatagtaagcaacacgcacactcacacaagcccaccacagactaatacc

SEQ ID NO: 698027 - DNA, 137 bp, Homo sapiens
ttcatttacgcaatcatgactgaagaaaaatcaatcagatgtatcttcaaaaatgtgtagtcccagtttttatgaactcagagtatattaaccaatatattctataaactgatcatagaacgaagaatccacgtaat

SEQ ID NO: 698028 - DNA, 948 bp, Homo sapiens
ggaaaccgagtcccagaactccggacgtgtgcggcgcagtgagtcgcagcatgtcctggttaactcgttgttgaagggcgccgggcgggcgcgggggcgagtgcggggccctgggtgggggccttgggttcactggttgcttggatgcgtgctgactcagcgggccgcggtgcgcagggtgtgtgggggcgagcgtcgggcagaacgtgtggcgattgatttggtgaggaggccgtgtggacaggtgggaatgggaccagtgctgcatccctagggcgggcggtctatcaggcggcccattgctgtgggggcggggtggtcgtaatgtccgggtagtgccctcgggcccccgtattgcttggtgattgcattccccgacgattttggagcgccctaccgtataagtaggcggacgtaccggtgcgtccccgggggcgacttctggggccccagtgtggtgtggtcgcgtccttgggggcggttcagggcgcagaatagacctgttcggtgaaccgttccttccaatcgggtcgtcgccccggcacacccctggggtgtgtgaggccatcgtggagggttggcagggcatgggacgccttgtgttgccatcattggtgggctccgatgattgaagtaggcagacgaccaatgaggcagtcgtgggatttgggaggactcccagggtcctcgtgtgggagaagccgggtccacagttgggtgggtcgcgcctgtgatgacgaaacatcgttcaggacagcttggctctgacaggggaccaatttcgcggtgagtggaactcccaggagtgctttgtgaagagagaaaggttcccctggatagagcgtcctaacagtagatccagggaaccaattgaagtggaactggtttggaacccaccaggggtggcaagcgacgccatgcgggtaattggaccgggcggcaactggc

SEQ ID NO: 698029 - DNA, 1122 bp, Homo sapiens
gggctgggcagtgtcccctcccacgctcctgccgctgtctcccagctgtccccagtgtgcgcggacaccatggcgtccagcgacgaggacggcaccaacggcggcgcctcggaggccggcgaggaccgggaggctcccggcaagcggaggcgcctggcggttcttggccaccgcatggctcaccttctacgacatcgccatgaccgacggggtgcgttggttctagctattgccatggtacgttctccatatggcaaaacacggaacacacagaggttctatatacaaagtattcagcaagacacttcacctgtgtccacgacacttcgccttgcttgcgcatagttcactgtttaatcggaattgtacctacttctgtgattgtgcactggggtccaagtgagtccacgactcttcatggtgtggctcattacgtcacagtactcacaacccaatccagaactgacgaggagtgtgcgccgcctacgctcctgcgtcgcgatggcacctgtgaacagcagattcaactcggccagcgcccgttctaacagcattccagagccctccttcggaacccaccttctggcccactaaacgtctcattacacacactgtgcccagcagttcctaacccaacaccaaactcatctcatacatactaccctgctcggcgcaactcaccatcggtgaacacatttcctctaccacactacatagccgcctgtccctatcgcccccgcaacacgttcgaccgcaacacacgccacgggcacactaggttccgcccaacttactccgacccgtttcgccgtagcgccccccagcactaccacaacaactgaatccctcaccattcttccacgacccgtctacccctacttcatacactcaccactatcccttcaacctacaaaccaccagtatgcgcaccacttcacacctaattcactaaccgccccatcacgtcatatcctcccacccgaaccacctctcactacattattctgacgagctacaaccatgtatacacacgataccaacacccacacgaaaaacaagggcatcccacctcctaccttcatccaaccacaacgcctatgcaacaaggctcatcaagacgaa

SEQ ID NO: 698030 - DNA, 192 bp, Homo sapiens
acccgatcgcttattagacccaggctgaggcggccggagtcagtatggtcaggagatcgaaaccatcctggctaacatggtgaaaccccgtctctactgaaaattcagaggattggctgggtgtggtggcgggtgcctgtagtcccagctgctcgggaggctgaggcgggagaatggcgtgaaccccggagg

SEQ ID NO: 698031 - DNA, 385 bp, Homo sapiens
ataatctatgtatcacttcatatgaatcttggttcttacttttcatctatctcattttatcttttcttcgtatcctatggtctctcctcctcaccaccaccaagtctgttcctgcatggtggtaaaggagagagatctagcagccacttctgcagcaaggccagcagtgaaggtaaaatctggtgacagctgtagccgagccagcctctgcttaatggagggctgtaatgagtccctgggagtaggaggggccgtggtcagaccacttccatctgcttgtggttcatcttcactctcacattggtaacacattctttcttctgctccttgggggaagacttcatttgaagaattatctttatttttaccttctagagagttttca

SEQ ID NO: 698032 - DNA, 343 bp, Homo sapiens
gttaaagctacccgctacaggacaaatttacacatataataaacgttcagctttagccgtagaaatatcacactacctctaaatggtcctccatagtttcttccgttctaatatatgtactatccgtgagtatctagaagaaattattccaaattgatcatagtttcccttaagccatacaacatttggctcgagtccagaactcttcactatttgtcagaatttgctaagcattcagcattgcaattctaaaatatatattgaagtcaagggggatatgtctacatgcggaggaggaaatatctgcgtctcaaggagccattccatttgatgacacatgctg

SEQ ID NO: 698033 - DNA, 313 bp, Homo sapiens
gatttctctactggcgaaacctcgtatccgggcccaacctcaaaaacatcccacccaaagaactgggaatagaagctccaagggaaagaaaaacgtcttggctagggagaaactatacaatgctggacaggacaggtttgaaatataatgatagaagggggtgatcttaaccgggaaactggacataccatcttgccttatacatgcgtcttctgaacaacacttgtcctatcagaacatcacctacctctaacggaacggcttacatacctggatagggggcctagccccaaaaggggcaatcaaatccggg

SEQ ID NO: 698034 - DNA, 794 bp, Homo sapiens
agatgatttctgtgatcttgtgtgtataatggtgggccactggcgccctcagtgatgggtgccattgatgctgtgcgacgatcacagaaaggatccttcctggtacgcccatttggtggctcatgcttgcgtgcttccctccgaaatgaaggagtgaggacatggcagagcgaggactgtgtacgtgcgctgtctgttcttacgaatgcctcgtctaatgcagcttccatgcatgtgctaagtcccttccagtctgctgcttcctctgatggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcaagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgttaacagtgtgctgcagttcctggcttctgtggtgtcctctgaacagctgtgtgacctgtcctggctgtccctgagtttgctgggcgggggcccggttgttctcactggctggattgcccaagcctggctggttaaccgtggcccggttccattccgatgggctccccttggggccctgtgtcctg

SEQ ID NO: 698035 - DNA, 907 bp, Homo sapiens
gtaaggtgtaccgaagtctatgacatcggagatggctttatatattcccgcacttgtgcctccggtggaactgtctgctcaatggtgcgcccttctaagtgatagaccgttctgttgcgaatccttgctgctcccctaagttacggcccctcctgtaagtaccaggcccaagcgcgttccaagatgttttgggcgtttgacccaccgtctatagactggcggaataataaacttttgtgggcaccagcactaaatcacttgcaaccagggaatcttttttatgggaaatatggcaccacatcgagccgtctactcataattacaccacctttggaccgccttttcacttttaccaccgtaattctaactttctttaaagagaaagaatctaagcttcccaacccgccattataaaaagtatcacttgccaccttgactttggaaataattgtaacacggaacgtctgtaaaaccaaggtcacacaaccaccctttaatggtgcccccgggggtaaaacaagaccccccaacaaaatgaaggttgcacgaccactctccccatttaaacacttgttgtccaccaccctctagcaagaattcaccaccgggatgccgtgtgcgcaaaatttcaaggtgagcatgttccgcctccgaaaagtatgataaaggctgctagcttcgagtgccggtaatcttgacttgcgggggctgcaggcaccccgaagatctcacccggcgaggcttgttcaacgtgtagctgagattttatgagtaccgtggcttattatttctttcaaggagaagcattaacatctctgcttttttatacggcggacatcctctgataccaagacttttctccagagaacccctataagaaaaaccggcaacacctcacaaaaataac

SEQ ID NO: 698036 - DNA, 179 bp, Homo sapiens
tttggtactgctgaggggtcatctttaatacagatcaggagcaggaggtcactgtcacttcaggagatattgcgaggcggttgttgaaaggtcatggtgtgacacatcagactctgcagcgatcaatagtgtcttgcgtgagtcttggatgagtagctcatcaatgtagtggatcaccc

SEQ ID NO: 698037 - DNA, 1313 bp, Homo sapiens
tcgaaccacgctgtcggtagagcttgattgctctttgacttttcgcactctaggccacgaatgccgcagtatcagaactgggaggagttcaagcgcgctgccgagaagctttacctcgctgagcctatgaaggcacgtgtggttctcagaatataggcatactgatgggaacgtgtgtgtgtgtaatagtaacagatgatttagtttgttaggtgtatagaacagaccacgctcaagatgtcatccgaagatcgcgaaattccacaggtcaactgaagtgcgacgttatggtagccaaggagagcccgcaatgtgaccatggaaactgagtgactggtgtgaaatgaagcactttagtccgtagtcacttcaggcatagtcacacatcatctatttgcacattcagcagcacacagtgtacaggagcaccagcacacagtcactctgtcagtgtcacactcatcagtggtggctgtctccagcacagctcttagcagggtccatttaggtaggtgaattttttactatgtattcacattgcactgtgtcagaagcaggcttaggggcatagcacaattgttggttcacagtttagcactaggactttgtcattatcactgtgtgggggcaaaatgtggaaccaaagaagatggcgatcctagtacttggagaacaagctggggaggactatatttggggaatgttgagggtaaaaacaatggtcaatagtaagcctcgtgggcaaaaattggtcattcaagtaacatttgcacacatgaggatacttagggaagaaggtcaaattgcttacttgaaaattttaggttccatcgttgcttttaaacacagaacccatcacacttgtcccccattaaggcccggatccactggtaatttagggaaggcatacacacggtacgtgctggcagtgacacaagtgaaatattaacaagactgggtacaattgggacaattaacggcagaaccaaacaactgcaataggtgaaacagatacgggggactcactaccaatgtagtacgaagctgtagatctaaaaaaaccgaaaggcatgggacaaaccaggaaagcagagcataatcagaataacacgcaaacgggaagaaaagaggagagcacataaaagtgcacgcaacgagataaatagaccagggcaaaaaacgataaaagaataccaaagaaagggatcagagaacgaccagtcagcatacacaagctgaacgagcgagaggcaaacgaaaagaagagaacgagacaacatcaagaatgtgcctccttccgcacttcacgtcga

SEQ ID NO: 698038 - DNA, 190 bp, Homo sapiens
cttctgcttctcagactctattccgacaccctttcaaatggaaggaatacgcaacagaaatgcaactctagtagctgctccgtcatctccgcgtgctgctcattcgaagtcgtggcttggagacccgatgcggttccgtcacgaaggtaatgttcagcctaacaacccctgggttgtactgatcatcctt

SEQ ID NO: 698039 - DNA, 121 bp, Homo sapiens
accgggaagatcaccatattagatgacgaactaaaaagacgagacaaccgatcggaatagcgcactacagcccagaaactcctggactacaagacgatccatccagacctacagcctcccg

SEQ ID NO: 698040 - DNA, 313 bp, Homo sapiens
gtcgaccctcatatgcatatgaggattctgctttctatgtcacatagttttctcctgcacctagttttcatagcaattttaaatggctggatgacattcaatgttattgacaaatcacatttcacaaactatttcatttacaccatttaaaagatgttcaaggttaaaaaacatttcccattattcttaacggtttccaaatattgaaaacctgtctataacttcaaccttctcagaagtatattttaaatttcgttgtaatattgacttgttcttacaaaagaggaggaaaccactagtcatgtcgtcgacg

SEQ ID NO: 698041 - DNA, 104 bp, Homo sapiens
gtcgtgcttctgtctgcttctgcttcctgcttctgcttccgtgcttctgccgcttcctgcttctgctgcttcctgcttctgctgcttcctgcttctgcccctcc

SEQ ID NO: 698042 - DNA, 115 bp, Homo sapiens
tggacctttccaaagcggagatgctggctctccgcttacaaacttaactatagggttagggccccaggttctgggttgacaaatattaagacgttggcagcatctccgcttggaa

SEQ ID NO: 698043 - DNA, 289 bp, Homo sapiens
aaaagggggggggggggggggggggggggggtttttataaaaaaccctttttttttaacccgccggttcgcgggggggcccccccccctgtttttttccccccaaaaaaaaaccgggggggatcccccccccgggttttttatttggggcggggggggagaaatatttttccccaaaaaaaaattttcccctttggccttttttgggggcccaaaaaaaaaatttttttcaaaaaaaaaggggggggcggggggggattttccggggattttttccccccccgggccca

SEQ ID NO: 698044 - DNA, 784 bp, Homo sapiens
cagctaacaggtatggacacggggactgttattcgcaagctggttttccctgctgtagggatgagcggtatagtcattactccccacaccatcatttctaatttagcctgacgtcatcgctcttggctcgttccttgctctgatctcatctcctcctgctatggtcgcagacagaaaaagtagaatcgaattcactaacgcgacacgttgggtacaggtagagatgtacatatcgtagttgtagtagatagcaacattatgtcttgcacgtgcgtgttgacgttgacgttgcagttacaatcaagaactgacattaacatcatgacattgtatagttacgttacatttaaaaccaaaaaacacagcatgcaacgcggcacgtgcaaatttgctacgggtcgtggcgggtcgcggaactgacagtcggtaccgtcgagaattggagacagcgataggcattgagatcacgatctgggtcttgatttggacaatcgcaagcgatatgtatgtttcgtgatttagaaaagggagtgaaggagaggaaatgtgaggccaaggggcaggtagcactacacatagatgagggaagggtacaggagatattgaaccaattatagacataatagagaagtacaaggaggctataggaccagaggcctttaatattttgatatttggcatcgcttcaagagtacacggatattatatgcagattttaatagcatagtttgtattcggtatattatcaagtatatatgatatattgtagtgattctcatatggg

SEQ ID NO: 698045 - DNA, 240 bp, Homo sapiens
  misc_feature (230)..(230): n is a, c, g, or t
gatcacctttattacgtactgagggggcgatccttgaagtcctgatatggagctctgcgcctgtagaggtacgcccagcatggcatgaatggcggacttccataggggcctttcctggcttgttcttttctgggagaaacctgagccgactgccaccttcctcgggtgtgttctgggtaaagtcttgaggccagaaagatcttgcatccctcaagcactcttgagctggngctgaaccag

SEQ ID NO: 698046 - DNA, 375 bp, Homo sapiens
aactgggtagagccacacaggtcagcaagacctactgcctctgtagactccacctctgtgggcagggcatagctgaataaaaggcagcagacagcttctacagacttaaattgtccctgtctaacagcactgaagacaggggtggtactcccagcacggtgtttgagctctgagaaaggacagactgtctcctcaagtgggtccctgacccccatgtagcctaactgggatacacctcccagtaggggccaacagacacctcatattaggcggtctatatggcgatgaagttaccaggggaatgatcaagcaggaatatttgctctacctgaatattcgctgttctccagcctccgaggataaaacccaagaaaa

SEQ ID NO: 698047 - DNA, 585 bp, Homo sapiens
gaattattataggagtaaaattagctcgactttttagctgcattctaacattttgtgaaattgttcttcaatttcaataattttgttagcatatgtattttcagtaatagtaatcataatgcgaattcaaactatattgtgatgcaatttaaaaaaatatagatagctgattctgtagattaaatcaaaccagtagagtaattttcattcgggtcagggaattcctagaatgaaatattcaaagttggtggggtaatatgtatagaacaagtttcgtcacatcactgtagatgtatatatgtatgtcctttgttgactgctgagttcttggcctgctattaagaatcttcgacctctttcggtagattgttgtttaacaagctgtgttgaagggatcacagagtatcaagagtggtatgtcagctaatgagattcttgtatgcactccgtttcggagtaaatgccaagtatacttacatctattcgcatcgcgcctggcggtcatagacaataggtctgaggttcaggatggacatagttatcatgaagccggccgatgtgccggtggactttgttgcatgcctt

SEQ ID NO: 698048 - DNA, 318 bp, Homo sapiens
gctccagccgaaggggtgggaggtgttgcttaaaaagaacaaacaggccaggcgcagtggctcacacctgtaatcccagcactttgtggagtgcctgaggctgtggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggtttgcagtgagccactgcactccagcctgggcaacagagcgagactccgtctc

SEQ ID NO: 698049 - DNA, 1740 bp, Homo sapiens
  misc_feature (629)..(629): n is a, c, g, or t
  misc_feature (1740)..(1740): n is a, c, g, or t
taaatttttaattcccttttaaaatttataaaaatttttttaaaaacccacaaaaaagacttatccaattctctctcttttttctctcttttttttagtgtgtgtgtgtctcaaaaaaccacctcttaaagaatatatctctcttgtggtgaaacctcctttataacgcgcggtggtgtgtccactctctctcaagcacacttatggcaaaactctattttcacacaagtagtgtgcacacaaagtagaaaaaatactttaccacctctcttgtgagggtgaggcgcgccttaatatatctctttatctctgtgagaaatctctctgtgtggcgcggagagcgcacgagggttctcaaagagagagcacagtagtgatctctcacacccacgacaaaaaaatttgtagagagagggtgtgctctcttattctctcttatatagagagagtgtgtctctctttatggtctcttatactctctcccacaaaaagcagagtgtgtgtgtctttacacaaatatatctctcttatactcatagagagagagagaggtgtgcgtccacacaagagtgtcgtgtccccacactctatcatcacagaagagtgtgacacacagcagtgtgtctctnttttctctctacactctgctgtgtcacagcgctgtgtgtataccaccgcgtgtgtataaaatcgtgtgtgtcgtctatatatgagagagagaagagtgtgtctctctcacagagagtgtgggtctctctcacaaccactcatgtgtgtctctctcaaaaactatcctagaagagagcagcgcgggggtcataagatgtcctctcgacgagcgcgggccataatataaagcgcggggggggcacggcggaagaaaaaaaaaaaaaacacccccccgcagagacaatatctttttttgccgcgggggggggtgcaccaccacccggggagaaatcatctcatcgaagcaaaagggtggtttgttccaccccccgcgcttgtgggacgagagattgcttgtgttaattaacaccatgtcccacgagaggagagcgccctctttaacaatttttgttccaccccccccacccccaacaaaataaaggcggggtgaaacactctctattacaagcggaaaagcagcaggcacaacaatctctcggtttgtgtggtcgcccccccacctaagaagagaggcggctctttcaataatgactgatgcaagcggggagggaggggggagcaagccaccaacttcttcccttcgttctatcaaccccaacatcttttgttggtgtctcctcatcattatgatggagagggagggaagtcatatatttgccgcctcggcgatgtgtgtgtgtgcacccaccaaggcggtctttattctctccccccgcaaagaaagacgaaaaagaaacacacaacaaacatacacagagaacaacacacaaagaagcaaaacaaacaacaaaacaacaagaatcggcaccagcaaacacaaatatgaaaaacaaagagagacgcggcgcgccgatcataatcaacacaagcggaggagcgagaaagacacaccgccactatacagaaacggcccgcaatgagagtgaataactatgagcgcggatgctcaaaccaaaaggcaagagatcatggtgcactgacagacacaatcgtgagacggcacccacacaccccgcaattatgctcagctatcggacgacacaaacacgn

SEQ ID NO: 698050 - DNA, 339 bp, Homo sapiens
aggatttgggggttttgtttggttcccaaaaggggggggttttgtttttgttccccttgggtaaaggttgggcccttccccttggtttttccaaggagaccaaaaattttaaagggcccaccagggctaagggggtaaaggggcagcttgtttaaaggggattttggggaacttccctgggggggggaatcgaattggggattccccggggggggggggggccactccccctggccctttcccccggggtggggcccaatggttttcccttttaaaaagggggtggggaagggtttttccaaaagaaagaatttcccttttttaaaaaaaaaaggttta

SEQ ID NO: 698051 - DNA, 110 bp, Homo sapiens
actctagagtgatcccgctagatattaagaattttgaaatggatcatttctacttgcttgtgctattttaaccaactaatctgatgaatatagaaaaaaatgatccaaga

SEQ ID NO: 698052 - DNA, 211 bp, Homo sapiens
ttaaatgttcttgccacacacaaaaaatggtaagtatgccaggtgatgactatgttaattagtttgatagtggtgattattaaacaatgtatacatataccaaaacatcacctttatactgtaaatatatatgtttttattgtcaagtatacctcaataaagctggaaaaacatttaattcaaaaataagataaacatgaaaccctaaaaa

SEQ ID NO: 698053 - DNA, 718 bp, Homo sapiens
aattctcttctctctctctctctctctctctctctctctctctctctctctctctctctcggcagtgtggggggaagaggaagaggaattctttccccgtcatacatttacgagagacacaacttcactccatgtctcttcccttctccaaggcgcttccgaagctgctcccggctgcccgactcctgaatccccctgccgagagaggagtctcatgcgcaactcaaactctctcttctcctcttctccgcgtcgtctcttcccctccctctcgtcgttgtctaccctcccactcgtacagcgcgaccacctcccacctccggacaccacacccagcgcgccgcgcggcggcacgcgggagcgcctcccttctgcttctctctctctccctcctcttccttctctgttggggcagccgatggaccgctgcggtatagagggtgacagcggtcgacagtacaaagacaacagcagcccacgacagcgcgccagcgtcgcgctcgccccggggtggtgcttcccagcatatatcaccttatctccagaaaggctgctggaacagtctcaggggagaatagaggaaaagcgtgtagcaaggagggaggaagcggcggagaggaggcaagatgagcgcacgctgagagcgcgacggggcagcgtccaattacagccagcagggactatactggccgcccccagcgactcaaaaagagaaacg

SEQ ID NO: 698054 - DNA, 161 bp, Homo sapiens
gaggcactggttttggggctggttggcaaccttggaggggcagagctggggctacccttccgaagggccggggcaagcgagctggccctcggggcctggtcttcagaagggcaggaggtcactgaggattctctcggtccgggcatcaggtgtagacgtct

SEQ ID NO: 698055 - DNA, 191 bp, Homo sapiens
tcaggcttcggcatgagctgggcgcgacggatcatcttcaaaatctgtctgaaaaatgaggattttacatttggctgtattcgttaaacagtttctgaacagaaaagggaagttattcaacgctgagcttcctctgtcttaacaaaacatgggataacgaaaattccccacaagtgactgggcaaacataa

SEQ ID NO: 698056 - DNA, 1290 bp, Homo sapiens
cggcgcccttttttttttatttattgatcacaataatagcctttataggtgtttctaaaaaaatggggtgaaaaaacaataggatataaaataaccattattacaacgtggaaacagataaagtcccccagaaccacccctttcaagaatggacactccaaagccctcgtggggccaaagcacggggccaccaccgagcaaatacaaaaatccacgctcgtgactccagggtgcggaatggaaggaaacgcgctcaggccatcccgagcgataacatggaaggagcaagatatgacaataaatcccttgagggtcataaaatcttaaagggacgaaataccacatcatacggacacaagacctgcggaaccaaatccccggaaaccactccgagagcgatcccatataaggatatgatagaagggaaataccggagaagatgcaggtgggacttgaacggactacccgggggatcacacacaggacacaagaaaaaggcgaaaggaaacccacaagcaatccgaggagaaaggtgagccacacggggggcagccacgggtggacccccaggaaaaaagaaggcaatcgcccgggccaacgcccacagaagacacaacagcagaaaaatccccagaaagccgcagagcgccacacaagggttagccagacatgaagggggataccccggggcgaccatgaggcccactgcactgagcgaccaaaagagacaaaagggacgccatatgagcgccagaacaagagagatgtgacaagatggggacaacttcccaaaacagcgaggatcccacaaatacgcatccaacgaatctcggcaaacacgggacccgagctcatagaagataatcacccgatgagaggggaggcccccaacaagcatatagccaacgaaacacccaagaaattacgaattggtacccaacaaggggtggaccccccatcaacgggagacagctcggcaataaccagaaggccatagcacactagtggaagcgtacgagttctaccacaagaacgacgcacatgggccacaacacccggcatcaccacgggacaactctaagccgaaaggcaccccataacaacaagtgaagtgggaacaacatcaaccgcccaccacataccactccagccttacaagcacacacgagaaccaatcacacacactagtacgccggaacacactcggacaccagcggcgacactaacccccaccacgaaccaacgcccacacgatacaataacaacatacgacccagcacagctacaacc

SEQ ID NO: 698057 - DNA, 373 bp, Homo sapiens
  misc_feature (279)..(279): n is a, c, g, or t
  misc_feature (301)..(301): n is a, c, g, or t
  misc_feature (315)..(315): n is a, c, g, or t
  misc_feature (321)..(321): n is a, c, g, or t
  misc_feature (328)..(329): n is a, c, g, or t
  misc_feature (336)..(336): n is a, c, g, or t
  misc_feature (340)..(340): n is a, c, g, or t
cacgaggccgatgacgatcgcgacgatcgcgacgagcagccccaccgtgccgccgctcagcacgtgcgacccgatgaggcgcccgaccgggatgtgcacgaccgactcgggctcggcgacgggctcctctgcaccctcgatgatcccggtgatgccgccgctcaccacggccgccgcggccgacgcccgcgacccgggccgggagacggtatccgcccgcgcctcggcgaggcgcgcgcccgacgcgagccgcaggatgtcgggccgcacctcctcggnattcgaggtcgacagatactcnagcttgacgttggngtccangcccgcnncgaccanctcnagcttcgccaacccgacaagccgcgagatcatc

SEQ ID NO: 698058 - DNA, 284 bp, Homo sapiens
ctttctccacgtatgcggtgtgctagctggatgtcttttggcataatatgtacacgtattggcatggatagcacacaggttgtgtgtcttcaacacggccaaccagataggcctcacttgcctcctgcaaaggcactgatagctgcgctctggaagcgcagatctgtattactgtcctgagcaatttctcgcaccagaggcttggaagtggaagttggcgaatcagaatgtccatgtggacttctgataacgtctaaatttcacggagcgccacagtaccaggc

SEQ ID NO: 698059 - DNA, 458 bp, Homo sapiens
gctgaggagcagctgcgagccgaccatgtcttcatgtgcttccactagaaccgcgaggacagagccgaccttgactccgaatccttacagctttcagggtcttatgatgattcgtcgacgaccgcggggcatccccatatgtgccacacaaagagagccccgagctgcttgctattcatgggcctacacagttcggaagaagagtagtcttccgggacgaggacgtgatgcgacgtagcgagtcccgtctctggggctgcgtggcatcctggacccctggaggccagcgccttgtcatgccgggtggttaaggaaccgtgaaattcgactcatctagcctgggttgtggtccgaagatgtaagtatatcaggatgtcagaactaggatcgactgctacttccggatagtatatgtcagtgtgtcatggaaagatacagatagagacagagaagattcc

SEQ ID NO: 698060 - DNA, 103 bp, Homo sapiens
cactaacaggtagaccttcgggttattgtatgattatgggcgttgattagtagtagttactggttgaacacttgtttgttggtgtatatattgtaattgacga

SEQ ID NO: 698061 - DNA, 346 bp, Homo sapiens
actggaaggatacagcttaacagataaaacaaagaagaagaagaaatggcaaagagaaagtttaatcaaatttctttcttttatacatttagattagcagttcatttatttgaacacagactgggccaatgtccacaaagaatcctggtcagcaccaccgatgtccaaaggtgcaatatcaaggaagggcaggcgtgatggcttatttgtattgtattcaatgattgtctttccccattcatttgtctttttagagcagccatctacaagaacagtgtaagtgaacctgctgttgccctcagcaccaagttcaacatcattcgagccctgtagaatgccagccttt

SEQ ID NO: 698062 - DNA, 167 bp, Homo sapiens
gagagaactgttgcggagagtaaacgataagagagtaaggaggctggcgcggtgggtcacacctgtaataccagcactttgtggaagccagggcaggcggatcacctcaggtcaggagtacgagacagccttatcaacatattgaaagccccgctctactaaaaata

SEQ ID NO: 698063 - DNA, 105 bp, Homo sapiens
ggtaggcggactactctcgggcctggtgcatggctagctctagaatctagtctgacagcaggcagaggaattatcttaaaacatcaatcggtcacgatccctccg

SEQ ID NO: 698064 - DNA, 1373 bp, Homo sapiens
ctgccgccgtcgccgtcgccgccaccgccgccaccgctaccgaggccgagcggagccgttagcgccgcgccgccgccgcctcctctgccgccccggagcagcgcccggggcccgaccgccagaatccagatttttgaaaacatacaactgtctaagtgcgcttatgagagaccacatggctcgaatgcgtgcagagggtgacatcggtcagatttgaacttcgaacggtcaactaccattcaatctagaagcatgaccaaggactgagattaaaaaagacatgctttcgagaaagacatatggatagaagtagaaatcatgaaaacacatatactaacgaggaataaaagatagaaacggaacacacgatatggcgcttactgcgccctaacgctcgactccatacggctgacgcccgcgccaagcgcactccactgcacgcagcactcgcaatcaaacacgtctgccaaacgacctcgcacgagcatcccacttcaaataacacactcaacggccgctcgcaactcctacgtccacgagccctccagcaagcgcactcacaacagcaagccacaacacttgcattacactcaaaacacaggaccatccctcgcgcgaaaccaactaaccccccactaacccgcacccatcaacaaagcacagtgatccgaactcgacaattcgtactaccgcattacaattaccctggccagaggaatccctatcaacgctacaatccaagaacccacccaggacttcgatcccagacacaggaaaatgaccaattaactcccaagaaaccagacaccaaaccaagcaacaccacccagcaaaacaacgcaaccccacaagttcatcacacagagcatcaatacatcacacacaaaacacaacataactaaacaaccaaatcacaaatctacaacactacccaacacacataacaccaacatacaacaaacaaatacaacaaaacaactacaattaaaacaaaaaactcactctacacacccaccaacctactacaataacacaaaataccaaatccatagcccacaacaatcacaataatccaacaaacaacaatacaaacaacaaacaccacaacacacacgatcacccacctaccacacacacctcaaactacacattatatattactattaacactccacaatctcacaaccttatcttcatccacctaaccaaatacaccccaatactcaaaaactcaaaaaataacacaccacatccaccgacccccccccccacaatccaccaaaccacctcccatccactatacataccaaacccacaccctacacaaccacacacacaaaacacaccactaacccacacctacactcattaaa

SEQ ID NO: 698065 - DNA, 745 bp, Homo sapiens
aagaactcccctggagcaggaaattttgcaagcctcctccataagaacaagcagctcagtgacagacgctttactgaacccctgtggcaaacaggtcctctctccgagccattgagcctagaagaggcgaatgtatgcgacgagcagagtcttccggagggctcgggctctgcagtcctactatgaggccagagggctcgtacggagagaagaagatagtcaacaagtacaataacgtatcacgaagtcgtgaagaagggaaaggccaagaaagccctagaagtagtttgagcagtctgcggagaggttatccagctgcagcgaactagaaagagactggaaaacatattggaagggccagaatgatggggaagaatgacgccttaagcacgcaaaacagtgggaaattgggccacatgtctaagaggcaattatggcgcaactactgacctgggacggcgtcgaccaagcgtaatgtcaggacacagatagttcttaacggaaacaacggaactgatcatcaggaaagctcccagggtaaggcctgctggagcagtagagcgaagagtgacgggaggcaacagacagaggggggagagatcggccctggtgctctgtattgtaaagtgcaactgaagtcgccagattgaatgcagtacgggcgaaaccgctgcgagcacaaggagggccgagggataccaagatggtgacatcacggagacctgagggcaaggacgagctgagc

SEQ ID NO: 698066 - DNA, 149 bp, Homo sapiens
gttttttttttttccccttttaaatgagggagagctttgcttaagggttgcctccttttattggggtaaatctgaatgttcctcctcctttggggttaaactggtgcttcccggtttcccattgtttttggcttctggttggaatttga

SEQ ID NO: 698067 - DNA, 253 bp, Homo sapiens
  misc_feature (119)..(119): n is a, c, g, or t
  misc_feature (230)..(230): n is a, c, g, or t
taatacattaaaagcatttaacttccacactagaaaactgcacaggctaaggcatagacaaaacaacgagaaatgctgagacttttgacactggcgacaacaaccctgaatgagtgagngcagaagagtactggctatggcacttagagtaaggattcgtaggcgatttcttaccacaaggtagaacttcacccctcatctccggactagatagtatcgagaccatcagnggtactcattcagccaatagacc

SEQ ID NO: 698068 - DNA, 294 bp, Homo sapiens
gaaaggccttcttttcatgacttcatgatctgaatccccccgagtcattcattctccatgaagtcatcgattttccaggtgttggtgaactgcctgtgactcctctcctcccccggcccctacccctcaggagataatgaagttcattgctgggctagaatgttttagccaatgattcctgcctctgtgtttaaacctgcgacacatcccttatctttgtttacaatatgaaaatatctgtgatccccgggtatattgagagaaataaaaaggtgaaagcgatttcccaaatga

SEQ ID NO: 698069 - DNA, 220 bp, Homo sapiens
  misc_feature (92)..(92): n is a, c, g, or t
  misc_feature (210)..(210): n is a, c, g, or t
ttttttttgagactctacggatgtattttacctagaaatagccaatctctactaaatcccttttagtcttcgagatttccgcggtaacaatntcaacagaaaggtattttcaacagcgaaaaaacaagttattctaatttggcctttattttttactcaatagagcttgccatcgtaagggcatttttccatactaacatttgcaattgnagaaaggtcg

SEQ ID NO: 698070 - DNA, 599 bp, Homo sapiens
catacacggcgctgacgttggccaggtccaagccggcggtaaagtgctctccgtgggcaaataccacggcaacacgcgcctcgtcagttcgatcaaattcgccataggccaggctcagctcgttgagcaaatccaggtcgaaagcattgcgcttggccacccgatccaagcccaacagcaggacatggccctgtaactcacggctgacgcgactgctggtggcttcattcatcgggtgtgccctcgggcgcggggaaggatttcggaccaaaggtctcaagggttaggtgaatcgtttaagcgttatgaccaacagggccgggcctttgaaaaatagaccttgccactgttatctgcaaagactgtgatgcagcgcggtttatcggtgctttccgataaaaaaagctccctttttcaggtatgtccggtatagtgcgcgccggcctttaaccgggccgcgtttaggtagcgcaattccccgaagtcagcttcggctgcacgtccgcacagcggactctcccttgacgaatctttttcattcattcgttttcgcaaatccccgccgacaaagcagccagggcgactcttgagtctcaaca

SEQ ID NO: 698071 - DNA, 437 bp, Homo sapiens
  misc_feature (9)..(9): n is a, c, g, or t
  misc_feature (28)..(28): n is a, c, g, or t
  misc_feature (114)..(114): n is a, c, g, or t
  misc_feature (119)..(119): n is a, c, g, or t
  misc_feature (180)..(180): n is a, c, g, or t
gaaagaaangtgccagttccccggattnagttattacaaaataaagtacctataaatatttgtaacaagtgtccccgccatgaaaatcagttttaatttcctctgggatatatnccccnggagcacaattgcctgaattgtatggtgatatggtttgacctcagatctcatcttgaattncccacatgttgtgggagggacccggtgggaggtgactgatttgtgggggcatgtctttcctgcgctgttctcgtgatggtgaataagtctcacgagatctgatggttttaaaaaggggtgtctccctgcacaaactcattctctgtttgcctaccgccatccgcttaagatgtgacctgctcctccttgccttccgccgcgattgtgaggcctcctcagctatgtggaactgtaaatcgaattaaacctctttcttt

SEQ ID NO: 698072 - DNA, 114 bp, Homo sapiens
gagctttgctgtcgaacccacgtgtggtctcctacctctcagctcatggcctttgtccctccacccatgttcctcggggcatcttcgtcctctgtgtgccgccagtctttaggt

SEQ ID NO: 698073 - DNA, 152 bp, Homo sapiens
tgtctctacaaaaagtaaaaaaataaattgagcatagtggtatgtgcctgtagttctagctacttgggaggctgagatgggaggactgcttaagcacaggaatttgaggctgaagggagctatgattgcatcacagattaggacccatctct

SEQ ID NO: 698074 - DNA, 257 bp, Homo sapiens
ggggacgggattttgcttttcccgcctgggccaccgcggggctccctttcaaaaaaaacggaaatttttttcaagaacctggttttcccggggttttttttaattccgatcctccaactggtttttttgaagggttggctttaaaatggttgcaaatgtccttttttttttaaaactggaagaaaaaatattctgttgtgtttccaaccgtgcttagggtgtttttccccgggcttttttaaaaggtggaacctgga

SEQ ID NO: 698075 - DNA, 256 bp, Homo sapiens
gagttccccaggtagacctaacgtctattacgtttgtacttgcgcttactttgtacgccttcatcaggctttgctgaagatggcggtctataggctgagcaagaggtggtgaggttgatcgagggtttatcgattacagaaccggctcctctagagggatatgaagcaccgccaggtcctttgagtaataagctgtggctcgtagtgttctggcgcgcagttttgttgatttaactgttgacgttaggtctacctg

SEQ ID NO: 698076 - DNA, 152 bp, Homo sapiens
ggaaggccattcctttcaagtggacccggggtcaagaatacccacattcccgaagggctgggcacggaggaggcatggggggacgatacctttggactattgactattgctctactgaggcgaagcgtggtccacacaggaatacctggagc

SEQ ID NO: 698077 - DNA, 199 bp, Homo sapiens
tgtagaggcaacaattataagcggaaacgagctctcatggagtcacatgaactattccgagagaatcgcttctgagcctctcctgctgctgacctgatcacctctggctattgtctctatgccgggaccatgcgtttccttattctatcctctcttctctcattcccatccattccctatctctctcttccctactttc

SEQ ID NO: 698078 - DNA, 1400 bp, Homo sapiens
acactggctcaaagaaaagcaataaaaataagagtggcaagaaccagtttaacacgacggtggtggccactacgaggacgctggcacggacttcaactatgcgatggcgcgaacactttcagcagcgacggagcccctggcgaactcgctggcgcgatataactaggacggggcaacaatgccacagacgacggtgcgctgcgcggacgcgcagcgaagctgcgtggcacactcgcgctatcccataccctcgctgcccccctgctctttctccctgccgcccgcctggcctcgcttcacctccacacaccagcagcgcgcaacacctcacacacccacgcagcgctgcgccacactggcctcacaccacagcaggagaaacctcacacacccccagcacacacctctcccagcacgcgcacaccgcacgagaacaaaccacaattcagcttgagaacatcatccacaccacaacacttcacaacctcctcaagcgagactaacaaaactcacgctgcgcccacgacacgcggccctccacacctcatccttgcgcgacgctcacagcacaacgccccaactggcacacgcttccacacccacctctacttcacaccccacaaggcaccttactacactcttgcacaactaaccccccacaaaaccttcaacccaccccgcaccaccctgcaacttaccattaattacttcctcctccaaaaaaacccctttccaacaacgaaaaagctccggaacagttcgttatcactcccatttcaagccctaccgggccctacaccccttctctcttccacccccacctttcccccaccacaccgcacgcggcccccgctggccccttgccccggccgcacctccccctcttcttccgcgacacgacaaggccctttctggctcggcgcgcctacgcgccctctctgtcccgcctccctctctgtcccctctttcgtgccggctcaccactttccctcctccaccctctcgcgccccacctctttcatccacgaccgcttgcaaccttccggtccgcggtccgccacaccccctccccaccccacttcggctgcgcccccgcacccacgccgcgacatggctgcctcccacgcacacctccccacagcgcgccgccctaccccactgaccgctctgaccacaccaccgcgctcccccccaccacccccccaccacacgcaacaccaccacaacacagaccaacaccgacaccaaacaccgcactgcccacatcacacaccaaaaccgcaacgcccaccaccccaccaccagacaaccatacagcccccccccaatctaccccacccacaacacaaagcaacgacgcgaccacaagcccacaccgccacacacacacagccaccccc

SEQ ID NO: 698079 - DNA, 418 bp, Homo sapiens
tcattaagatagcctttagtagaaaaatgggaaaataaatgctaattcccaaaagaagccattcaaataactaataaaatgcttaaaagttttaaccccagacctgggcaagatgacagaataggaacagctctcatctgcagctcccagtgatatcaacacaaaggcgggtgatttctgcatttacaactgaggtacctggctcatctcattgcgactggttaaacagtgggtacggcccatggagggcaagctgaagcaaggtggggctttgcctcacccagggagtgcaaggggtcggggaattccctctcctagccaagggaagctgtgagggactgtgctgtgaaaaatggtacattccggctcagatacttcgcttttcccatggttttcgcaacctgcccgccaacccata

SEQ ID NO: 698080 - DNA, 655 bp, Homo sapiens
  misc_feature (246)..(246): n is a, c, g, or t
ccctagggctagtggaagacttaagatggcggcgttgcacggagtgcatcactgcgtccttacgggggtgtgcaaggcgtccgaagtatgagtccactaacaaatgtccagaaactcgccagttaatagtatggtgtctcttcaaaatatcggagaataatttctttctcgctgatcgcctaattcatactgacgaagctgggaagtgtgcagaagatggagtccgctctgtgtggcccaggctgnaatgcaagggcttggacctgtggctcatggaacctcgtgcctccccagttcagtgtggttctccgtgcctcagcctcccggagtagctgagattacgaggtaggggctccgtgtatcacccagctctgggagtggaaagagctcttcattcctgagtctcctgtaccactgagattagaattcaagcacttggcggtcaaggaaaatgtgaaaccacagaaaacactctaaaattaaaagaagatagcgtcttcagaaaaccaaacctagtgaagtgacgtatttgtggattaccctgacagggacaattacaaaaggagcaaccataaaagagtctcagtgggagcaagtgtgtgaacaaatgagacttttcattagacattaaatgataacaaagagtttaacgtgg

SEQ ID NO: 698081 - DNA, 243 bp, Homo sapiens
ctggtactggccctaacattcttgaagtctggtgcagctaccatagttgatatggtacctggcgagcccatgtgtgtgagagctctcaaactatccacctttgagtcgcttagcagtacgtgatatgagacagacagtcgcggtggatgtcatcaaagcagtggacaagaaggctgctggagctggcaagggtcaccaagtctgcccagaaagctcagaaggctaaatgaatattcatcccta

SEQ ID NO: 698082 - DNA, 170 bp, Homo sapiens
gtattgcggagattggcacgtggtccccaattctttggtggctttcacctgctcattcaggtaatgtgtcgcgcgtgaagtcacacaacatgggggtctatttttgtcagtggccagctttgtgcagttccagctagtgactagattcatactttagtgtgccaaatgta

SEQ ID NO: 698083 - DNA, 182 bp, Homo sapiens
aaccccaaggaggagaaaaaacttgttcacagccccttatttccgcaacccttgtgggaaaagcacagaaagtgtagtccctccataaggaattggtatttaaaaaaaattttataaaaccccttttatgtaatccgatttgaaaggtaaaggtgataaaaaaaaaatcccctacttgggtg

SEQ ID NO: 698084 - DNA, 608 bp, Homo sapiens
  misc_feature (114)..(114): n is a, c, g, or t
  misc_feature (141)..(141): n is a, c, g, or t
  misc_feature (143)..(143): n is a, c, g, or t
gtttctttcctccctgtcttagactttgaatgttgaccctcacagggagggataatttagactctggtatggccaaagatttgagcacaaaggcaaccgtggttactgtatttntatataacttcatttaaaatatattangncctaaatgttcagatatcagcatatggcactaatgcacaaaatatgtgagcttttttttttttcccggttagcagtttgtaacatttggggtattgggctatagtggctatttaaaaaatttatagatggtaattaattttaaatggcagtaatatttgggagaattggaccaaccttggtaaccaaaaggggaaactcactgggttccttaagattttataaattggagctatttttttaaagaggtgctttttaaaattccattagatcccagagatggttccctggggttttctggccagtcatccagttggatacacacctggatgattttaaagaaggccacaaagagctgaatggggcagggtaatcaataattttcaaaggacttgattgtcataaagatcctttataacggtagatcgaagccaaagcagcctcattgtgtgacaacctttccatac

SEQ ID NO: 698085 - DNA, 170 bp, Homo sapiens
gagagatgggttgataccttatcatggagagactttcttgctaggttaagaatgtttacccattgcccagtgccgggcacagtggctcatgcctgtaatcccagcactctgggaggccaagacgggcggatcacgaggccaggagatcgagaccatcctgcccaacatgg

SEQ ID NO: 698086 - DNA, 732 bp, Homo sapiens
  misc_feature (162)..(162): n is a, c, g, or t
gacccgttgactgctgccaggacgcatgggcgtgtggctggctgtcggggcgtccggcggctgtcagggcggtgcaatcccagagaccacggcgaggaataagaacgttgtgaactccacgtgcgtctttcgaactaagtagtcaggacgaagtgttgatancggttgcctagcatttcagtccagatagtactcagatcgacagtcaaggggtataccttgcattgactagtatgggcatttaaccgggtatcaaaggttgtttacaccggtaaacgtttgctactaatgagggctataacacgtagtgcgtgggacctgcacccatgagaatcatatgcataccagctgtcaagcaaacggatggtccagtcaggtgcagtgattaggcgatagggaaggactgacataaactggttgtgtacctagccataggcgaatagaaaccgcggctgcgctccctgcccggcagtccgcataaggccagtattcctttcttgccaagtggggggtcggtcttaagcacggcagaggcaattggctttgaatgtctccagaaaactaagttaagatcagaaatcccgggaggaaaggaagaccaggcgggcagagtccaccagagcagcaaggcccacacgcggcataggattttccaaaatttacacacagagtttaaaacaacagggtgtgcttactctggcgatgtagggccagggagttgctacccgagat

SEQ ID NO: 698087 - DNA, 212 bp, Homo sapiens
tcctcccagggcctttgcttttaaaaggggggggtcttttttttctttctcccccttttttttttttgattaaaaaataaaacccaaccagaatttgctgaaagcagggccctttcagtagctccgatcaaagtaactcagcttaaagatactgtttctcagggccccagtatggtccaaagtttccggaaaaggaaaataaaaccccctga

SEQ ID NO: 698088 - DNA, 463 bp, Homo sapiens
ttaggtttttgacttctctaagtccatggaggaggcctgcctagcaccctggtgctgccctcccaccaatgggaggaaggttatcatgcagaaaaacctgcttgctcccacatcaggcatgccctgctgtcccctgcacctagccccgccttccttccccatggaacaattcggccaaatgattctgcccaaaagttccctttgtccataatgaaaagcaagttggaaaggggtaaagattggtaagagaaggcaaagcatgttttcctaacaagtttgacaatttggaaataaatatatgtacataacaatttttaacacctttaatacttttttcactttccttccagatgactcctttatacatgtgctaattcatcatatgtcttttttcttgaaatatttcaaatggaaactaaaactgatgtttatttacaagaataaacttatgaaaaaaaagcta

SEQ ID NO: 698089 - DNA, 133 bp, Homo sapiens
cgctttctgccctgcatctaccgtgacactacgagaaaccgtgcctacctaactaactggactgtggggaccaatgactggtaacgacacgacggtacgactttggactggacgacgacacacgacaactacg

SEQ ID NO: 698090 - DNA, 107 bp, Homo sapiens
tatacgatcgcaaggcctggcatgcaatgtctactgctctggtagagagacaatagcaacaaaagcttccatcactactagagctaaccttctcctactaacccagg

SEQ ID NO: 698091 - DNA, 392 bp, Homo sapiens
  misc_feature (326)..(326): n is a, c, g, or t
gatagttttcaggtgtctacagtgattttgtaatatttgtgcacatataataattccaaaaatgtaatccagtggggaaatatactctctaaattctagatttataatttagggtttaaattataaaatcattaaataagacacaagtgaaatatagtcaaatatccccttggaaaaaaattaagtggtctctaaagtgaggtattcatatatgtaattttacaatcctctagtgatagaattaattaaatacgccaccaaattgattaattcctacagtatttaaaaggggaagcacttaacaatgccagtggaccatgttaacntggggttttaaggctattaaggtccttaggaaattgtggatgggggaaacctccggcgctgttaaa

SEQ ID NO: 698092 - DNA, 239 bp, Homo sapiens
  misc_feature (128)..(128): n is a, c, g, or t
aaaccttcaaggggtttggaaatggacttggtcacccaaaaactttccccgttgggggaaaaactccgtcacaaccaaagggacaaaatgtgggtgaccctgaaaccccaatttcccaaattgttctncataattcatttcacattgttgtctgggttggacatcctgtgggcctcaatgttaggcttttaatatgtaatatccttgttatcaataataacaattatccatatgggttt

SEQ ID NO: 698093 - DNA, 769 bp, Homo sapiens
  misc_feature (189)..(189): n is a, c, g, or t
  misc_feature (217)..(217): n is a, c, g, or t
  misc_feature (231)..(231): n is a, c, g, or t
  misc_feature (277)..(277): n is a, c, g, or t
  misc_feature (301)..(301): n is a, c, g, or t
cactcactttatcaccaaagtacagaggccaccttcaaacttaattaacagcatataccgcgatgacactcttgcaccaagcgaattaacacagactacctctatctttgtacccttcccggacatcataagggctcgcccctgctccttaccaacgttatacacaattttttttttgagggggggganaaccaacacaccgcccctatccaagccngcaaaatgattctncgttcagggtttccaccctaacagactgcttactcaaaatcggtgngcatacaacatctcctgtgaccangctggaaaatttgccccacttgaatgaaatttgaaaaggcccaggcacttgcaccggtatatttcctatgggccacgcgacccatagacacctccccgactaaaccgctttggctgtttaggaccatgttggtagtacgccatacccacaacctggaatacggcgccggacatcaaaacggccaatttgagagttgatactcggcagggccaaacttctatacctgccttaatttccccgctgcctgcctagtgtacaaaacaccccgaaaccacattctctggggctccgctagaaaaacatttaaaattataaaaataagaaacgcccgcaaaagggctgacccaacataaaaccgccgtaaaattacaaagtggaacaaaaggggggtatatttccaaaaagtcccatagtaaaccaggaaggaatatactctctttttaagccctactcaaacatattgtgaag

SEQ ID NO: 698094 - DNA, 761 bp, Homo sapiens
  misc_feature (323)..(323): n is a, c, g, or t
  misc_feature (332)..(332): n is a, c, g, or t
  misc_feature (343)..(343): n is a, c, g, or t
  misc_feature (556)..(556): n is a, c, g, or t
  misc_feature (559)..(559): n is a, c, g, or t
  misc_feature (562)..(563): n is a, c, g, or t
  misc_feature (565)..(565): n is a, c, g, or t
  misc_feature (568)..(568): n is a, c, g, or t
  misc_feature (571)..(572): n is a, c, g, or t
  misc_feature (574)..(575): n is a, c, g, or t
  misc_feature (584)..(588): n is a, c, g, or t
  misc_feature (591)..(592): n is a, c, g, or t
  misc_feature (594)..(597): n is a, c, g, or t
  misc_feature (599)..(600): n is a, c, g, or t
  misc_feature (609)..(610): n is a, c, g, or t
  misc_feature (615)..(615): n is a, c, g, or t
  misc_feature (617)..(618): n is a, c, g, or t
  misc_feature (625)..(625): n is a, c, g, or t
  misc_feature (630)..(630): n is a, c, g, or t
  misc_feature (632)..(632): n is a, c, g, or t
  misc_feature (634)..(634): n is a, c, g, or t
  misc_feature (636)..(636): n is a, c, g, or t
  misc_feature (677)..(677): n is a, c, g, or t
  misc_feature (745)..(745): n is a, c, g, or t
agcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggccaggaggcgcgtggcggcgctcggcctcgcggcggcggcggcggcagcggcccagcagttggcggcgagcgcgtctgcgcctgcgcggcgggccccgcgcccctcctccccccctgggcgcccccggggcgtgtgaatggcggcctccgcggcggcagcctcggcagcagcggcctcggccgcntctggcagnccgggcccggncgagggctccgctggcggcgaaaagcgctccaccgccccttcggccgcagcctcggcctctgcctcagccgcggcgtcgtcgcccgcggggggcagcgccgaggcgctggagctgctggagcactgcggcgtgtgcagagagcgcctgcgacccgagagggagccccgcctgctgccctgtttgcactcggcctgtagtgcctgcttagggcncgnggnncncgncgnngnnaacagctcnnnnnacnncnnnncnnctggcgacnncaccntnntttactntcccntntncnagcaacagtgcttctccaaagacatcgtggagaattatttnatgcgtgatagtggcagcaaggctgcaccgacgcccaggatgcgaaccagtgctgcactagctgtgangataatgccccagcca

SEQ ID NO: 698095 - DNA, 1022 bp, Homo sapiens
agcggttcgtgcccacccctctagcgccgctgggcctgcaggtctctgtccagcaacggacgccggtctctgttcctgcaccgatgagggtatcagttaatacagttgtcaaggcaataaaccgcctactcttaatgagataccaaggttgcaaattttcagcagaagacctgcaacgcatgcaggggtaagacactcgcagttcatctcactgcgtcgcgaagaccgacttgtgccgtatcctacatgactcatacatacataagatttactagcaaatcccaagatacagtgactgactacgtccggtgtgcatctgacagaagaaatatcattattgtttcagaatctgctttatatgcccggtgtatcagaaggcgggcatatcgaataggatccctgcgtcgagctgataatgccactactgaaaccatgcctataaagtaatgcgtgtgcaagtgttgggccgtgtactaaatatatgcttgcatgcagtatgttggtgcatggccttagcctgcattgtgtccacaggccattgacctttgcatacaattaagagtctctagagacgaatagagaccaaaggtacttcgtatggagaaggccccagaggatggaacgggttcacctcgcgtgaatgataattacaaatgctggtatcatgacattagagtgtggtatagaccaggatgcctttcacccttgctgatgtatgagtcttgtcgatgtgcacctttggctcgagtaaatcatcaccgaacattgtgctaactaaagaagttggtggtacggtggtgggccccttggaatacgggtgaaggcattgcctgagaattgagatgggcttatggtgcattatccccccattccaacttgcgtcacccgaccatctgaattgctcctttggatttgttcgagtatcctagagccagagccagtgtgaacttttaaagtagtcggaggaaaggttaccacttcgtcgaaggcaactattcgattgtgggcccacgaaaaatcgc

SEQ ID NO: 698096 - DNA, 155 bp, Homo sapiens
taggatctccttctatgctgtctgcccttctaatgtgctcttctaatccctcttctgtgtcatttatgcatatcggggaaggaaggaagagggaggtactacgtgagtaaggtaagacacctcaaaatggcatgtggactttcgggccgtatcta

SEQ ID NO: 698097 - DNA, 590 bp, Homo sapiens
  misc_feature (590)..(590): n is a, c, g, or t
ggactcagtccccagccaaggagcggctggaggacggctgtgtgcacccactgtgagggaagccatgctgatgctgcgacatggatggctcccgtcccacttccccgatgtcccgatagacatgcagccacatcaatgaggcccatgaacgccttcatggtgtgggccaaggatgagcggaggaagatcctgcgaaggccttcccagacatgcacaactccagcatcagcaagatccttggatctcgctggaagtccattgaccaaccaggagaagcatgccctactatcgatggaacaggcggcggcttgagccgtggagcgacctggagaagtatcctgaactacaagtacatagccgcggaccgaagcgcagcctgcgatcgtggcggggcagatgcggcttgcgcgtgggagagtcccatggctcgctgttgatggacccgtgggtcgggatgcccgtcggagctaccgtgatcccgccgcaggctggccaggtgcagatgagctcctcagatgtcctgtcccctcgggcagcaggctatgcctgtggcggcgccactggtgtatgcactatgtccctcggtaggn

SEQ ID NO: 698098 - DNA, 1417 bp, Homo sapiens
  misc_feature (503)..(503): n is a, c, g, or t
tattgaatcagatttaaacatgaagcatgcattgagtgtgccaaggcaactaagtggtccatagcagcagtaatgttcatagcggtgcgagatgcctgctatgaaacagcaactctcaaacatttattatctcaagcaccattatgtttatgctgagcctactactactacttactctactacttacaactacttacacatcttcttaacacatactctctacttctactgcgggccaaggcacggctggcctctacggccctatgcgcccctcccccgaaagcctgcctagcgcactctactcagcgccgctgcacgccctacctgcctgcccctagccctaaatttaacctatacctttactacaaccagcaactgataaacgaagttttagcctgcagcaaaacacggcggccccgcgttctttctctgcggagggcgaacatatttaacctttactcttggctccaccttacacacggacatgcatcttagccactggngcgccttccctcccacttggttccctgtgccttaaccacattctccacgcctcccctgcctcctgcctcggccaccgcctccacctatcctaacttccacctgccttcaaacacaacccctcccttgcggccagcccacaacccaaccgccccttcccttggccttcacctaacccctcgcgccctaggccacatacaacgcaagaccttcgcaccaccacacagacaaaaccccccaacataaacgttaaccactcgaccccccactctgcaaccatctacgctcggcacttctctaattcgtcaacaacacactacccgcttttctcctcgtggaaccctttttcgacaccagggttggccccctccctgcaactacctgggtcgcgctccctattggtgccgcacacttcgttccccgaagcggggcgagttccccacccttccagtgggtccctacccacgcgctcgccgtgggcgcgccatgacccggaagcgctccccttgactgaatctacccctgccgctttggctacttgcgggcttctcccatgccacagccttcggccacgctttcctgctcgggcccagcgccccccctttgtcaagggcgtcgctgccgtgcgtcaagcacgtttccactctactcctgtgtcctgcggtccccaggcgctcgtcgtttctctccccagcatcatacgtactgtgcgtgcccaacgtctgccccccttggtccccaatgccgctgttgacgcccagactcagcatcgggcgagattccgtccgtggtgccttctcccagcgcttggcgtcgctatcccctggcgtcgcacactgagcgtgcgctcccctccgccgcacacctgtcctcccgtggccgctagctatctcgtcgtgcaaacgatctccctccg

SEQ ID NO: 698099 - DNA, 402 bp, Homo sapiens
tgtgctgtgctgtgctgtctgtgctgtgctgtgctgtctgtgctgtgctgtgttgtctgtgctgtgctgtgctgtgctgtctatgctgtgatgtgctgtcctgtctgtcccgtgctgtggtgtctgtgctgtctgtgctgtctgtgctgtgccgtgctgtgctgtgctgtctgtgctgtgctatttgtgctgtgctttgctgtgtgtgctgtctgtgctgtgatgtgctgtctgtgctgtgctgtctgtgctgtgctgtctttgatgtgctgtgttgtctgtgctgtctgtgctgtctgtgctgtctgtgctgtgctgtgctgctgtcatcctgtcactgtgagaagtgggttgtgttctcctttatgtcatcattcatcagactgctgtcacccactattg

SEQ ID NO: 698100 - DNA, 837 bp, Homo sapiens
gaccactgcgcgtgttgctggtgctcagctcgtgtttggatgcaatgtcttaggatcctcctcccgtccttctcatccttcatgtccaggttgctgcagaaggacgcggagcaggattcacagatgagagcggagatcccaggacattgaagcaggagctctccacagtcaccatgatggccgatttggccagatatgccaggtggcacagaaggtctcaccaagatgagggaataagctcaaaacccattgtgaaagctcggacagctccattagccaagatacagtgggtgataagtgtcgtttcaacgtatggcaggctcccctgattgatctcactcattgggacgtatatcctgccctgttgctgtcgtgccggtaattggataaccctttataagaccgcgtgaagcctttccctacaagatgtacgcaggtgtttgtcgcaataccctgtggcatttagtctgtaccaaatttgtcgcctatgggtgctccaatcccggtccaggcttgcacccagggaggcattggaattacaaggcccgcggagtcaaaaacaccagggattttccttcttccatagctaaaaactttgtgattcaacaggtgctgcgctttaaccagccaaccagcgtgcataggtaagactcctcgtcggcgcacatttttggtcttggccttatgcgcatcgtctataagactccggatttcctaccctgtatttggccaaaatcccgtttatgccgtttttttattaacaccgttctcattgtcaactgtcatgtgtaggaccctccgtgttcactgtgtgcccctatattttgtgcaatgtca

SEQ ID NO: 698101 - DNA, 261 bp, Homo sapiens
gacgtcgaccgcaagtagctggacctgcgcgtacgccagttcgacaacaccaccagcaaggatatccagccgttgcccatgccggtggtggtctacgacgacaaggcgtcgagctatctcaaggacgccaacctggacgccgagaagctgaaaaaaagcgtgatcatcagtcagtcggtggacgatgccagcgcggcaaacatcgagttcgaccaccccaagaccttcaacgacgagttgcttggcacgcccaccgccccc

SEQ ID NO: 698102 - DNA, 983 bp, Homo sapiens
ctcaattgtacccattctaatcgcagtggctattcctaatgcttaccgaacgaagaaattctaggctatatacaactacgcaaaggccccaatgcgttgtaggcccctacgggctactagaatgcgcttcgctgacgccataaagagcgcttcacccaaagagcaccctaaaacccgttcagcatctaacattcgaacccgtgctaccatcaagcggcccgccaagcattagctcctctacacaatgcggctcttctactattgaatagcctcccactccgccagtatcctcaatggccacatgagtgcaagactacaacactagagtccttcggtagggatggattcgtagaccagctcgtagtgattaaagcggtggtaaatcaaatcgctcgtggattaccaggggatagaaggcgactccaatagcgtactaagacctagcagacacgcatggaattcggggccgtcgctgtggtcgaacgacatggtagtgaccacgggaaacaccacaacatgctagtggtgggaagaagtcgagctctttagatccaagtcatttactggacttgattaacaaagcaatataacataagttataagatggacggagtcgcttctcgaggcatgcatgcatacacaataccatttctgactccaagaagaggtaccagagacaaagtaagcacgtaactagtcattgtaacatactcgttagtccctaaggctaagtggaacgcacataagcgactcatgtaagtatggcaatttagtaatcttgcactaacttaactcaagtcccaagatgtgaaccttaattctcttggaacccagcacccttttccagtatccctgtgaccacagacaagggtggatcgtgaccccgataactgaacaatgcataaaaggaattcacaaaatcggtcggaatatcaacgccggaaggtcccctctagggtaactgataacttcaatgggacgag

SEQ ID NO: 698103 - DNA, 947 bp, Homo sapiens
gcagcttcctggatgggaaccccacgtttgcccatcaatactttgggaagaagttgagccctgaaaatgtggcaggggcctgtgaagatggttggctggcggactgtggcagcctgcgagagctgtgccaggtggaagagagtgcagcactttttgaactggtgcaggacatgcaggagagtgtcaatatggaacgtgtggtcttcaagatcctgcggcgcctctgcaccatcctgcatgccgaccgctgcagcctctttatgtaccgccagcgcaatggcatagctgaacttgctacgcggctcttcagcgtgcagcctgacagccttctggaggattgcctggtgccccctgactctgagatcgtcttccccctggacattgggattgtgggccatgtggctcagaccaagaagatgataaacgtgcaggatgtggcagagtgtccccacttcagctcattcgccgatgagctcaccgactatgtgacaaagaacattttgtccacaccaatcatgaatggcaaaagatgtcgtggctgtgatcatggcagtgaataaactggatggcccatgcttcacgagtggaaagatgaagatgttttcacgaagtacctgaatttgtaacattaaacctgaagattttcactaagtacctccacaatgtgagaacgcgaggcagtgctcctggtcaggcatagggtgaagactggcggaactgaagacaggtcccaggctctaaatgtcggccattaaaggcagggatcagggccggacgaccggaacgcgcctgagttggccggtcagtgagacacccaaatggcccaacgtggggggacaatgtttcgtaggattataccggaaaaacaagtacacacccgcgagggcgcggtcaccacacagaggattgcctcgagcagtgatcgtcgaccgacagagacataccaa

SEQ ID NO: 698104 - DNA, 126 bp, Homo sapiens
ccgccattaaaggttcgccggtcaagctgaccgcgactggtgccaaggcttttgccggtttttacagggctggtgagccgatgaacccgttgtcgacgaacctcaccttgtcagcggagaaggtct

SEQ ID NO: 698105 - DNA, 492 bp, Homo sapiens
gggtctctccgtggaaggtgaaacgcgatgccgagaagaaagaccattgatgaatggctgacctcactgcgcttttcctgccgcggcagccgcccatgtcgctggccggaggcggagcagcttttggggccacaattgggaggagtgtggaacgaagacctagacggcatggagggttatcgtgctggagggcaagaagtttgcgcggctgccggaagaaggagttgggcacttctacacgcaggactgctacgtttttcctctgcaggtactgggtgcctgtggagtaccgaggcaggagtgcaaaccgaaggcacgaccccggcgtgagacaggcgatgggcaaagaaggcgaggactcaacgctgaggcagaaggagcaagcagccagaggaggacttcagtgcctcggtactctggcagggccgtgagctccaatatgggtgctcaaccttcacctcagctgaaaaaagtcagaagctttcctggaac

SEQ ID NO: 698106 - DNA, 351 bp, Homo sapiens
gctccactggtgctcgatacgtctattgattactctaactctgtactatctttataaaatgcatctcttttatggacacagtactgtatctggttgatcttttgaggctgttcttatctagactgtgagaatcagagaattatgctacttctgagcaaacacattaagctggcaagtttcacaaatatgagctaaagacacaaaactcctggctcaaaggcgaaggacattactatttacagtgtagcaagcaacatgagattcctgtttgcataggtttttcttgcctcccaagtctcaaagcagcaatatggaaaaggccagatggatgctgtgcaaccgagtgggagg

SEQ ID NO: 698107 - DNA, 100 bp, Homo sapiens
  misc_feature (63)..(63): n is a, c, g, or t
gtttgaatgcaggctttttatttctcaggacagccgagatgcctccgaggtttccagcgacgntaacatccaccctgcgctctatgacgggaggagggcg

SEQ ID NO: 698108 - DNA, 212 bp, Homo sapiens
acccttgatgcgaatatacgcacatactgatcagcacggctagttttgaccgtgctccgtttccgacctggagcggttcacccctaccttaggcaacctggtggtcccccgctccctgggaggtcaccatactttgatgccgaacttagtgcggacacccgatacggcacagtgcactaacatgcccagaaactccttgggctacaagcgat

SEQ ID NO: 698109 - DNA, 170 bp, Homo sapiens
cctgctcagccttctgagtagctgggacacagtggtggcaccaacatgcccacctaattttttatatcttgtagagatgaggtctcctgcctcagcctctcaaagtgctgacaaataaagcttctgtgatgctctttatgaaaggaaacaaacaggaagcaaaatgtgga

SEQ ID NO: 698110 - DNA, 332 bp, Homo sapiens
ggccccttttttttcccctggggggtttatccccccccgcccccccccccctttgccccctttttttgtgtggggggaagaaaggggcccccccttctttcccccgggggggggggttttttctggccggcgtccccccgggggggggggggcccccccccaagggggcccttttttttcccttgggggcccggggccccccccccccgggggggtttttttggggggggtttttttgggggggggtttcccccttcggggggggggggggaccccccccgggccccccttttccccccttttgggggaaaaaaagggggggttttccccca

SEQ ID NO: 698111 - DNA, 222 bp, Homo sapiens
aagcgagtcgtatgggaggcagttaattggaacaatatagagaaggggctgctaaagacctgattattatgttgatatttaacaatttaagataaggctgtgtatgtatggtggctcatacctgtaatcccagcactttggcagggcaacggtgggtggatcatctgacggtcgggagagaccagacctgaccagacatgcgagaaaccaccagtgtctacg

SEQ ID NO: 698112 - DNA, 809 bp, Homo sapiens
taggctttagtagggaaagtggaggttaggctagtcagaaatggagctggctcgggttgggttgtgctatggttaggcctttaggtgccccgagtggtgcaatcatagctcactgcagccttaacctcccaagctcaaattcctttcatgttacctggtgcttagtaggaggagcatggtgttgcacactagagggtattctgactcaatcattgccagtgtccacctgtcagccttgaggcctatgggagtacctcagggagggtactacctccatgttctctgccttctccctgcagtgagactgcccttgcttgttactcagtgcgatgccagtcctagggttggggacatggggtagttctctgttgtcttggtcccagccgtcagacttaggtgggtctctgtgttcctgcatctcaggggtggtgctttctcagtgattctggccgtccttcagtggtaggagacctctaactgtttggaccctagatgatttcctgttccctcccttagaatagaaggtttttccttttcccttccccagctgcagtgggtcttcgtctgtaccgggaagcgacggggttttctcccccagctgcatggctgagagcttctggtctgccagtatggttgggcgttgtcttggcaatcttcctctctgggcccccagtggggggcttcgggttggcgccctgcattcattttttggtgtgccgttggtcccagggtctgttcctactgggctttgtccaaatggaccccgtagggcgcagggggccaggggtggttcttccaaggggcgcctg

SEQ ID NO: 698113 - DNA, 147 bp, Homo sapiens
ttgctgctgattttggttgaaaggtaaaggatgtttgaaaaactaatgctgaggcaaaggatgtcttcctgggcatgttttgtatgaatatgcaagaaggcatcctgattactctgtcgtgctgctgctgagacttgccaagacata

SEQ ID NO: 698114 - DNA, 149 bp, Homo sapiens
  misc_feature (35)..(35): n is a, c, g, or t
  misc_feature (75)..(75): n is a, c, g, or t
  misc_feature (112)..(112): n is a, c, g, or t
gtcaaactccaactgcattcgggttcacactcttntgttcacaggtgtaaatattaagatttctccttgtcttgnttgcttttctactatgtcttgctgacttatatatatnctcctgaattctctaatttgacagtatatttctaagt

SEQ ID NO: 698115 - DNA, 331 bp, Homo sapiens
gtgctggcttatggggttaagaagcttcaagatgtgcatttcaggccgggtgcggtggctcacacctgtaatcccagcactttgggaggccggggtgggaggatcacttgaggtcaagagttcgaaactggcctggccaacatggtgaaaccccgtccctgcaaaaaatacaggttggctgggcgtggtggtgcacgcctgttgtcccagctacttgggaggctgaggcaggagaattgtttgaaccggcgggaggcggaggttgcagtgggccgagatcgcaccactgtactccagcctgggtgacagagtgagtaagactccatctcaa

SEQ ID NO: 698116 - DNA, 810 bp, Homo sapiens
  misc_feature (456)..(456): n is a, c, g, or t
  misc_feature (678)..(678): n is a, c, g, or t
gttgagcaggaaatactggtgactggtatcaaggttgtcgatctggctagctccctatgtccaagggtggcaaaatcgggcttcctggtggtggctggatgtatggcaacgactgtactgatcatggagttaatcaacaatgtctgcactaagacaccaatggatggtatactctgtgtatgcatggggtgatcagtgtgacgatggacccgtgaagtgcaagtgagtttatcaccatgacatactgagtatgaatgctggtggttgatcacatcgttacacagatgccactcatctacagggtaagtcgtctggtatactgtgctcaacattggtaattgatgccatctctgtgtcgtcatcgttgactcccgggtgctacgctcgtgtaactcgtgcgctgtactagtggttgagatacttcatgagaggaagcaaggtcaaagattagtactngctattgtgattgtataaactatgcttatcggatgtccgacccagggctggtatcagaagctgtcgtgtcgttattggtgccgaatacccttctgcttgttggagctatacagaactaaccatgtggcagtgacatggcgtactattgcatggagtcggaatctacacaacctagcaaagaaggggatctatcacctcctgtacagggtatcgtatcgttgnctggcggatgactttgactggccatgccccgtggttacataccgttttgcccattgggcttggtacgactgtaccttgttcgggttgcacttggtagagctcgggcatttatgccaggtggtggatctcctg

SEQ ID NO: 698117 - DNA, 132 bp, Homo sapiens
cggtggtctgcagaaacattctggtacaaaatctgtattatgagggtctctagagggacaggaagtttattaagtattaactcacacaatcaccaagtctcacaatagtgcatctggcgggcggagcgaagt

SEQ ID NO: 698118 - DNA, 359 bp, Homo sapiens
agcaattctcatgccttagggattacgggcatgagccaccacgcccagcccctgccctacttttatttttaaaaccgtttatggctgggctcagtttctcatgcctgtaatcctagcactttgggaggccgaggtgagtggattgcctgaggtcacgtgttcgagaccagcctggcccacatggtgaaaccccatctctactaaaaatacaaaaattagctgggcgtggtagagggtgcctgtaataccagctactcaggagactgaggcagcttgaaccagggaggcagaggttgcagtgagcagaggttgcgccactgccctccagcctgggagacagagtgagactccgttgcaaa

SEQ ID NO: 698119 - DNA, 234 bp, Homo sapiens
aacgtggacggggagaagaggatgtcgccatgagcacagcctcccagacagcatccaggagcaaccccaagaatgggcaggagtgctgctgatcccgacccatggcgaggacgggctgcccatgctgcctaaatgggttcagaatgacgaccgccctctttgccatgtgggggtcattaaccatgaatgcaattattaagacaagctcagatgagcaaatggtcaaaaaaaaaa

SEQ ID NO: 698120 - DNA, 542 bp, Homo sapiens
  misc_feature (1)..(1): n is a, c, g, or t
  misc_feature (131)..(131): n is a, c, g, or t
  misc_feature (538)..(538): n is a, c, g, or t
ncccccccttctgtggggggggtggcgccgcccaaaaatttttgtggagaaaaaaaaaaaaaaccgggggggggggaggaaacccccccccctccctggagaggaaaaagaaaaaagggggggggtggctnttttttcttccccccctccaaaagagagggggggtttttttttttttctcccaccccgccccgggttttatattctcccccccccgagagggggggcccccccccccccccttttttttaaaaaaaaaaaccaaaatgggtcccccccccaaaaaaaaaaaaaccccccttttgtttttctcggggggaaaaaacaaaaatctttctttgtgtgagaagggggggttttttttttggggggccccaaaaaattatttaaaaaaaggggcgccccctttcaaaaatgggggccctttgagtgccaaagggttggggggccccgggttcccaccaaaaccctgctcctttgtccaaggggtttaatgtgaaaaagctttccttttgaatggacctaaattggaaaagcntcgg

SEQ ID NO: 698121 - DNA, 143 bp, Homo sapiens
gtagagaggtttcgccatgttgcccagtctggcctccagctcctgggctcaagtgatccacccacttggctcaaaccaccacacccaaccctgaaaagattctaatcttccccacccttctgtcgtcttctaacagccgtata

SEQ ID NO: 698122 - DNA, 256 bp, Homo sapiens
ccccaaagactcttttctccatggtggggtgacaggtccgtagaaggtcgatgtgcattttacgtcgtgcacgaagtggtctattccagaccccaaggctgaagataatgtagaaaactttacttttgtttccagtacagagcatatcatcaacaagaatacaaagctatgttgtcaagagaatatctgatgctgagtcaagaactgatgtagcatgtcctttcaataaattaaatggttgagtgcaatgcgaaaa

SEQ ID NO: 698123 - DNA, 645 bp, Homo sapiens
aaaaaaaaaaaaaaaaaaaaatttttaaaaaaaaaaaaaaaaaaaaatttaaaaaaaaaaaaaaaaaaaaaaaaaaaaaaagggaaaaataaaaataaaaaaaataaaaaaaaaaaaaaaaaaaaataaggggaaaaaataaatttatacagaaaaaaaaaacttttgggtccccttttccccaaccgttttttaattcgggcctcttttttctgggggcccattttggggcttatttggccattttcccttttggggggggttttacaaatttctggggcctgtttttaaacttggtggtttgggcccggggggtccccattttaatccctttgggtcgaataccccttttctccggtttggtctattgccaaggggcccttccctggggggcttttcctttgtggtcatcttttctgggtatgggaacttgtgcgggttaattttttgttctttgggtatctcctttttttttcttaatcttcttctccccttcagggttttgggtgtttttcctttttgttacacgggctccttcttttatagcgcgggtttcttcattcctcgggctgggcccccttttttcttgggggtgggcccctcttctggtgcccctctcctcttttctcttttttgggggggggt

SEQ ID NO: 698124 - DNA, 159 bp, Homo sapiens
actttctgtctgctcctgtgtctaaacagattctctatactggagtcgtggtctacgcccctgctctggctctcaaccaagtgactggttttaatctatgggcctctgtgtttgcaacaggaatcgtttgcacattctactgtagtttggtatgtactg

SEQ ID NO: 698125 - DNA, 174 bp, Homo sapiens
gatggaatctgctggcatccatgaaacaacttacaatagcatcatgaagggggacattgatatccgcaaggcctgtatgcaacaatgtcttatctggaggcaccactatggaccctggattgctgatcgatgcagaggaatcactgctctggctcctagcaccatgaggttaag

SEQ ID NO: 698126 - DNA, 568 bp, Homo sapiens
  misc_feature (45)..(45): n is a, c, g, or t
  misc_feature (563)..(563): n is a, c, g, or t
tagtagagacggggtttcaccgtgttagccaggatagtctcaatntcctgaccttgtgatccgcccgtctcagcctctcatagtgctgggattacacttgtatcctatattttatgggcaagggactaggactattccaaaggtatccataagtgaatatccaatttggaatttcaaaacctaaaagtttaatagataaaagtatttagagtctacttaagtccttttaaatctggaattcagaaggctttgtaattaaaaaaaccctgaaaacctaattacatgaagtcaagatgttaaaatacagaaaaagttaattttgttcatttaaaaatattatttattcggctgggcgcggtggctcacgcctataatgccagcactttgggaggctgaggcaggctgatcacttcaggtcagggtcagacgctcgagaccagcctggccagcacgatgaaaccccgtctccactaaaaataccaaaattaggccgggtgtggtggtgcacgcctggtaatcccagctactcaggaaggctgaggcaggagaatcgcttgaacgtnggaac

SEQ ID NO: 698127 - DNA, 164 bp, Homo sapiens
ggtccatacggcgttgtatctggattcccgtacgtaacttaaagggaaattttcacaatgtccggtagccctttgatgttctgtcaaatgaagggaggaggcatgttcctttaagtttccttgacagacagagagacccagctttaggtggtcaccacatattt

SEQ ID NO: 698128 - DNA, 876 bp, Homo sapiens
ggtcggaggtgggggggggggtgtggagggtggagggagaaggacttcagagctactatcctactattgattctagttccagctggtggaccaactgggtgatccctgccatctctgcaatgggggggggggtgatgtatcgcctatacatggcagaggactgaacacctcctcagaagtcagcgcaggaagagcctgctttggacacgggagaaaagaagccattgctaactacttcaactgacacaaaccttcactcgacaacaatgatcttaatatatggggggctttctcttccgacattcgaaacaagaacacaaagaactcgcctttctcgcgctcaaatttatccaggagcgcctttttattcatctactttatctcgatgatggcttaatggggcaggagcttattattagcacgggcttatgaagtatataggagccgtaagggctcaacagaaaaagacgggccggtttgacccatgcggccagaccccccacccccgtcccctttcgcgcgggttattgcgcggatcctcattccctgaccctgcccgcgctggccactgggccagcccgaaccccaagacactgaccccaatggccgccttccccgcgttcttccatgtatcgacggtaggacccacacacacaacctctggaacaaaacagctcctgcaacgatcagtccccgcctcatcgctcccgtaggcgagcgttatccaacgggcccggctccctctaagacgacggacgaactcgtcctatgtaggaagatggcgacgcgccctgacttgccgaggatcacctgctgtggactgtctgtaaacactgccttatgaggtatctcggtgcgctcgccggcttcccgctt

SEQ ID NO: 698129 - DNA, 1021 bp, Homo sapiens
ttagtcgttcctcctgacatcaagatacttgggtgcttatatcctgatgtatactctgaagaacagatacttatcggttctgagtggcatatacctttcctaccaattattgatcctattttcactcatctctatagatatcccctttatctatcatgactacagcaactattaaatggtacaagacttcagttttaaccgactggtgtggtaccagcagtagttgctacgtaccaccttcccatggctgtttgagggctaatattgctaagacatcttgaatctcccagtgaagatgtctggggaatttgggccagttgtcttccctcttgctcgtttcgttctttcattagattcagctttggcaccatagaccacctccaggatctttgttatgttctggatctccaattgaccaagcatctgcgttttgcaatcaaatcagaagtctcacgaaagcacacagttatgactgcatatctgatgttcatatcctataaaatttcaaggaagattcagagtccatcttctattcgtacatgatgtagacaacattaagctgtccaattcgttagcactaccaaaatcgcctatggattacacgtaagtgtgctcatcttgttgtcgaccaaggttggtatcagcgcggggcctctgtggctcaggcctgtatcccagcatttcgggcaggcccacggtggggggatccacctggagtcctgagtcatcgactgccatgacagcttgtgaggcctgttctagtaaagatacacacgttcatcaggcgctggatgtggtgttactgtgaacccggtatcgaaaggtgggcgggaaatcgatgcaacggccggaagggacagcatgagttcagctggacctcttgttacagcacaagtgtcttccgcccagaatggttgtatctcaaagacgggattatatctttgcactacatatcgtcctccggctacttaatcttctactgacatgagataacatcgtacgtaatatctgttgtctaacg

SEQ ID NO: 698130 - DNA, 130 bp, Homo sapiens
ttgctctgtgtgatcctcctggctggcggtaccaggatgtcaacaggcacgttccccatcaatgaccacctgcttccggtagaaatcctctatagtggggtcgtattcgtccacaaagtggttctggatc

SEQ ID NO: 698131 - DNA, 104 bp, Homo sapiens
tttagaggatccgtgcttaccgtgggcgtatgtgtgtgttagactgggtttcaccatgttgcccaggctgttctcgaatccctgtggctcaagctatctgcccg

SEQ ID NO: 698132 - DNA, 533 bp, Homo sapiens
cagcacgcaagaataagtgggggtctttatactcattcaggaatggtttatctgatgccaggctgtcttcgggggggcctttggatggttggtgaaatactttaattgccctgtctgctcacttctagctatttaagagagaacccagcttggttcttttttgctccaagtgcttaaaaataagttggaaaaaggagacggtggtgtggaaatggctggggagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtcaggtcttttagctcctta

SEQ ID NO: 698133 - DNA, 259 bp, Homo sapiens
tgagtatcccggccatgtggctgctggactgggtggtaacatttccatctgtgctgctcgtctctgacacacacatgcttatccattgatccctgctggttgaggaggctgtgaggccaggaggcccatgaacacatcttgccatttccctcctgtctcccctgtctccctgccctttgggagcaagcacctagtgcggtctggtaggcgcgtttccccacagcgtgcgctcccgtgaactccttgactgggcattggt

SEQ ID NO: 698134 - DNA, 1130 bp, Homo sapiens
  misc_feature (538)..(538): n is a, c, g, or t
  misc_feature (853)..(853): n is a, c, g, or t
atattatatgattctactgatacaacattctagaaggtggaagtctagtgcggtatcagtggttgtttaggggagagggttgggatagtgtacgttatcttgattggtgctggatggttgtcaggggtgtgtgcatattgtgtaaattgtgtgcagatatgtgatattttaaatatgtgcaagaatatgtgtatgtcgagttggtcgcgcggtcaatgagaagtgttttgaaaatagtagtattgcatggatccgatacgcggcacataggtggattattggtcaaagacttgacaacagtgggcgttcgggtctaatgaggacagtggtggggaagggagttgggtagatagtgtatagggagatagtggaggaacgctggacgggatgtaagggaagaccggactactgcgaggcaactcaggcaggaaggacttgacaagacgctatgatgttcgcgagaagtacgagcaagaggaatcgctatcgaggacccaggacgtcggctggtggtgcgaatttggatcaccacacgtgntgtactcctagggcaatgtgcgtggacgcgcacacaggacaagggtgcgtgtcaacactgttggttccagcgagctttagaagaaccaagcctggggcctgttacatttggtgggacaccacgcttgtgcttgaaattaaggggattacgaaagggatttaggcctgaacgaatggcggagtggcacagtgcctgggtaaattttccccgagtgtaacctccgtgggaagggccatggaagacaagacagaaggaagtccatggggggagcgatgagaagggtccttcacagatggaaggcctggaggagtcggntaggccaacttggtaactatccccaaggcctggggagtgggaacagggagaccttgtaatcgtcgtgggtgctccataaacaaggaaaagtcacaagagaaggcaaaagtcccagggccggcggccattgtggtaggggtccccaatcgccgggtgggagtgccccaggccacctcttgcgggactaggctgcccagaggtgtggggatgccactgggaggaaacaggggacgtcacggagaaacacactgctcaagaccaagatatgcgggagaaa

SEQ ID NO: 698135 - DNA, 177 bp, Homo sapiens
gagaggctacagatcatgggcgtgggtctcactatgttgcccagctggtctcaactacagtggctcaaacaatccttccagtactgcctcccgagggtgctggggttataagcgtgaccacagcacctggccacagaggtacattttaaattgtcttacataaacggtgaccaggat

SEQ ID NO: 698136 - DNA, 1275 bp, Homo sapiens
  misc_feature (51)..(51): n is a, c, g, or t
  misc_feature (55)..(55): n is a, c, g, or t
  misc_feature (61)..(61): n is a, c, g, or t
  misc_feature (202)..(202): n is a, c, g, or t
  misc_feature (204)..(207): n is a, c, g, or t
  misc_feature (371)..(371): n is a, c, g, or t
  misc_feature (503)..(503): n is a, c, g, or t
  misc_feature (505)..(506): n is a, c, g, or t
  misc_feature (517)..(517): n is a, c, g, or t
  misc_feature (520)..(520): n is a, c, g, or t
  misc_feature (528)..(528): n is a, c, g, or t
  misc_feature (531)..(531): n is a, c, g, or t
  misc_feature (541)..(541): n is a, c, g, or t
  misc_feature (543)..(543): n is a, c, g, or t
  misc_feature (548)..(549): n is a, c, g, or t
  misc_feature (555)..(555): n is a, c, g, or t
  misc_feature (561)..(562): n is a, c, g, or t
  misc_feature (566)..(566): n is a, c, g, or t
  misc_feature (570)..(570): n is a, c, g, or t
  misc_feature (579)..(579): n is a, c, g, or t
  misc_feature (584)..(584): n is a, c, g, or t
  misc_feature (587)..(587): n is a, c, g, or t
  misc_feature (606)..(607): n is a, c, g, or t
  misc_feature (612)..(612): n is a, c, g, or t
  misc_feature (621)..(621): n is a, c, g, or t
  misc_feature (644)..(644): n is a, c, g, or t
  misc_feature (646)..(646): n is a, c, g, or t
  misc_feature (658)..(658): n is a, c, g, or t
  misc_feature (685)..(685): n is a, c, g, or t
  misc_feature (789)..(789): n is a, c, g, or t
  misc_feature (920)..(920): n is a, c, g, or t
gtcttcttgttagttgattatttgaggcttttaaaacaagtagttcatganagangctgtnggactcaacatagagtagagtaactatctttttagtctggatttctgccctgcttagattttaaaagtataagcatggattgccaattccacttgatgtaaacaaaacttttttttatacataatatatatatatatatanannnnaacttattgtatcagtccaggttcagaaacttgtggtaggccagttccagatagtttcattcacctgtaaactgtatcactttgactgatattgtaattttcaaatgtataatatgtttacagatgtgccctgcatttagtctgccttgttcctattttgattntgttgagtctcctgcctgcttgccaaaagctaggatgcttcaggcccatgtacaattgaaagcagaggcatccttgagctttaaagcattgaacaaactggaaaatgcaacataccacataactgaagtgancnnaagtctgtgtnctncgtgtctnctnacatcaccantnttcanncaagtnaacaanncaangacntataaggtngatcnacngggacacaaggctccagtnngtttnacacgtctncacagttctgctgtgtgttcaantngccttgtgtaancacttgtcgccttagggccagattccnctctctagtcccctttttttaaaattgtcccattttggcttgcctggcaatttttaaacgtttctttcccggtctccaccaagcttcaccacaagaaacaaccnttcctcggggtttggtgaacatctaccagcagggtttgcactccggacgataatactatttctcgcaacaacgcgacaacaacaacaaacacaaacacccaggatacccagacctgaaattgggcgctttnaaaccttttatgaaacagcaaaaacctttgtcattttaacatcattccttctgatagagaacaggctcattatggccttttcacgtaatcttttccccttgtccccaattaatttcccccttcacagggacctacacacgtggttcccacaacagaaagagcccaaacaagacacatgtggttttcccaacatcttccactgtgtctgtggtcccacacagaggcgattactagtgacgagcagctttcaccaccttctttaataagtcctacatcacaacagtgcgagccatttttcacaacgtgcgatatatgcctccacaccggaaaatatcccgtcgtagatcaatattag

SEQ ID NO: 698137 - DNA, 399 bp, Homo sapiens
tcagcatagtttagaaaactcatgaggagaaggaaggcctattttgctgttttctttctttccgatgtcccaaggttccttctttaatcatttcctttccgtctagagaactccccttagcccttcttttagggtagaactgctggtcagagatgtccttagcttttcttaatctgaaactgttttgatcttctccttaatccctgaaagatgtttctgctggagagaggagtctgggctgacaattttcttctgcggcttgaaaagcactgcacaacttctttctgcctccgtggtttctgatgagaaagccatcatcgtcggaattgtttttcctttctaggtaaggtgtcacctttctctgttgctttcaatatattttctttgtctttagtttcc

SEQ ID NO: 698138 - DNA, 680 bp, Homo sapiens
ggagacagatgcggcgctgagccgggagcgggagcgcagctcccagtgagcatggcgagttgcagtggccggctgtgcagagagtggagtctcagtgagcagtggtgctgcgtgcagagtgctgctgtgactgagcagttcgcagtgttgctgtgtggctgctgctgcctgatgtgcctgctgtgtgcatcctgcaggatgcctgtgagcaagctggacgaccccctgcacctgctgctgtaccatgctccccatgactacctggtgatgcagtggcccatgtgaggccttgtgatgcctgtgagcaccctggaggagggccacgcccagtacctgacctccttggcagacgcctccgccctggtggcagctctgaccctgcttctcccaccttggctgctggataccatcatcaatgtgcggtgccacctcgcacctgtgttcccaccgaccctgcctgacctgcctcatagacacctgcaatggagttgcggtggccctggtgctctggagctcatgggtgcagcttgcaggaccatgcaggctctgcgtgcacatgcagtgccagcctgtgttgcggacacccctgcagggcatccttcagctgggccaggaactgaaacccaagagcctagatgtgcggcagtgaggagcatggggccatggtcgaacaaggagat

SEQ ID NO: 698139 - DNA, 103 bp, Homo sapiens
gagctcggatgctggggctacgtggagggcctggatatgaggaggaggatgaggatgaggaggagtatgatgaagatgctcaggtagtggaagacgaggaggg

SEQ ID NO: 698140 - DNA, 1145 bp, Homo sapiens
ttgtggccgtgtttcccagtcggggaaataggtgcttagagttgagggagttgtaaccgcgtggaattgagggccccacgggtttattgttagaacacattgggttagggcccccgggaaagtttttaatgggggcaaaggtattggtccctggtgtctgtggttcgccctggcgtggtgagagaaagtgaaggtgtaaggggtattattccccaccgtgtgtgtgaagagaagggggccaaagccccctgggggcctatgaagattccccgcgccccccttttgggtgttacattaactgggagagggtttaagaatttagtggcccccgaaataggtcccaaccttctctggttatataagatgttaaaagcacccgagagtgggtgtgtgcacccggtggttgaatatgtgcgtgaaatatcccaacccctcttaagttagcagctctttattggtttaaacctcttgggctctatatttaaaaatatggttttataaatttctagagatttatgttttctcttattaaggattttcttataatatttccttatctttaaaatgtgttgtgttgttaaatctcacagatttaaaaatgtgtggttcacatggtaccacggtccccacctcacgctatggcggtattatgagaccacccccaccgtcttccctttatggtataagttggttgaggaaaaaatcgccccctttggttgtgtcacaggctctccccaaaatccccacacacaccggggcctgcacacccctgtggaggttctctgtgagatactcccgagaaagggtctctcctttctcccagagaggttctggctggttgccactccacgaggcgagggagtgacccgctgcttgagaggagggaaagaaatgtggttcacaagagtctactcacatatattgcactcacagagaaggggacgcacctataaatatgagacccccttatacctgttgtaacttgcccacaattgaggaatcacagaagaatgtgtaaaatgcacgccaattatacttattaaatgtaacgttatagaatttgctttttgcccaagttgccaaagttgtaatccaccacatcacggtccctgttaaaatgtattattttgtttaaacttatgtta

SEQ ID NO: 698141 - DNA, 376 bp, Homo sapiens
tcctcatccctagtaactatgtccaggtatacctggaaaaacacacacaggagcacacacacacacacacacacacacgcacacacgcatgcacttatctcccccaaggtcgtgtgccatgtgcttatagctcggggacgtgctgtagaagtgtgccacaagtctgtggcctcttctagcaagctgtatatcaccctggaggagataagagcacgtggacagagtcaaggagacttgtgcatagctacatgatcttggacacaacacttccttatccaggcctaagtgtctagtcttagagctctagcttcttccagttctgaagccctctgatttgatgtctggaaagctttttccacctgtgcccaggtttctg

SEQ ID NO: 698142 - DNA, 97 bp, Homo sapiens
ggttctggcccccctggccctggggggtcttgcttttaacggtttttggaatttaggtgggggccccttaaaaaaaggggcccggttttttggttta

SEQ ID NO: 698143 - DNA, 480 bp, Homo sapiens
ggggcccaatccctcacattctccaagtttgaagaatagaaaaccatcgagaatacccgcaaggtttaccacagtgaatgaaagttcttcagtgcatcttccagggtcggatcatataaggaaattcacgaaacaagatcgctcccattcgttttcatatacccggcactgcaccattgaaacgaatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaa

SEQ ID NO: 698144 - DNA, 1535 bp, Homo sapiens
tcttgtgttgctcttcgttttgcctctctttcgttgttttgtgttttctctttgtctgtgtgtgtgtgtgttgtcggtgtcgtctagaatacgtccagtgttcgtggttgtttgttctcgttttttcgcgtgggtctgccccactggtgggcccccttggctctttttttgtcccccgccctcggcttgttcctcttgcttcggggccttgagttgcaccgctgggggcccccccgtggtggcccttgtcttggacgtttcccacgtcttctggacccttggtcgatggcgttttataacagggcttaccgcacttttccgtggtatctccgactccgggttcaagtggctgctgtgctgatagtgtgccgctgggaaagttttgtgcggtcttcccacaggatcccccttggtgccatacaaccgggcaattttgtaagccaatatgtggtgttgccccgtggtgtctgttgggaaaattgtggtgcccacgtgccccaaaggtagatgggtctcaaggaaatgtgtaggagggtcccggccccaaattagtccctttattaagggggttctatggggccccccaagttgttggttttgggatttgctctactaagggaccaggaggttcccccagtgaggtcgtgtcccagaccacccagtgtgttttataagggtattgtcctggtcagatagtgtgggttcccattggggtaaacagaggtggtgtccaaacccccagggtagtttcccaataaaggtatagggtactccccaggtgatccacagcgctcacatcttagctcccacacacaagggtcccttcttttgtgaacccctcacaaggggataccgctctccttctttgtgtaagctttgttataggtactccccaggtacgccccccctccctttttgtggggtgggaccacaccatatggggcgttgacccatgtcacccctgtgtttgtgcgctgtgtgtggccccctgcgtgctaacacacacacaatgtgcccacgtgggcgctcttgagtacctcacctaccccatgcgcaacactggtatacgccacacacacgtgtgcccggggactttacactgggccactgagccgcacactagcaaagggctgtttatagggcctcgataattgccacaccacctgtattgccgggccgtgaatacactgctggacattgcactgccaagggtggctgtgaatcccgccgcaccgccccaagatatgcccgaggatataataagagaatggagaaaccaatgccccgggaagacctgtgtttcatgccccctgaatgtcttgggaattaaagaaggaggaaccgcgctgggccactggaaaggctggaaccctctgctgactgggataaatgcgtgagcttgttaatgttggccgcctgtctgtcaggtgttcttaaagggattgtctccccttttggttcccttttgtaccacctttggaaaataatctcccagaaacgagctgtgcttgccaagacttcatagttccccagaa

SEQ ID NO: 698145 - DNA, 1002 bp, Homo sapiens
  misc_feature (967)..(967): n is a, c, g, or t
  misc_feature (1002)..(1002): n is a, c, g, or t
gagcgggaagagcagtccgtgcgtctcgcgcgagcagaggatgtgaaccccgtgaacgttacttgtttcactagttgaatccctgagtgctctgacagagtctgagcctcctcacattcataaaaaggaagccatgcgcagagagagaagagacgttcaagaagcccatggcgctctagaggtgtgttgcgagcagctacaataacttggatctcagtgctgtggaagtccagaagcgatctttcagttaatcgcctaaacaaagaccctgtacagtgggctttccggagatttgggtaactcctttccactttgcggtggcatatatttggttatcttacatgcaataacaagggagaattatcaaagtgacctctagtgacggctaatttgactagtgaagggggccaccagcttactattgacgcgcgggaaaaaccattcccaacagtgggggatcacgatacggtgcctggcattaggtgggccaggactggacccttttatcttacacagggggttcgtgagaattcttttccaaattgaaaagaaccttgtgaaggtgtgtaccagttactcatgttctcttgttccctaagaacccatgctaatgaacagaggaagcaaagattagccaggttggcaaccaagaacccacttgtcgatacaactttggtccctttcccacaagcctgcaagaccccatattcctcatttctttctaccaccagaaggttaagccgtccatatctaatagttcctttgcccattactcctcctttatacactgtgcccatggagactgtacagcttagggttcggttactttatgaacattcgggtttagttacaaggtcaccagtgcgtgccaagatttgccatgatggtctacagatatccacgactgtattactcccgtgaagtgtcgtgacaaggtaccctgagtatgggcacatggcaacggcanagtgtcatgtgtctcccggctatacactatatttn

SEQ ID NO: 698146 - DNA, 1005 bp, Homo sapiens
  misc_feature (6)..(6): n is a, c, g, or t
  misc_feature (12)..(12): n is a, c, g, or t
  misc_feature (14)..(14): n is a, c, g, or t
  misc_feature (20)..(20): n is a, c, g, or t
  misc_feature (209)..(209): n is a, c, g, or t
  misc_feature (745)..(746): n is a, c, g, or t
  misc_feature (752)..(752): n is a, c, g, or t
  misc_feature (754)..(754): n is a, c, g, or t
  misc_feature (764)..(764): n is a, c, g, or t
  misc_feature (768)..(768): n is a, c, g, or t
  misc_feature (772)..(772): n is a, c, g, or t
  misc_feature (774)..(774): n is a, c, g, or t
ggtcgnagcagncngttccnttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaanattaattgaaagcctgtgatgtgtgtctgaaggaggatgataaagatgttgaacagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttacgaaacatggatttctgactggaatctcaccactgaaaaaaaagcacacccttttaagactacttttatgaggccacttgtgggatttgtcagaccaagagtgatgctgcttcaaaaagtcatggtggaattgctcggaagttacacagaggcaccaatgcttcccaaggctcgagttgatgccccacaggtgtattggacgaagcattggcaagatccaagnngcattncnttttgaacancttnttantntaaacagtcagttcggaaagtgagcttttcatgaccttaaaccattttggggagtggtaactggcgtcatatgtcaagttagtcagaactagtaaggactccatggatccctgggctggttccagaaccgagttgggcacactggactgcgtgcacttcaaggcgaaggcgtcgcacacatcggacaaccttggacaatcacgggaacttcactggaccatgaagtgcacc

SEQ ID NO: 698147 - DNA, 147 bp, Homo sapiens
  misc_feature (118)..(118): n is a, c, g, or t
caataaagccctgaaacttcttgcgagagaaaagattaaacttctcgctcacaaccctattctggtcgcaatgtagaaatacggtttatagggcaaagccaccttaaatctagcttcncgtcatctatgaataaaagtagtaatcca

SEQ ID NO: 698148 - DNA, 674 bp, Homo sapiens
  misc_feature (320)..(320): n is a, c, g, or t
gggcacagaacagatccattatcccccaaaatgccacataataccccttataatcagccccctccaactagtaatcactgacttgtttgtgtctctataggttggccttttccgtccagtttctttgactcagcataatacctttgacattcatctgtgttgtgtgtgtataatagttccttccttttgtgcagagtagcattccatggtgtgggagtaccacagtttgtgtttaatgagtcactcattgaaggacattggggttgtttccagtttggggtaattttgactaaagctgttaaacatttgcatatagattnttgtgtgtgttcataagttgtcattttttatttcatcttggataagtaactaggagtgggattactgggtcatatggtaaatgtgtgtttaactttgtagaaaactgcaactgttttccaaagtgatgtactattttgattccagccagcaatatatgagagttctcgtggtcctcatgctttgcaacagttagtcattagaattttttaaaaatattaacattctgataggtatgtaagggggtgtctatcgtaggctaatttacactgccctaatggtgaagaatgttggcatattttcgtgtgtcatccggtcttcttggtgaaagggctttgacttttaacattcctgag

SEQ ID NO: 698149 - DNA, 113 bp, Homo sapiens
cagttccaatcggatgagcacgtgtccacagtcatgcagcttcccaggaacatacatagaactcgtcatggtgggagcgagtaattctttccctgtgaaagcactgaagacaa

SEQ ID NO: 698150 - DNA, 1047 bp, Homo sapiens
  misc_feature (6)..(6): n is a, c, g, or t
  misc_feature (12)..(12): n is a, c, g, or t
  misc_feature (14)..(14): n is a, c, g, or t
  misc_feature (20)..(20): n is a, c, g, or t
  misc_feature (209)..(209): n is a, c, g, or t
  misc_feature (787)..(788): n is a, c, g, or t
  misc_feature (794)..(794): n is a, c, g, or t
  misc_feature (796)..(796): n is a, c, g, or t
  misc_feature (806)..(806): n is a, c, g, or t
  misc_feature (810)..(810): n is a, c, g, or t
  misc_feature (814)..(814): n is a, c, g, or t
  misc_feature (816)..(816): n is a, c, g, or t
ggtcgnagcagncngttccnttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaanattaattgaaagcctgtgatgtgtgtctgaaggaggatgataaagatgttgaacagtgtgatgaacagtgtggtatccctactcttgatcctggaaccagacaagcaagaagctttgatctgacaaacgccctaattgttgacaccacggccttgggttccaacatttttccgccgaacgggtggaccgcgccggctctcgagaaatctgggcgtgtgtgttagcgcaactctttctcacagcgggagatgggataagaatactcctgtaagatacacagtgtattgcagccttattaaagtggcagcatcttgtggggccatccagtacatcccaactgagctggatcaagttacgaaacatggatttctgactggaatctcaccactgaaaaaaaagcacacccttttaagactacttttatgaggccacttgtgggatttgtcagaccaagagtgatgctgcttcaaaaagtcatggtggaattgctcggaagttacacagaggcaccaatgcttcccaaggctcgagttgatgccccacaggtgtattggacgaagcattggcaagatccaagnngcattncnttttgaacancttnttantntaaacagtcagttcggaaagtgagcttttcatgaccttaaaccattttggggagtggtaactggcgtcatatgtcaagttagtcagaactagtaaggactccatggatccctgggctggttccagaaccgagttgggcacactggactgcgtgcacttcaaggcgaaggcgtcgcacacatcggacaaccttggacaatcacgggaacttcactggaccatgaagtgcacc

SEQ ID NO: 698151 - DNA, 209 bp, Homo sapiens
  misc_feature (58)..(58): n is a, c, g, or t
  misc_feature (113)..(113): n is a, c, g, or t
gtgcgcacctcgtatccacgctgcagtagttcggcgatcgcccagcgtgcgatgaatncgctaccgcccgtcaccagcacagtctcgctcatgcgactccctcaataattggnggttgtttctccgctttagggagcatagcaccaagcggagaaacaacctccgtttatttagcgtgatctcaggattagctggcaccatggtccaat

SEQ ID NO: 698152 - DNA, 101 bp, Homo sapiens
ggctgagaagtcgaattcagtcgtccttttaatctccgaaactccttgctgtatgtgttgggctgatagtgggcatcctactagcagtctgcacctgcagg

SEQ ID NO: 698153 - DNA, 166 bp, Homo sapiens
aagcactttggtaagagagaaaagacacatggattttggagacaaaagttatcttcaacaaccaaataacattttaacagagcaacctatcaaggaatataggttagcttaggaatcagttagacctggactctagtcctgatgctgccaattaccagctataaga

SEQ ID NO: 698154 - DNA, 404 bp, Homo sapiens
ctggacactgctctgctctacagggttcccatttccgttctgtccccattgtcatctaccagcagtggatgttctttaaatgtaaacagatcagtcaccttgctcaccatcttccagtggttccccctcacttttaaattaacgtcaaagtcccatataatctaactactggcaacctctcccatcctcatcttctaacaccctcacacttgctccctacactccagccacaatgattttcctctcgttcctcaatcatattcctgacacaaaacatctgcacttgccattcctgggcctcgaatgttttatctcccaatcatcacttcatggcacgctttctttcatctctttcaaatgtcacctccccagagaggccttctccaatcactgcagctaaaatg

SEQ ID NO: 698155 - DNA, 157 bp, Homo sapiens
gctagggcagagtctaggagacatgaggtgcaagctgtccagttgttctctttcagtggagttgtacagacagagcttaattttctcagcaatgtatgtatgataacacatgatgaggtattgccacctgccggaagttacctcaatctttggtgtc

SEQ ID NO: 698156 - DNA, 1071 bp, Homo sapiens
gagacgcgcgagcgcaagcagcgggttactggtcgcgcgcccgagctccgcagtccctagccgtagccgcgacccttcctggctcgtccccaccccagcgtcgccgccatgcgcctccgccgttctagcgctgttcccgggtgtggcgctgcttcttgccgcggcccgcctcgcccgatgcctccgacgctgctacgacctcacggacgaccaaccttcgagagtcgcatctccgacagcgggctcctgcgggccctcatgctccgctcgcagtccttcgctccctggctggtggacacctgcaaggagcacttgcaccctgacgctagtgaagcgtgcaagctaaccagagatctaaaaggaatagtccccagttagccaaaacggctggaccttgccccgtgctcaacaacctaaaccacctggtaaatcaacactagtgcgcagtcaagctgggactattcgcaaagcccctttgaacaacgaactacttcccaacgacgccatgtgctcgcacacgaaacgccaaggggctggcatcataagtggcacttggcgaaccccataacgagcaccgtggcccttggcacctcgccgacacagttgcgctccacggcgccagctgttgcacacgcacaggccgggcggccgatggggaaaccccaaaggcctttttcacaacggtggacccccgttcctttgcaaggcagcaacccatggtgcagctgcaaacggccacacctctttattaacacggcaacacacacctgtccacgctacaacgcgttggcatttagaaactcggaatgtgacgcccttcctatacttaacgcttaagcggcattctcacacacacacgaaacgtggaatttcccactgcgccaaggttagcaaggtgtcccttccgacacttccgccggagaagggtatccgccgtataagcacaaagagcccaagtccgacaagggccaacaacccgtttgggaaaggccggcgcaaactacaacccgtttacaaccccggctcacacttcttgcgagcacccccgatctttagcccgaaaagccctgc

SEQ ID NO: 698157 - DNA, 181 bp, Homo sapiens
actcccaggattagtgtccataccccttcgtctgtcatctaccttcgtgtgtcataccccttcgtgtaacatcccccttcgtgtggtgtcatcccccttcgtgtgtacatccccctatcgtgtgtacatacgccttacgtccttcgtgtgtacatactgaagcagttgccgtacgaagggg

SEQ ID NO: 698158 - DNA, 143 bp, Homo sapiens
aagagtgacctgattatgaggtgattagaggatccctagttagtttcgggacgtagtgacgcgcacgcctccctcggagaacctggctcatgcgcgggttgagggcgcagcgcatcgctgctgcgtgccttctggcggctacc

SEQ ID NO: 698159 - DNA, 671 bp, Homo sapiens
agcggacttgcgcatcggggcgcgcggaggtggacccagtcgacctcccctgcagcgcgggcggcgcccaggctcggtcccaggaaagctcccggagggcccagagcgtgggctggggccaggcgggctctggggcagagcagggtgaggcctgttgcgggcctggtctcctcgccgccgtcccgcccggggtcctgggggatgtcgcgtgtcctcctcaggagacagtgccacttccaagaggtcctaagacaaaggggggccagtaggggcctccgggtgggagggagcctgcgcttctccacagacacaactccctcacacagctaccccaggagcacaccctgccggggtccctgtcctggcgaccaccaacactgggcccccaaactccgaacctgtttctgccttggacagagaggcctgagccctcccggcgtgccttcctgccacgttctcattccaaggacatctggctcggcgacccatgtgggtaatctccatcacatgcctgggccaccagggccatgccgttccgcggcccctttaccagcctgggcaaggctggcacctgtggaccagtgaatgggggctgcgatggcagcggggaggttccatcgttagcccaaaacatcctgcacatcagaagttggactattggcggctgactg

SEQ ID NO: 698160 - DNA, 162 bp, Homo sapiens
gtatttgctcaaattatactgtttctttctcactccctttcaaaatactccacttttatttctaactctcaccttgcatgcaggaatggactgtctctattcttgcatagactgtccattcttgcatgtgtgtgctgtgtgctgtgtcatgtgtgtgctgtg

SEQ ID NO: 698161 - DNA, 364 bp, Homo sapiens
  misc_feature (70)..(70): n is a, c, g, or t
atcgattgaaagcagccagccgatcaatagtcctccatccatgtgaaaaaaatcttagaaaaaatgcggnttaaagaaaccaatactctttctttaaaaaagttaaatggagttcttctgggaaaccaagccatgaatgcgagtttgtactaacatagccctgtggaggccacatgtgtagcaatcagatataggagcttttccatgtttgaattccacaaaggaaggcatatacatgatcaattatctgagcagaattctatataggttaagtaagggggaaaaatacttcatgtaaaatattccctttatagaacacagtcgcgctcgtgatgactcgtgtccccatggatacacatgacag

SEQ ID NO: 698162 - DNA, 429 bp, Homo sapiens
aaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattcagggtcactccatgtattttacctacttcagcaatgcaactgcattttggggctttgtgaatcagatttagctgccttgtatagtcgtttgaaacactatgtgatgtgcgagagagttagagtttccttttagaagatcaaactcatcaacagttctttccaaattctcatgtgccacagttcttattgttctgtgtaatcagagattatcgccgtgttccttcatccaagcaattgtttttccttttattgtttccttttc

SEQ ID NO: 698163 - DNA, 518 bp, Homo sapiens
tctagtagttgaaatataataaggaaaatgtctaaaaagttacggcaagtcccacatcagaactctgtaactactactccttccctcaggacaccaagaaggtaagtaaattgagtcactccccatatctaaaaacataatgaagtatcatccttcagatagtactcgagctgagcttagagtaagcctagggaagtctttgcagatcttaaactgggcctcatactaatatctacctacctaccccaaatttcatatgtagctttcttaatggcccaaaaggaccacctctaatacatgaggaaataatcccaggtggggcaccccagtaacacctacaggtaggagatattcaagggtatgcaagaagtaatagtactgtcctggcctcagatgggtgaacaggagaaggagtaattagcaaaggaattagcccactgataaactaggtacggtgtaggcaccagtgccagtgcctttaagctacatgccacagtcatcccttcagaagacactga

SEQ ID NO: 698164 - DNA, 225 bp, Homo sapiens
ccagtccagagtgcagtggtgtaatcattgttttactggtagtttctgtctcccatgctcaatgagatggtcccacctcacgctctgagtagctaggaccataggcatagcaccaccactcctgcccgttttttttttttcttttcttttttctttttttttttttcacagagacggtgtctctcattattgttccccaggctggctttgaaccccggggctcaa

SEQ ID NO: 698165 - DNA, 257 bp, Homo sapiens
tttttcaaaaagaagaagctgggggagcccccccccccggggggggggtttttttcccccaaaaaaaagaaattttggttttcggggccgggccagtttgttccaaaagctgggggctccccattttttcccaaaatcaaaggttttccccggctcccggggcccctgcggtttgggtttgttttggggaaggggatttttcccccccaattggggtttttaatttttttagacccctttttaatagctggccccca

SEQ ID NO: 698166 - DNA, 415 bp, Homo sapiens
caagggggtcagtctggggcagtatttgcttcattcacgctgtaagtcgaaccccgccagaatatcccgatccagcatgctcacccaacggttgtagttgcgatggatcttaccgtccttgtagcccaggtcgcggctgtcgtggtaggagatggcgtagctgttgcgggtgtagcggatgtcgattgcggcgtagaactggccgcgcacggtgatctcggcctgcaccagttgcgggctcaggcgttgtaccgtccactcgcgtttttgcagggcggcgacgatcacctgtttcattttttcttcgctgacctggctcgtggccggcaactcgtgctgggtgttgagcaccggtttgctggtgcagccagccgtggtcagcagggccagcgtgatcagggtgcgtccgtagcgg

SEQ ID NO: 698167 - DNA, 217 bp, Homo sapiens
ggccccaaaaaccccccccccccccccggggggtttggggggccccaaaaatgattttcgcccccccccccccccctcccccaagggggggggggggcaaacccccctttttttcccccccgggtcccccccccaaaaagggggtcccccggggggggttttttggggggggggggggttcccctccccccccctttttttttttttggcccgggga

SEQ ID NO: 698168 - DNA, 946 bp, Homo sapiens
  misc_feature (235)..(235): n is a, c, g, or t
  misc_feature (654)..(654): n is a, c, g, or t
ccttggtgtgtcttatagggctcccactgctccccgtgtgtgcgttcgtttggaaaaagttttggtgatcgcccactgttgagggcgtttaacacaaaactggtgtgcgaccaaaacacctggggtgtaaatctataagacaattctcccccaaatttggggattcaacaaaaggttatattcggctggccgaaaacgttgtaaaaaaaaccggggtgcgccgccgcaaaggctntgaccccgcttggtagtcaaacaatgcaggcctttccctcctgtgctacccctccgcaagggtcctaccagccccgtgcttcaaccccgaagcttccggcgcccatcaaaaaaaggttgttgctagactttccccgccggggaccccattgggttggcgccccagctcgccccttcctcgccgggtctatggcgacgccactctaacatgtgagaccagccacggttataagaggccctgttcattaaaaacccttgaacgcccctagtttctctataatttcgcactggtatccccacagtgggagacacatttcgcggaagatttcttgaaaaaagggagatgaacgcaggggtgagtgactatatttgtgtctccctttccaagcggagattcggaactgtatacggtgagcatanccagcaccccatataggtgctaagacacacggcctgtgaaaaaaacacttatgaggaaatgtcagggggtaacaactacatattatggcacacatccgccaggggttttttgtagcaccttctcaataaaattccctcctctcacttgccgtgatatgagaacatgaagccaatgtatgtataactcagcgagtcccagcgggagttgtgtgacaacaaaacatgcacgtttgctcaataaaataatgcaaaaaaaaaattatgatatgtaatttctgtcccaacaaaaaca

SEQ ID NO: 698169 - DNA, 550 bp, Homo sapiens
  misc_feature (513)..(513): n is a, c, g, or t
  misc_feature (540)..(540): n is a, c, g, or t
  misc_feature (542)..(543): n is a, c, g, or t
ccagtctctccagggactagtatttgatagtatatgatctcttaccttttattttctcataattgaatatgggagatcaggagtcacaaattcctttcttggcagtttctccatctacctctgacttagagttttattaaaaatagccctattcttcaatatttaaagatagaaagtcaattcatagcccttttgtgaaggaacaggtatactgaagaatgctgtaaataatgaataataagcatgttgatcactctaagtgacacaattctgtttgaaagtttaaatacatgaatgtgctgttcctaggcatgagagtctcataagcaactgagatagattgttactagtgtaaaaccaaatattcataaatatttttaatagatgtatgctcctgttagtcagggtcaagattaggctaggaattaaataacatcttacatatatgtagtggtctacttaggtttcattatttctccaggaagacagatggaatttttagaggcagattanatcctttatagttgttaaaataaaaanannatcatca

SEQ ID NO: 698170 - DNA, 140 bp, Homo sapiens
tgtatcctatatctaccgtcttttctcttctttctcttcaaattctcttcttcctatttccgtccctgaacacttgtaaatctgtccttttatgaaccatatcacctgaacctcttttaggttttttttttttttttttt

SEQ ID NO: 698171 - DNA, 136 bp, Homo sapiens
atgcgatctgatgatctcttttatttaatgtgatttcactttgcgatcaagaaaagactttgttgaatagcttactgttctccagtgtttgggaaaaaaatcaccctgcatcactttttggattgtcttgattttc

SEQ ID NO: 698172 - DNA, 251 bp, Homo sapiens
gaagaaccaaatataggatgccccaatagagagcagacaaatctagaggcaattgaatggcaaataagaattgtcttctcagcatggtgacatgagatgctcagctgttaatctactaaaaatatcattattaatgtcattcattttctgtttctttatgttaatagctttgttacattgtgcttgctctctcttaagagtttccttctttgctgtgcaagttacatacatcatcttcagaatccaaatca

SEQ ID NO: 698173 - DNA, 950 bp, Homo sapiens
  misc_feature (63)..(63): n is a, c, g, or t
  misc_feature (104)..(104): n is a, c, g, or t
  misc_feature (107)..(107): n is a, c, g, or t
  misc_feature (118)..(118): n is a, c, g, or t
  misc_feature (127)..(127): n is a, c, g, or t
  misc_feature (151)..(151): n is a, c, g, or t
  misc_feature (157)..(157): n is a, c, g, or t
  misc_feature (160)..(160): n is a, c, g, or t
  misc_feature (174)..(174): n is a, c, g, or t
  misc_feature (186)..(186): n is a, c, g, or t
  misc_feature (205)..(205): n is a, c, g, or t
  misc_feature (266)..(266): n is a, c, g, or t
  misc_feature (269)..(269): n is a, c, g, or t
  misc_feature (280)..(280): n is a, c, g, or t
  misc_feature (291)..(291): n is a, c, g, or t
  misc_feature (318)..(318): n is a, c, g, or t
  misc_feature (374)..(374): n is a, c, g, or t
  misc_feature (405)..(405): n is a, c, g, or t
  misc_feature (413)..(413): n is a, c, g, or t
  misc_feature (417)..(417): n is a, c, g, or t
  misc_feature (448)..(448): n is a, c, g, or t
  misc_feature (458)..(458): n is a, c, g, or t
  misc_feature (780)..(780): n is a, c, g, or t
  misc_feature (789)..(789): n is a, c, g, or t
  misc_feature (796)..(796): n is a, c, g, or t
  misc_feature (859)..(859): n is a, c, g, or t
  misc_feature (864)..(864): n is a, c, g, or t
  misc_feature (876)..(876): n is a, c, g, or t
  misc_feature (933)..(933): n is a, c, g, or t
cctgagtcgactctgcgccgcccgccgcgatggaggccgccgcccagttcttcgtcgagagcncggacgtggtctacggccccgaggccatcgaggcgcaatangantaccggacgangcgcgtcancgcgagggtggcgttctcaaagangccaantantaaggctcgctgantcaagcgggcancgtgaacctgggcctggangccgaaggccaagaagtgttcgtaaccttcaacgcggtgctgcccaaggtggcgcccaaanaantcgtgttcganggctgggaaanctcgtcgctgaaactggccgaagcgangcggcgcgcgaaagtgctggaatgggggctgcaagaacaaatgtggccgcacatgnaagccctgcggccccggccttctgtttaaanccccgaantcancgcggccaaacagagcgcgcgcgcgcacaanctcatcccangctcgcgtgcgcacagctgtgagcagatccgcaggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaantcaagccanaccaaantcaagtccgtgcttgtggacttcctcattggctccggcctcaagaccatgtccatcgtgagtnacaancacctgggcaanaacgatggggagaacctatcggcgccattgcagttccgctctaaggaggtgtccaanagcaacgtggtggacga

SEQ ID NO: 698174 - DNA, 864 bp, Homo sapiens
  misc_feature (151)..(151): n is a, c, g, or t
  misc_feature (161)..(161): n is a, c, g, or t
  misc_feature (244)..(244): n is a, c, g, or t
  misc_feature (246)..(246): n is a, c, g, or t
  misc_feature (305)..(306): n is a, c, g, or t
  misc_feature (330)..(331): n is a, c, g, or t
  misc_feature (339)..(340): n is a, c, g, or t
  misc_feature (351)..(351): n is a, c, g, or t
  misc_feature (357)..(357): n is a, c, g, or t
ggtggtcactgtggagaagcgggttcctcctccaacaccaaggctgtcaccacatttcaccatcactgtgcgtcccaagaacgcagcgctgggtcccgggagggctcagtccagcgagctgatcctcaaacgatgccttcccatccaccangcagcacaantatgccgcccctctccctacgtggagagtgaggatgcacccccacagaagaagataaagagcgaggcgtccccacgtccgtcnangagtgtcatccccccaaaggctaagagcttgagcccccgaaactctgactcggaggacnngtgagcgtcgcagaaaccacacanntcctgganngccagcgccgntacgancttcggtccagctttctcacgctcagggtaccacgtgccggagattcgtgtaaagaatgagaagtgccgcgcgaaggtggtcatgtgtgatgacaaggccactgagtatgtccattcccctcctaggccagaggagctaccgaagcttttgctggtaacaggaaaagatcgcaggcaagacagcggcagtcgctaacgaaaattgaacaggctcggactggctagacgcttctcaaaactggacaggtcactgccactttgcacattgtgattctatttctagacagagcatttgtgttgaccgttccggcactgtcgtgcttcacttgtcacacatcggtcccctgttcggcgtacggtctgcggtgggcagtaggaccaccagtgtgggggtcctgctgggaccttggtgaagcttggtcccaggatgcttgggtggcctgggctctcacgtcaccccctgaccggccaacgtggcccgtggagcccgggcgtgaccctgtgtgt

SEQ ID NO: 698175 - DNA, 123 bp, Homo sapiens
ccccttgagccaccggacccagccaatttttcttattttaaagactattttattaaatggctgggtgccgtggctcaagggtggaatcccaacactttgggagggggaaccttttaaagtgaa

SEQ ID NO: 698176 - DNA, 170 bp, Homo sapiens
ctggcatctgcctccagccacggatctgccagcatgccctccttccccagacagctgccagagaaccattcaggaaacacagtatctgctcgtggcacgtgcccgtgcttcaccgtacactgcctgtcaaagtcatggtccagttctccatagggcaaggcacgacaggg

SEQ ID NO: 698177 - DNA, 774 bp, Homo sapiens
  misc_feature (151)..(151): n is a, c, g, or t
  misc_feature (161)..(161): n is a, c, g, or t
  misc_feature (244)..(244): n is a, c, g, or t
  misc_feature (246)..(246): n is a, c, g, or t
  misc_feature (305)..(306): n is a, c, g, or t
  misc_feature (330)..(331): n is a, c, g, or t
  misc_feature (339)..(340): n is a, c, g, or t
  misc_feature (351)..(351): n is a, c, g, or t
  misc_feature (357)..(357): n is a, c, g, or t
  misc_feature (742)..(742): n is a, c, g, or t
ggtggtcactgtggagaagcgggttcctcctccaacaccaaggctgtcaccacatttcaccatcactgtgcgtcccaagaacgcagcgctgggtcccgggagggctcagtccagcgagctgatcctcaaacgatgccttcccatccaccangcagcacaantatgccgcccctctccctacgtggagagtgaggatgcacccccacagaagaagataaagagcgaggcgtccccacgtccgtcnangagtgtcatccccccaaaggctaagagcttgagcccccgaaactctgactcggaggacnngtgagcgtcgcagaaaccacacanntcctgganngccagcgccgntacgancttcggtccagctttctcacgctcagggtaccacgtgccggagctgggtagaacgaactgacgataggccagtcaacggtcggtcacttttgaacaaacggccacctgacgtagtgtccgactccgctccatgcgccgagtgagcatccagcgttttgcctggacataggatcaaacttgcaggtcacagacagcaagcatggttgctagagagagaatattgagacacgtctcgtgacttgactagcacgcgttctcgacatgctgggacagtcatcttgccacctttgccaccattttgagtttctctcttggtaccatgcaagcattcgtgtctgaccttcacgacctggtgggttgtacttctctgatgtcggtcccctgntcgatgtctcggctctgcggtgggccagtagg

SEQ ID NO: 698178 - DNA, 421 bp, Homo sapiens
agcggactgttcctatcacatcacaccccagcaaatgccaagctgtgcgggccttctaccccatttccactatttgcccccgcgcgcggcttttgctccccgcgcgcggcttttgctccacgccgcgcggcttatcgcccgcgcctccgcggcttttgcagctttttacccccgctgccgctgcttttgcggcttttgtcagcgccaccgctgcttttgcccccgcgccccggctttttgcccccgcgccgcggctttttgctcccagccgtcacggctttttgccgccgcggctttttgcgtcttttcgccccctactctgcggctttttgccgccgcgactttttccacggccgccgcggcttcttcccccgccgcgtccttttgccccccgcgcgaccttttcccgcgcgtttgtgcc

SEQ ID NO: 698179 - DNA, 109 bp, Homo sapiens
tgaagaaattcaatgaagcgcgggtaagcggggttggatgcagtcagcggcgtaggatgcagtcagcggcgtgggatgcagtcaggggctttggatgcagtcagcggcg

SEQ ID NO: 698180 - DNA, 351 bp, Homo sapiens
atgaaaggttcctgcggcgtcaggccccgatgctggctacctgtagagacctgcacttctatagccagcctgaagatctgtaagcttcctgagggagctgattcaccactgtgccaaggtgacacaacccaaggcacacattgaccctgacttctcccagaccccatacgcgctgggcttgagctcgacagcaagcgccgaggacgtttgctggagaattctcctgtgcctgtgagtgactatgtgtggaccagtctctcactggcccatgctcttgttgacagaccaatctgtgaccacgagtcctcccacagaagcctgctgcttgttctgagtggtcagaggccgcgc

SEQ ID NO: 698181 - DNA, 170 bp, Homo sapiens
gtcgatgcgcgggctgcatcaaatgagtccgtttgcaatgacggcaccaaattctagaggcttgtgtacaggagagggggtgtgagcagcgcttgtgaagctccagactctcgggtcctaatgggcccattgatttttatttcaatactgttgatggaagcgtcgcgcat

SEQ ID NO: 698182 - DNA, 242 bp, Homo sapiens
  misc_feature (56)..(56): n is a, c, g, or t
ccccccggaaacccttttttttccgggccttcccggaacttttttggggggggccnaacccggcccttaagggggtgggttggttgaggtgggttaaaaggccccaaattaaagggttttttttttttccctttttgtccaagagggggccggtttttttttttggcccgttttgggggtgggggaaaccaaggttgccccccctaacccgggattttttttttgtggggtgtttttcccca

SEQ ID NO: 698183 - DNA, 150 bp, Homo sapiens
atcagcttcctttggactagtctcttagctaagacccacaaatacatttcgaacactttacctattaattacgcccattactggagtcctcagccaccacctcctaaacctccctctattcccacccagtcgtgcccatcccacctcaca

SEQ ID NO: 698184 - DNA, 119 bp, Homo sapiens
gcccctatggaaagggtgcaacccgcctaccatgagttactattaactgtattagtaggtatggtgtagtccatacttcagcactcgtaaggagtactgctagctagaatgttagaggt

SEQ ID NO: 698185 - DNA, 469 bp, Homo sapiens
ccacatgactcagcctccataatcacattcctttaaggctcaaagtaatttaaagttccaacaacattgattctgaattacttatttttgtagacccttgcaaatgcacccacaggcagcagattgctgggcacacagccatctggggagtggacctccactgtcgctgggcccactggcattggggacagcatttacatgggagagaaatcagccactgtgtatgcattgttgcaggttttcttttgctcacagccaaacctaatcctaactcatacaagtgggaagttgtgatcagagggagaatctagtctgtagaagcattaaatggttaagttagcaaattgaggagaaacatcacaggttatttatttatttagagacagggtctggctctgtcacccaggctggtttgcagtgagtcgagactgagccattgcgcttcagcctgggcaacagagcaagactc

SEQ ID NO: 698186 - DNA, 350 bp, Homo sapiens
ttgttcagctgaatagcgtcatctaaattacagataaggcaacttatgcgaagcctaaatgcccgatttacttctttggggatccagatattaagttagggcataacgcataaaatggaatgcacagctgttggcttctaggaatacaaacaggaggacataacccgagggcggctaatgtcttagcgattgggcgaagtacttcattcccagctgtgtgttaatctgtcttaccaaacaataacaaactctttatttatgacagaggctgagaaattccatttgtgcccagcaaaagttaaaagcacattaggaaatatttgcaatgtcagattcagtaatttgtcccg

SEQ ID NO: 698187 - DNA, 380 bp, Homo sapiens
gctcaacactgccctgatcacggcaacacgatctgctggttgaggagagtcgaagaatccccacagaagcatcgcaagtgctacgcagctggcagcagtagccaccagacacgcccaggattttttttgatagggagggggtgtggcgggcatcatgggctctgggaggggaaaacgtcgtcgtatggcaacggatcgatgcccacgtgcacgatcaatcttttcgggggaccttgaaagccgcttcgagttcgccgacgcccgtgctgctgcatgagctggaagcgcccagctatctcttcaggctcccgcctggggcccatgcaagatagaggcgtaagttgtctcccggggaccccgcgtccaatttggtaaatcag

SEQ ID NO: 698188 - DNA, 483 bp, Homo sapiens
  misc_feature (92)..(92): n is a, c, g, or t
  misc_feature (108)..(108): n is a, c, g, or t
  misc_feature (313)..(313): n is a, c, g, or t
  misc_feature (366)..(366): n is a, c, g, or t
  misc_feature (384)..(384): n is a, c, g, or t
  misc_feature (390)..(390): n is a, c, g, or t
  misc_feature (397)..(397): n is a, c, g, or t
  misc_feature (422)..(422): n is a, c, g, or t
  misc_feature (430)..(430): n is a, c, g, or t
  misc_feature (466)..(466): n is a, c, g, or t
taagagacagggtcttcttccatcgcccgggcaggagtgcagtgggtgccatcatggctttgtgggtaggccttgaagctcttggggctcangcagtcctttcacctnagcctcccgagtagctgggactacagacgtgcaccaccatacctggttaactttttaatttaaatttttgtagagatggggtctcgttctgttgtccgggctggtctagaattcctgggcctcaagcaatcctcccgccttggccttcttcaaagcagtagggaatacaagcatggggccaccgtgcttgaatgggatttaggantcataggaggggggcaaaaagatccatgagggaagtttttgttttcttctganttttgaagtttgctggtnacattngcagggnttttcttagttttaggaggggatgntccccgtntcacttgtttaaggaggaggttgatgcccggggggnaacaggtgggggaaggg

SEQ ID NO: 698189 - DNA, 298 bp, Homo sapiens
  misc_feature (30)..(30): n is a, c, g, or t
gtctactattactattatattctcggccgnttgtctatatgtaaataatttaattctctttgtaggcttaaaagctgtcctatttttaagaaagcgttctaagctcattacccattacctaattaatctcaaacatataactgatctcctcacacccaattggaccaatctatcaccctatagaagaactaatgttagtataagtaacatgaaaacattctcctccgcataagcctgcttcagattataacactgaactgacaattaacagcccaatatctacaataaaaaaaaaaaa

SEQ ID NO: 698190 - DNA, 259 bp, Homo sapiens
cagatgtttggatcaggacctccccaatgggggcaactgccgctaattaaaggttctgtttgtttccaaccattaaagtccctaccgtgatttgagttcagacccggagtaatcccgggcggtttctttatacttaaaattccccccctgtgggaaaggccaaaagaaataaggcttattttccaaaggcccttcccccgtaaatgatatcattcccaacttagtattatacccccccccccccaagaacagggtttta

SEQ ID NO: 698191 - DNA, 244 bp, Homo sapiens
gtcattccaaataataaatagcgatagttacagagaagtcacctatgcaatccataaaagccaccccaattcatctctaaagagaatgacccaatcctctcccaagtccacacagggaagagtgatagcattgctttcgtgtaaattatgtaatgcaaaatttttttaatcttcgccttaatactttaatatattgaatatatattgaatgatgagccttcgtgccccaccttcccctccaaca

SEQ ID NO: 698192 - DNA, 789 bp, Homo sapiens
  misc_feature (531)..(531): n is a, c, g, or t
actatcaaatgaaatgaaagctaagaataaagatgtaaaagatacagaaaagaaatgaataaaattacaaaatttatgaggagaataaagaaaaatttacacagctagattggaagatgttcaagttagagaaaagttaaaacatgccacgagtaaagccaaaaaactggagaaacaattcaaaaagataaagacacgggtggaagaatttaaaagtatacctgccaaggagtaacaatatcattaatgaaacaacaaccagaaacaatgccctcgagaaggaaaaaaagagaaccgacgaacacaaaacttacaggaagttatggatagccttaaacaggaaacacaagggcttcagaaacgaaaaacggaaacgtcgagagaaagaaccttatgggtttcagcaaatcggtaaatgaagcaacgttccaacacgatggatgtagcccagtcagaacttggatatctatctcagtcgtcataatactggcagctgtctcaaattaactaaggctaaggaagctctaaatnggcaggctttcctggaaggacttcttcaacaggaagtggacaaagctggcaattccagaggattttaagaacggaaaacttcccttcaaattgaaaaaacacacatgaaaaaaaaaaattttgtggggcgcgtccagggccctaaaaagctttttaacccattcttggggcgcccggcccattatgttatgccacgctcgccacgcggtcccaagaaacctggccacactggcggggttccccccataaaaacccggg

SEQ ID NO: 698193 - DNA, 995 bp, Homo sapiens
tgtggaaaaataatagggactgtccttgtcaccatgtagatcagcgtcgcccattttggcattccggccggtcggggagcctcccagtctgcgggcatgaaggcgaggagcgagggcgagagcttcgcgggctcggtggcaaacgtggcactaacgagttggctgggtggtagactgactcgcccgagcatccatatctggggctgtctgccaagcagcaggtttaacaatgctggatgccttcggtagcctcactaagcacaggtgggtgccatgtctgacaggcactatcccgcagactagctccctctaggcagcaggtcccatgttttgctatcaggatgggtacacgggtgcgcttgcctagcccgaagactcaaggatcccgagccaagcgaggaaatccgaagtcgatcttggggagaccgcccagatcatgtccacaggttctccagcgtccaggaatgtctggttgtattgacaccactggcgtaatcgacaactttacctgtgcccgacggaaacacgtcccgtgaatcaactctagaactagcctagtgttcaattcatcatcgtcccgtgccaaatgatcaatcgcacctaatataagtgcccataaggacctggtcgtgcttctaggacacaaggcctctagggtgtatgcatattccaggggttgcccacattcaaggaacctggcgtataatagagcactggaaagagaccaatggacgcgaggcattttgaacaaagatttcatccccgggaagacgaaaatccccattcagtggtcgaagtcgtgtgggcagtggtgcctttaggccggaacacgacaattctggaaccacgtcacatgcgggtgcccacaccggggcggttaaaggccttacacagtgttaagaccggtcgtggacttcccggttgccgaaagcaaggaggcttcaaacaaggactggagatcactcggacaggggccttcaatgcagaaaggcgag

SEQ ID NO: 698194 - DNA, 416 bp, Homo sapiens
cggcaggcaggtctgtctgtagagacaagacttcctactgacatccaagctactcgttgccacagctgctccaaggatggcaataatgagtgcgagctgcatcagagatgagagattgaactttaagaaaaatgtcgccgggcgcggtggctcacgcctgtagtcccagcactttgggaggccaaggtgggcagatcacctgaggtcaggaggtaaagaccagcctggccaacatggtgaaaccctgtctctactaaaaatacaaaaaaaaatgggttgggcatgtgggcgcacatctgtaatcccagctactcaggaggctgagccaggagattcacttgaaccggggaggcagaggttgcggtgagccgagatcgcgccactgcaatccagcctgggcaacaagagtgaaaccc

SEQ ID NO: 698195 - DNA, 172 bp, Homo sapiens
cgtctacgactgactggcaggtctcgcatgaatttgccttgaatttcaaccccagttaaccctactgtgcaggcatcagggcattgtggatgcctaccgccaagccctgccccaaatccaaatgcagggaacagcttgtctgagtcatagtcctaagccacggtcaacccac

SEQ ID NO: 698196 - DNA, 425 bp, Homo sapiens
cacataggggtgagcttggtgtgcacagaagcaaaaaactgagggcggtgaactgctgcctagatttcaaatggtgtgtcgaaattgatagaatctcaaagaggaactggctgtaagaaaaggacactcattgaaaaactgtagtactgcatggcaaaaagaaaaagagaaaaatatatcaaattaaactaaaactctccatacttttaattagtgcgccgttagacccataaagatcttggtggccgcctaggccaagtcggctttagattttagcaagctattgcatgcgcccgcattttggggctctttggccaattcccccatttgtgggtctaataaaaatacacgggacgacgtttaacagccggggtttggcccttgggctccctttatccccctggcgggacttccccttgccgcct

SEQ ID NO: 698197 - DNA, 463 bp, Homo sapiens
catacaacgcctcagtggatccagcaacatcttttgagcctggagcttgattggggcccttggattctttggggccttgcttctctttctgtgccagacttctctatggtggccgtaggtgatgcttctccatgcgcatttccagccactacaaggtccatgccccagctgggatccttcttcccaccaagcactaacctggggtggccgtgatccgaccagttacatcggttggcacccgcaatggtcccggggctgaagagattgtccggggagttccctgggccgtctcgccggtttggcttccgggcagcgggtttcgcgcgctacgttgttcctgtcgcttgcgctgcgcttggccgtgtgttgttacacgttatcgtgcccgccgtgtgcgtgcgtgttcgactgtctttctctcgctcgcgtcggtccgcttcacagtcgtgtcaccggcgtcccg

SEQ ID NO: 698198 - DNA, 232 bp, Homo sapiens
tgctaattctatacccagtcaaaccggtcatcgtataagacatcactgaagatatcaaggtctgggtctaacatatacctcccatgcatcctctctcaaaaaattattggaaaactgccctccaggaaaagaacactccagacaattagacgtatccaacaacaggacgacgacagtgacagagacattcccagggtaagattcccggattctaaatacgctgatgccacac

SEQ ID NO: 698199 - DNA, 618 bp, Homo sapiens
cactcgaccttactatcagacaaccttagacaatccatatacccaaataaagtataagcgatatgaaattgaaacctggcgcaatagatatagtagccgaaagggaaagatgaaaaattataaccaggcatagtatatgaaggactaacccctataccttctgtataatgaattaactataaataactttgcatggagagccaaagctatgacctgagaaaccagacgagctacctaagaacagctaaaagagcacacctgtctatgtagcaaaatagcgggaagatttataggtagaggcgacaaacctaccgagcctgttgatagctggttgtccaagataggatcttagttcaactttaaatatgcccacagaaccatataaatacccttgtaaatttaactgttagtgcaaagaggaacagctctttggacactaggacataaccttgtagagagagtatgtaacacccatagtaggcctatatgcagtcaccaattaagaaagcgttcaagctgaacacccactacctacaataataccatacatatctgactcctacactcaattggaccaatctatcaccctatatgagaactaatgttagtatacgtctg

SEQ ID NO: 698200 - DNA, 1627 bp, Homo sapiens
atgagtgtgatgatacatggcggattgaggaggatgatggtgaatgggcatgacgctatgagagattgaactgctagggggttgccgtgtcactgatgaatagagtcgcctggtcggtaccgtattatgaaccagtgacccccgtagttggtgagtcgaataagacaacactatgaccgatttatagggggagcacaccgtattatagggaccttctccgatagaggtgatgctcccacacacacaggtcgtggctgagccaacacaatagaaagacaacggcgccgtgtggtgtgttgaagatcgtgcggcgggcacccacgtgattacacttattataccgggtgtccctaaaagggggtatactcgaacgtccccatctgagatttggtccagaataatgttccgcgcctaacccgagatgagggggttgctctcacgcctgaaaaggggtgcgataatgtgacctggtggcggttgtggaatcaatcaacccgggacatcctcaccgggagcaacatcacgcaagggttggttcacaaatccacgcatactgaggcactctgtacaaattgtctcctgcgcgcgcgggacacacacgtgtgagagcaggacacagggcagtccccccccggagggggcgtccactctgtctcgcgcacgcgcgggggacgacaccaacgaccggagaaccggggcacccccctccggatatgggcaacgggggccccacctgtaaaataggtggtttttgtgttgctttgggggaaagtagccgggaggctcttctttatgatgggtagtaaaaaactgttggcgccttcatcctggagattccaaagctggtaacacccacagacccccaagtggcactgtttttccctcggaaagagaataaatatgttccccctcatactcgttatttgttgacccacacattgatatttcgtggccacaatgggtttaatgggttatagaatgtgagatgaatccgcggtgaaaattcttgtcggccttatatgggaattaacacacgctgtgaacacacgaaaagattattgagccacgaggttatcgccccctccctgattcctatgtcccgccaacacagaatggtgttgtctgttaaattgtgcgttgttctccctgtgtgtgagagtctctctgcacatcacattgtgtgaaaagtggtcccggggcacaaaggtggtatatctcctgaaggttctggcacacccacgtggtctccacaaacacactcccactcacttcctaagtgggagaatataaacttgagttcttaagggagatgagatataaagaacaccgcgttgaagagaaactgaaagagaagagaagaaagctgaacttcccactcaccctatttccccacgaggttttagaccctagtgctaagagagaattggtgctgtgaaaatatacctggagtgctcggcgctcacccgcgcgtaggcctcaagaaccagatgtttgacgaagacgatccggaccatcctctgcccccctcccctgaaaaagaaggaagaggaaatgcctcgctgttgtaaaagtttcagcccctcgtttttggtcctgtccccttggaacccttgtacgcaattgctca

SEQ ID NO: 698201 - DNA, 91 bp, Homo sapiens
gcctactactactactactgctcgaattcaagcttctaacgatgtacggggacatgagcaaaaaaatatgaaaaaaaagttgtactgcacc

SEQ ID NO: 698202 - DNA, 319 bp, Homo sapiens
  misc_feature (14)..(14): n is a, c, g, or t
ccctttttgaagantccggcagagtaaggtcccactgattcttgggattttccttactaccagctttagagtctgctttctcagatctgttaagtcagttaccacttactcatctgcttttcagcttccaaaattaattttattgctgctgattcctctattgtttttcctgttcttgtgttttgtgctttaaaaaatgctattattttagctttagcgatgtctctaagtgggtgaaagaggtatgtgaacaagacccccatctttgcccagatgtcctgatattatttctcccttactaagcttttaatgagtattg

SEQ ID NO: 698203 - DNA, 782 bp, Homo sapiens
  misc_feature (13)..(13): n is a, c, g, or t
  misc_feature (114)..(115): n is a, c, g, or t
  misc_feature (122)..(122): n is a, c, g, or t
  misc_feature (130)..(130): n is a, c, g, or t
  misc_feature (168)..(168): n is a, c, g, or t
  misc_feature (170)..(170): n is a, c, g, or t
  misc_feature (172)..(173): n is a, c, g, or t
  misc_feature (179)..(179): n is a, c, g, or t
  misc_feature (201)..(201): n is a, c, g, or t
  misc_feature (204)..(204): n is a, c, g, or t
  misc_feature (230)..(230): n is a, c, g, or t
  misc_feature (236)..(236): n is a, c, g, or t
  misc_feature (238)..(238): n is a, c, g, or t
  misc_feature (245)..(245): n is a, c, g, or t
  misc_feature (259)..(259): n is a, c, g, or t
  misc_feature (264)..(264): n is a, c, g, or t
  misc_feature (268)..(268): n is a, c, g, or t
  misc_feature (271)..(272): n is a, c, g, or t
  misc_feature (275)..(275): n is a, c, g, or t
  misc_feature (285)..(285): n is a, c, g, or t
  misc_feature (294)..(294): n is a, c, g, or t
  misc_feature (304)..(304): n is a, c, g, or t
  misc_feature (308)..(308): n is a, c, g, or t
  misc_feature (332)..(332): n is a, c, g, or t
  misc_feature (340)..(340): n is a, c, g, or t
  misc_feature (367)..(367): n is a, c, g, or t
  misc_feature (394)..(394): n is a, c, g, or t
  misc_feature (403)..(403): n is a, c, g, or t
  misc_feature (421)..(421): n is a, c, g, or t
  misc_feature (751)..(751): n is a, c, g, or t
cagctcaaaatanggcactaacatgatgagcatgcatgggctttggggggtgctctgtggtcttatggtgatctagaggggcgctgtccattagggctttctgtgatgatgagnnggttctncttctggnctattcgatggggtgaccgctaatcatgcttgggtctngngnncttggnttgttgctggtgtggttggggnggngggttttgggtgttgactggtttggntttggntnttaaggngttacatgtgggtngtggntgcngtnnggnggggttcggngctgggttnttgctgtgtnctcntgttaggcatactcgtggtctctnctactctnccttcatcgcgcctgtgacttcttgcnatttttttttgtttgtgtcattttctnatgtgttcntcctgggctctgggctcngggtgggcggatgctttgtctactttgcgattgctgtgtccccagtgcttggcatgggagctggtgcagagtaaatacatcataaatattttgtgaatgaatgaatgaatgaatgaccatgattaataaaaggatatagctgctcagtctggtgctgataatggtggtagtgatcaaaagggttaaaccacaggtcattaaatgaaaacagctaacttagtgcttacaggaaccatacactccctgtgtataaacatgccggtgtgtgtgtacaggtgtgtgtgtgcaaaagcataataatgtgtttgcaaaggtttgcatttgtgtagncatgtgtagatatgtatgcttatgtgttttt

SEQ ID NO: 698204 - DNA, 842 bp, Homo sapiens
  misc_feature (197)..(197): n is a, c, g, or t
  misc_feature (226)..(226): n is a, c, g, or t
  misc_feature (323)..(323): n is a, c, g, or t
ggtcagtgaccgtaaggcaggagaccggggtgatggtgttgaaccggtcaggggatgtggcaggaaagagtgtgactgctgccctcggctccagaaacttgccgtgattccgtgagagccaatgacctgtggagcgaagtcgtgcgtgcccgttgactctgctcacatgtgactagtataccgtccataacactggntgcctcggtttgacattcaggtcgaacgnttacgagcacgtagagtccaacagactgttacttgtgctcacatcgagtggtcatcgcaagtggcgtgtcagtgtggctcattgtgcatcgcccgantgacagcctgttgaccagtgacatgatgcgacgaactgtgcacacgtagtctacaggacagcgggtctacgtggcacaggagaaagccaccgaagtgcaacctgggaacggcagacaatggggtgctcacgactattccgcagtgcgacatatacaggcacgtacgtgatcttaacgtgcgagtgaggatccaaggaacgatttacgctctgaacatggacgtgcgactattggatcaatggaagcctctctgcggatgagagatcaggaatgactgcgcgaaggtgactaccaagccatcactggaaacactcatggtggcataaggtcgtgcacgcatagtggtagatggcgcaatactgcctgacgaggcccgcaaacgggaaccatgatgcgcactgtgccggaacattggtggaactcaagttcaggtgtgacagctactgcagactgcatgcaggccaaacgggcatgtgatgtggcttccacactgggctacctgtgatggtgagtgtggaa

SEQ ID NO: 698205 - DNA, 274 bp, Homo sapiens
tttcccctagggcccccaaaccccgcagttgtggaacccgtgaatcctccccaacgcctggtttccaaatagcacaccccaaaaccctggttttggccgttcgaatatgtgaaaactgacctgtccagggaaggccaaaaaagactgtgggattctggggcccccccaaaaatgggttggtttccagtgtgccttggggaacaaaaggggcaagtaaaaaaccaaacctcccaaccataagttatagccattcagggccccctagcagggttta

SEQ ID NO: 698206 - DNA, 333 bp, Homo sapiens
tgtgttcacaggatcttattgtgtggtgttatggttgacactaatgtagtcgagcatagccatactacaaaacatgtaaacgatgaggtaaagccctacacaaaaacacacggttagtttgcctacaaaatgagcacacaatgagtcacaaacgtttttagggtttggttttgaaaacacgaaaacaaacgcaagatcaatttcccatctatgatgcatacaaatatggacaaacaaagcctatctcgttacgagtttgggttgctgatgacgaggtttgcatttcactaagtccgttaggggattcgtgtctagtcataacaccacacaatt

SEQ ID NO: 698207 - DNA, 1520 bp, Homo sapiens
  misc_feature (57)..(57): n is a, c, g, or t
atgggtagacccacgcgtccgcccacgcgtacagcagagacgcagcatgggcgccgncatgcgcgacggagccgccgccactgctctgcaacattcatgcaactggacagcgcccgcgcccgcgaacctgcctccagttattccatgactcacagaggcaataagcacgacctaccagtcactgacgcccagataactatgcaagtgcccgccaatatcctatccggctatcaacacgcgacctggatctcgaccgcacaacgcacctagctgcgcgccgctaggccacgcccgcgcatggccgaccgagcccacacacgcgtccgtacagatagactcagcgccccactctccaccgccagcgacagaactacctgcggcacacaaggctggcacacctctctaggtcccacccgtaccctaattcgtagcccggaatcccacccacttcagacacatcgaatagcgtccgcggccgcacctcgccatccacgcccgggcgcatccacgacacgcacgccctagcacatccctcgccctcgcgcacacccacaggttaaccccgcacccccggcgccaccatgacggcccactcgcgacgcaggccgcaataccgagaccactgggcggcaccgccaagccccggccgcaccaccctctcccctagtccggaccccgatcgccacacacgcgaaccacgccccacatacgcctagcacaccactgtgccctagcacacactgacacgcgcaactcacgatcccgacgaacctacacgacggttcatgcgcccccacgcccccgaccaccgcaacgccctcatacccctattgaccacggcccacaccccgatctacagccccactcccccactccgagccacccctcacaactcacacccactcctactccacacccacaactgcgcccaatccatacatccacctcaccaacacacaccccccctcccccctctaccaacaccacagcacaccacccagccccccaccccatccctccacccccacaccacccctcaaaaccccactctctatcaccaccgccctcaagcggcgggccgcggcacgacagacgccacgcacactcgaccgagcagtcgccgccgggtctcgcgcgccggagcaggagccagcagcccggtcggccctcccccaccaccccgcgcccgcgcccgcccaccgacgcccacgcccacctagcgatacaacaacctacagcatcgaacctcagaaccccatatcactcgccacctcccacacctactgccaccagcaacagcactactccatcaaggccacactatcccaaacgatcacccacaacctctccaccacgcacaccgaaccaccaccgacaatacactacccagaccaactactcacgctacatccaacataccaactacatcaccacactcacacagcccgatacatccacacacactaagtcgtatcatcccactcatcaagacaagtacaacaatacacaaagcacatcat

SEQ ID NO: 698208 - DNA, 192 bp, Homo sapiens
atcggcatggggtcctgtagcactggaagtatcgcatgttgctaatgacaattgccatgatgatgccgtagataggcgcagctatacagaaggatgatgctggtagtggtagagcattacgggtaaggagtggcaaggcgaaagaaatgagaaagaaaccgtccttcctgcacagtaagtaccccgcaaatc

SEQ ID NO: 698209 - DNA, 360 bp, Homo sapiens
tacccctttctcccagacaagggtaggcaacataccataatggctaaaaacatgatgaagaacactgaaactcacttggctgtgacaccttgagccatttctctgtgcctcagtttcttcatctgtgacaggaggataataataatacttatccgtattagttgggtctacccagaaacagacaatgagacagacagaagtgcaagagatttattagtttgctgtgaaaattttggggcgaggagggtgaagaaagtagaattggagacagagcctcagactatgaggcaaatcagacaaaggcctgccaacctaatggagagctctgaaataaagattacccattaggggagttcccac

SEQ ID NO: 698210 - DNA, 253 bp, Homo sapiens
gggcagtgaatcgagctcgttacccctccgattatatgggtataactatcatgacataattacataatgcattgcgctgtgacgatacgttgtaataatggtcgtgacttggaaagcccccggggtggccagctcggctcgactaaggatggcttagagctgtgcctaggactccacgctcatgcgccgaataataggtatagtgttccaatgtcgtttgtggtttgtatataataatcgccggtcacgagat

SEQ ID NO: 698211 - DNA, 204 bp, Homo sapiens
caagtactactgcacagacacacacacacaaaaaaacggctttgagttgtaatactttacagtggatccatccatggacaagtgtatttgtcttctgttttctaaatcacaatagtctgtgtttcactacctggtggtatatattcgtagtcatcatataggaggcctaggattggatattgtgtcctgtactttttagtggta

SEQ ID NO: 698212 - DNA, 999 bp, Homo sapiens
  misc_feature (271)..(271): n is a, c, g, or t
  misc_feature (772)..(772): n is a, c, g, or t
gccgaagcgggagcggtcaatatgaagtttaatccctttgtgacttcctgaccgaagacaagaatcgctgaaaggcatttcaatgctgcctacccacattcgaacggaatgatactgtcttccccgtcgtttccataagacgctgagacagaatgctacaactgtgcgatccagtgcccatccgaaacggatgactgaatgttcatcgttgttccggtgtgacaccttactaagaaggtcatgcaacactggcataaggttagtccacggnattacaggagacaggaagagtactagtttagttcgtatcaattgaacctggtggttgcattgcgtggacaagacgggtctaaagtgggcagcaagacgtgtccatcgttaccggcatttcagcctcgcatgcagacgggtaggttaatcacctacgagctagaaatcttggagcatacatgagcccgtcgaataaaggaatccttcggaagcggtaaacgccgaggactcttcgtccgaagctgaaggatgaggcaaacacaaggcggctaaatacgaatagggacaggaagaccgagttgcagacatgatgccagtgaatacaagttagatccttagtatacaaccctgtggtactttaaacagagctttgaaacatcaaaaggtagaaaaagatgagaagagacccaataacaacagatcgggggggccgctccataggtgctgcgcaggcgagtgagagcggtagaaattcagaagcgcgagagcgcagaaggtgggnccccaatgtgtctggtgcatgtggcgtcggtggcgcccgcgtgtgtaacccaacacgtgtgggtccgatgaggtgctagatggtgggcgggcataggaatctagggccgcgagggatgcaacgcgcatattgaggcgtaaaagcaaccgaagttgttgatcttcgcacggagaaaacacggggggtaaaaagccccggggaacttgatggagcgttggcggcaaaag

SEQ ID NO: 698213 - DNA, 446 bp, Homo sapiens
  misc_feature (15)..(15): n is a, c, g, or t
  misc_feature (41)..(41): n is a, c, g, or t
  misc_feature (67)..(67): n is a, c, g, or t
  misc_feature (82)..(82): n is a, c, g, or t
gggtgcccacagtgnggtcggaacttcccctacctagtccnactcggactcacacactaaggtcccnctgaaaaacatcccnccccagacacaccccaaaatagtgctttaacaggtttttaggtattcccttaatcccagtcaagttgacaccctaaaattaagtcccataagtctaccctttgacccacgtaccccatatgcatttccttaaactatacttagtttccaaataaagacattaacaaaggaatagttccacctaacatgatgcaactcatatgatgcaaatgtcctttgtacaacccaaaaatgtgctaaacctttccccagaattcgactgtcaggattttgacatttcaagattgattttcaggattttagacttccgggattttgatattttggatttcaacatttaggattgtgtgttttgggattatgat

SEQ ID NO: 698214 - DNA, 207 bp, Homo sapiens
atctttatcatcgtcatgctgttgctcgtgtcccccgataggcctgtgcatccttactttagtcacacactgccagattgaaactctcactggtttgtgtcgccttactcccgcctaaaatgcacgaatttctggcaacccggtgacagaccaaaaactaacgtgcatcaataaacagaacatttatctactgacccgaatctctag

SEQ ID NO: 698215 - DNA, 187 bp, Homo sapiens
agaccactctcaaagaccccaaatccgtgccgcaggccctcctgagaagtagcccttgtacacctcgtcagagtgctgtacagatgccagaagaccacacatgctagccttctcagccagtagacacttgataacagtacgaacttgtccatcacgaggcctaggggacagcacggcaggatgccga

SEQ ID NO: 698216 - DNA, 149 bp, Homo sapiens
ggtgaaagtggctggtcagacgtgtagaattgcatctgtttttaagcctaatgtggggacagctcatgagtgcaagtacgtcttgtgatgtagttattatacgaatgggggcttcaatcgggagtactacatcgcttgtcaacgctcaa

SEQ ID NO: 698217 - DNA, 277 bp, Homo sapiens
tctagaggatcccgtgatattccagagagtcgtgctcttacggacgaggacgtgacgatgatcaacgcatattactgccgtttgtcatccaggacacttgggacacgcttcattgctgaagcgctgcgagttgtcgcgtacatcttgcggtcagcatgctgcgatctgcgtagcattccaggtgcgcatcgatggcgggcttcgggaccagcagcacaaacagcaggtcgaccggggcccgtcgattgcgtcgaaatcaatcgggagcgtcccaggt

SEQ ID NO: 698218 - DNA, 387 bp, Homo sapiens
cgtctcatatactaccaaatcgggacttaaattgtctcataaagctcaataagtaaatagagaagatagactttattggcttacttaaacataattattttaaaataacaagaggagtccctgtgttgataaatgttttatatcttatgctgctatgtctagaatgccttgtgtaatattatgaattagctagtaaatggacttcgcaaaggatgctcagtggggcctgtcagccaagggctaagtggatagcctttctgacattctactgctttttagctgttgtgtcggggacgtagatgtctgtagtctcattgttagggctgaaagatatgtttccatgaggacccagcagagtaatagttccggtagctatgatgaaggacg

SEQ ID NO: 698219 - DNA, 509 bp, Homo sapiens
  misc_feature (488)..(488): n is a, c, g, or t
  misc_feature (500)..(500): n is a, c, g, or t
ttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctggcctccaacttcagattgacttttcaatagtttttctaagaccttggaactgaatgttctcttcagccaaaantggggactttcncagaaagtt

SEQ ID NO: 698220 - DNA, 575 bp, Homo sapiens
gaaggtgagcggttgtggtcggttgccgagctccagcagcagtcggttctctacggagaacccgggagtaggagactcagaatcgaatctcttctctctccccttcttgtgagatttttttgatcttcatgctacattttcggatttgtgagaaaccttaccatcaaacgacgatggccatgtcaacgttaccgaactaggacagatcctcgctccgatgagactcccggtgtattcattgggagatctcaatcactctatgtggtcgagagaatgtctgatgtggaggcaatcttttcgaagtatggcgaacaacttgtgggctgctctgttcatacatgggctttgccttcgttcagtatgttaatgagagaaatgcccgggctgctgtagcaggagaggatggcagaatgacttgctggccaggtgttgtagatgattaacctgggctgcagagccaaaagtgaaccgaggagaagcaggtgtgaaacgattctgcagctggagatgtacggctcctcttttgactgggactatgactttcaacgtggactattatgataggatgtacacgt

SEQ ID NO: 698221 - DNA, 151 bp, Homo sapiens
aggatttgtaattccttactgtaacggagcttagagccagggatgatgctctggtgtggccagcactctgcaactgagaaatgttcagactgcacggaaagatgatcagctcttctccacatcactgaaggcacatgctcgcccctaaaca

SEQ ID NO: 698222 - DNA, 524 bp, Homo sapiens
aaatctatgatgatgatagaatatcttctcctcgtcgcctcgtacgagatatagacaccatatattatatagtactctatacgagagactccactcgcgcgcacactatattatgctctctttatatcgcgcgctctctctatagataagagacgagacgaggataatatacttatcccgcacgtggtagtataccagtcggctgccgctcactattataatttcttgtgtgtgtttgtgtctacatagacatatatataggcgatatatgatgtatgtgtcgtgtgtgagagcagatataatctcttcttgtcgtgtgtgtgcgtggcgagagaaataaatttgtgtgtgtatatttctcgctgtaggaatacgtatacatatataagaatatatgtgggggtgctctccacacttcgccatatttatttttactctccccgcgcgtctttctctccacccacatcttaataaaacacacaaacaccctttttttcccccccaaaacaaataacaaacaaaca

SEQ ID NO: 698223 - DNA, 726 bp, Homo sapiens
gaggcaccacctgctcttaatgttagaactaaaggtcagactttgactcacggaacaaagaaaaataacatgcacagatcggagcagagagcatataaatatacaaaatatgtgtaagaaaaccaaggtccagagaggcgggccagcaacaaaggtccagagaggcgggccagcaaccaaggaaagactgatttcagaggctcaggccaggcctagtgcagctcgacgacgtttagtgcaatgttccgcggtctcttgcatacctggacgctactgtttctccaactcagtcacatagatcaggtggtcctcgggagacttgccgtgggtcttactaaggtgcagtttgactgcgtgcttgctcgcaaaagtccggttgcaggagcttacattggaatgtggagcccaagtcttcctcggtggcccccagtgggcccagagttttgtatggtgaggacttacgaaacattctgctgttcttgaatctgattgagtggcagcttggagagatccttcaggctgaagcccaagtgtgtctccaaatgacttcatgtatgtagaagcagttctgaactgagaggcacaatcgtatgcaaaagaacaacaggatgccctgtgtccaggttctattaggaatatcgtcccccatgtccacctcaactggtacattcaacattgggccaagccagatgctgatggtggtcaatggaagaggccaagataaag

SEQ ID NO: 698224 - DNA, 227 bp, Homo sapiens
ttccaaatgggcgagtcttctaccgtgtctgttccatgtaggaggagatgtctatctcatcaggcagctcactaatatttgacctcaaagcgatcctgcacatcatatgatggatcttggcatcattcatcatctggacacaaaatgtgatagccaacagcccttggttgccacaaccggcctgctctggccacccgactgcaggtagcgtgtcacgactcctcagg

SEQ ID NO: 698225 - DNA, 134 bp, Homo sapiens
aggatcccggcaacacccgctatgtggggtgttggggttggggtccctgtattggtggtggtgctgggtgtcatgggttggttggtctgtgtgccagtgtgtgttggtgttggggtccctgtagcggggtgttg

SEQ ID NO: 698226 - DNA, 132 bp, Homo sapiens
tgactactctggagatgcattgtagccaaacagcaaaactgaagaaatgtgagaagtcttaaagccaaagctgttacagagatgaacgtctttagtcaaaccattaagagttagaaagatgatctgtatcaa

SEQ ID NO: 698227 - DNA, 386 bp, Homo sapiens
ccccgcccccggcgggggggcagggatttcgggggcccctcacagttttgccccccctgcccccctgggtttccccccccggttgcccccggccccccctgggttttccccgcgttttctgcctttcccggtggggtggaatttgttttggggggggccgtcacccactgtcctccgcccctttcccctgggggaccccctcgtgtacccccccctttgccccccccgtccccgcgtggcccttggcgcgccccccccggcgaactccccgaaggtggtggtggcccctttgggaacgtggcctcccccccctggcccgtggcccccggaaccccgggcctgggtgggggctgggtttgaaataacccctttcgtttgggggctta

SEQ ID NO: 698228 - DNA, 317 bp, Homo sapiens
gctttaggaaaaagttgatgaaaatgagaaaaaagatggtttattcatgtctatgcagtaaactattaccagttctttgaaaaaggagcaaagaaaggtaatgttaatctctttttaaatgaaggtaaactcttgcccagctaaaggaaaatttatatactaaaagggtttggaaaactccttcagaggaactttaattaaagagtagtttaatgtgatgctgtgaagaaaaaccccccctctattagtaatttcagcttccccaaataggatagaataaatgcaaattaaaaataaattaggggcagatttctcca

SEQ ID NO: 698229 - DNA, 198 bp, Homo sapiens
ccaacaagggaactgaggcctctctagccaacagcatgtgaacgagccttcttggaagcagatgtctcagctttagtcaagcttccagtcctaaacatctgtcctgctgacatcttgactgcaacctcatgagagatcctgagccagaactacccatataagctgttccctgattgccaaccctcagaaactgtgtga

SEQ ID NO: 698230 - DNA, 604 bp, Homo sapiens
  misc_feature (342)..(342): n is a, c, g, or t
atcttcttctgtcttctatgggtgactagagtctcgctctggttgcccaggctggagtgcagtggtggcgacttctgctcactgctacctctgcctcccgggttcaaggcgattctccttgcctcagtcctcctgaggtagctcgagactacatggcgtgcaccacgcacgccctagctaatttgttggtaattttacgcagacataggggtttcactggtatataggccaggatggtctcaatattccttgaccttgttgatctacgttgccttggctctcccaagagagctagggattacagggcacgaaccacgcgcaccttggccaagtcagcaatanaatttcttttctaatttacccccatttcttattaattcacacttcaaaaaagcatttcctggaagtatatctaagtgtgatggttggtaatatataacaaatgaaaagatgtaattagattataagaaaagcatctgcctgtaaaatatgaaggacgaatggaagtaatggactcctcatggggcccacagtgaaccaggaaggacccagaaagggtgccgggcccttcccctgtgctgcagctacaggggcccatttcttc

SEQ ID NO: 698231 - DNA, 397 bp, Homo sapiens
aggcattctagctatgggaatgccaaatttgcaggagactaagattctgtgaactttttgcctcaggacagcgtccctgtgataatgtggagggtcttgcatgctttcttacagtatcttactggataagagttagaaatctcagggcacccgactcccatatgcaggaatttaccattatccaggaaaaaggaaggttgtggtctaaggaggaaccagagtggatacttagaactatagatagctgagttacacccatacacaggaatttacaatggcctaggggtaaggtggactataggatagactagaataggaactatggcaaggggacgaagcccttgcccctgacttctaagattaagctgaccttaggtggggcagccgatgtcgacgc

SEQ ID NO: 698232 - DNA, 750 bp, Homo sapiens
  misc_feature (83)..(83): n is a, c, g, or t
  misc_feature (405)..(405): n is a, c, g, or t
acaggctgcatcagaagaggccatcaagcagatcactgtccttctgccatggccctgtggatgcgcctcctgcccctgctggngctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatcatgctccctctaccaggctggagaactactgcaactagacgcagcccgcaggcagccccncacccgccgcctcctgcaccgagagagatggaataaagcccttgaaccagcaaaaaaaaaaaaaaaaaaaaaaaaaaaaaaaaaaaaaaaaaaaaaaaggggggggggccccaaaaaaatcccccggaggggggcccagtttaacgcgccaaccccgcagttttttgtggtacaagaggtggcccccagagaggggcgcgggcaaaaaagcacagggcaggcgacgccggcgggataacacaacgtcgcgtggacggggggaaaacactgtcgtccgcgggggacctcgggagaggagcaaccctcaagtgcgcgggggggaacacatgtgcggcaaacaccaga

SEQ ID NO: 698233 - DNA, 147 bp, Homo sapiens
cgactctagaggaccccgcggctctcgctgtctatatgggcatcaacatggggtcgtttatcgccccgctgatctccggcttggctgattaaatctcacggctggcactggggcttcggcatcggcggtatcgggatgctggtggcg

SEQ ID NO: 698234 - DNA, 170 bp, Homo sapiens
ccaacctcaagatggttcaattgatgcccttgcttcttcctagcatggtttctctgcttgtcatcataccacactgataacaggaaggatgctttcgtcattcagcttcgcagtttaagaccagtgagaccctagcacattcaaatttcagagctgttagttctgtacga

SEQ ID NO: 698235 - DNA, 422 bp, Homo sapiens
ttccttcgaccgcactttcttccattactctgagtttaatctgcaaatgcctaagtctgctgagttatgcggagggaaaataatacttgaattgcaaaagaaaatgttctgtataagttacaaagctattttgtttagttttctgtatacactcatatatttacataatcactggttataaacttgcatcatgttttgtgatgtgtggatattagatcgataaaaatatcggtccatatatgtacatataggtatacatatatttacacacacatatatagagagagagagaggaccgaccaataattttcatcttttatgtaaagattgcaagacagtgttattttatttgaataaactgaggcatttatatcttcctgtatatcattactctattgccatattggcttagcaccattctg

SEQ ID NO: 698236 - DNA, 314 bp, Homo sapiens
gaaagagaccacttgtccttcgagcaggagttaacaccttcaccacttttggaggaacaagaagtacagttgtgtgttagcacacgactcggttccttcgagtttttttcttctcgtcgcccctctgttgtaataagggtggccctccgtattatcagggaaggcagtctggactctgccacagaagtccgcactatgccttcacacatgagtaccgaagacaagttcttgctagtcgtgtagtcacagttcaatacagtcaatagatgaatcctaatggtgtcatatctggtctagctggtctattcaacgaa

SEQ ID NO: 698237 - DNA, 292 bp, Homo sapiens
  misc_feature (37)..(37): n is a, c, g, or t
acagaagcgctgattcaggacggtttaagctagacgntttaaagcaaggtaagctaaaaatgtccagcaaaatgacttggggagggagcgcttcccactgttgctctttttaaaaaatgagttcttttttaagatagaaatctttcatggtcctctgaagagcatagtaacatatatatagatcatggggagaaatatgtttatttaagtaagtcctgcgagtaatacactacgatgatgctccgcttcaccgctcagtgggggctatgtagatggatcattaccttttgag

SEQ ID NO: 698238 - DNA, 290 bp, Homo sapiens
  misc_feature (5)..(5): n is a, c, g, or t
  misc_feature (7)..(9): n is a, c, g, or t
  misc_feature (11)..(11): n is a, c, g, or t
  misc_feature (13)..(14): n is a, c, g, or t
  misc_feature (16)..(16): n is a, c, g, or t
  misc_feature (21)..(21): n is a, c, g, or t
  misc_feature (113)..(113): n is a, c, g, or t
atctngnnngntnncnggatnactagagtcactatccggaaatctaagaatatcctcttggtcatcacaaaaccagatgtctacaagagccctgcttcagatacttacatagnttttgggggaagccaagatcgaagatttatcccagcaagcacaactagcagctgctgagaaatccaaagttcaaggtgaagctgtctcaaacattcaagaaaacacacagactccaactgtacaagaaggagagtgacagaggaagcggtcgataaacctgttgtcaaatttagggc

SEQ ID NO: 698239 - DNA, 134 bp, Homo sapiens
tcttcatgcctaccacagatgagaacaggaagttgcatgtgaagcagagaggagtgcagagcaattctccgagaaaatgggctttttctctgaggacccaagaaagacattgacatatctacacgacattgata

SEQ ID NO: 698240 - DNA, 225 bp, Homo sapiens
ttgtcaatcgagctcggtaccgctctttaatggcagtggcatgaacatgggctcagcgttatgtccgagacatcaccagtggtgcgtggtggccacagctcactcttttggctgctgtggagtcccccgtggcatgaattcagcaggtgctgcttttctgtgctggtcagactgggcggtgttccaggttgtgtcactgcgtgggggctgccattaaaggagctg

SEQ ID NO: 698241 - DNA, 529 bp, Homo sapiens
  misc_feature (16)..(16): n is a, c, g, or t
  misc_feature (43)..(43): n is a, c, g, or t
  misc_feature (55)..(55): n is a, c, g, or t
  misc_feature (58)..(58): n is a, c, g, or t
  misc_feature (81)..(81): n is a, c, g, or t
  misc_feature (105)..(105): n is a, c, g, or t
  misc_feature (119)..(119): n is a, c, g, or t
  misc_feature (173)..(173): n is a, c, g, or t
  misc_feature (217)..(217): n is a, c, g, or t
  misc_feature (439)..(439): n is a, c, g, or t
  misc_feature (462)..(462): n is a, c, g, or t
  misc_feature (479)..(479): n is a, c, g, or t
atgacacatttgtgtnatgtggaaaatgtgactgggacaagtncaaaactatagnagnagttgacctcctgtgctctgcgnaatcttccagagatatgcaccttnaattgtttaacagncttttgtgtttaatccccttcagcccctagctcttttattctaccaggactggnagagttgatacctgcagttcaggcctgccagtgactcttagtgntctgtttctgacttatttttcctgtctctgtcttccaacccccaataatatttccaccggggatgcatcatttttactcccaatattctgtaggagaggggagtcagggatgctgtcttcccacggaatagtactcagtaacaaaccaattgcattttagttgggcagtgcttccacccacccttcagatccctttcagctaaaacccttcccccttccctncatgtgtttttagtttccggttnggttgttgggttttcantgcccttcttctaacctattaccatgggcggaaaggaaaattttttccat

SEQ ID NO: 698242 - DNA, 182 bp, Homo sapiens
aactacatgcagccttcagctctggtgccatggattgcaccaacatgtagcgaggaaagtagcatacctccacgctcaggccttgggtagatgtgagcaaaagaacaggagcagcataggttgtttgagctatgaggaaatgaactttgctttttatatttaactaggaactgaaatgagca

SEQ ID NO: 698243 - DNA, 240 bp, Homo sapiens
ataaatcaagaaacagttattgcatttttgtagtgctgtattaaagttaaggcggtacccacagtcttgcatgtctcatttcccagagaacaagtcaaggttacggtgaggcataagtaaaagattgttaaagggtattcatggttttgtcttttgctttatgcctcagtttggtttaaaactttgatggcaaatggtggtattcagtgtgggaagtgtcatatatttcccccttatcat

SEQ ID NO: 698244 - DNA, 113 bp, Homo sapiens
acatcatttgaatcatattgatcttcatcacaaataaacttctttaagcaaattagggtttgatgtcagaatattgactatctctacagaaatattttacttcaattaccaaa

SEQ ID NO: 698245 - DNA, 308 bp, Homo sapiens
  misc_feature (175)..(175): n is a, c, g, or t
  misc_feature (237)..(237): n is a, c, g, or t
  misc_feature (254)..(254): n is a, c, g, or t
catctcttgtttgcccccaaggaagagactttctgtttcccttgggaactcacattctgtgatggttaatactgagtgtcaacttgattggattgaaggatgcaaaggattgttcctgggtgtgtctgtgagggtgttgccaaagaagattaacatttgagttagtggactgggnagaggcagacccaccctcaatctgggtgggcaccatctgatcagctgccagcatgactaggnagaaagcaggcagaggnaacgtggaaagattagactggctgagtcttccagccttcatcctcctcctgtgc

SEQ ID NO: 698246 - DNA, 413 bp, Homo sapiens
  misc_feature (34)..(34): n is a, c, g, or t
  misc_feature (144)..(144): n is a, c, g, or t
  misc_feature (163)..(163): n is a, c, g, or t
aaaagcagcttccctggcctaattaccctttccnaggttccaatgcccccttcagtttgacccctgatcattaagttgttgtagttctctgggtcctttaaagatagttttaatggcccaggcatggtggcttatgtctgtaancccaacactttgggagtcnaagacagcaggatcacttgaggtccaggagtttgagacccagcctcgcccaacatggtgaaacactgagtctattaaaaacaatacaaacattagtcaggcatgctggtgtgcacctgtaatcccagctaccctggaggctaaggtgggagaattgcttggacctgggaggtggaggctgcagtgagccgagatcatgccactgcactccagactgtgtgacagcgcaagactctatatcgaaaaaaaaa

SEQ ID NO: 698247 - DNA, 118 bp, Homo sapiens
acggcggcatagtcatcctgtgagtgctccagagagtaatacatgtagcagcagctcgagcgggcatctgagtcctcgccacccagtagaattctgcagtgcctggtaaaaggctgtt

SEQ ID NO: 698248 - DNA, 201 bp, Homo sapiens
tgtgactgctgacggacgtgtccgtgaccgggacagaccgggtggtgtcacctgtggatgctgacggacagtgtcggtgaccggacagcggggtggcgtgacctgtggatactgaggaagcgtcggtgacacgaagaggggtggtgtcaccttgtggattgctgaggaaaggcttgtgaccaggaagaggggtggcgtgca

SEQ ID NO: 698249 - DNA, 717 bp, Homo sapiens
gagaggaagagacagaggcaaaaggaaagtcagagagagacaaagtcaaagagataaagaaagagagaaagagagatatatatataagtagttaagaaaaaaaacagtgtaccttattcctttaaaagccaaagtaaatttaaaacctgtaattgataattgaaagtattctctgtaaccctataatgctccaataccacttcattgtcagtgtaaacaatggcgtatcctgaaagcactgaggccttcctatcaaaaatccttaacccagtaacccgtggatggcccaaatgcattcagtctgtagcggcaactgctttgttaacagaaaaaaaataaaacaaaaataacttttagaggaaacctcatcgtgagcacacctcactagttcagttcagaagtatcctaaatcaaaaaagcaaaaaagcagcttactaactcaaaaatcttaaggtatgaggctattccgttaggaaaaaaaaaaaaagccatctataccaattctaaattaatttggacaaaacaaggtcttattaatagcaaaggataattaaaatcccaaacttacaaggtttttaaacaaaagtaaagcttgcttaaaggtaacaagtgtaacatgtattatactaacttctattcttgtgcctcagacagctacccacagacttaaagaagtcgcttaaaaagataggtatatcttcaaagaacaagaaagaa

SEQ ID NO: 698250 - DNA, 135 bp, Homo sapiens
atcaaaaactgctgacaatgcaacttaaaatgcagaaccattgatcaatttggatgtaaataatcctgattttacggctggtgtgatggctaaggctaaccatgcttcagatacaacgtcatgatgattacctgg

SEQ ID NO: 698251 - DNA, 1123 bp, Homo sapiens
tctacatttagagaaacctatttatacttatcttctatttcctattttagtgtttcatttatgtgcggtactccaatttaggacttttccatagtgccaaagccatacatattcagtagaacatcaataaatatacatacagcaattcaacactttattataaacacgggcttcgtgttagcataattcagctaaacagtcaggctactgtaagtgttctagagcatattcaagacaggctagcattctcaatcttacaatattttcaactgatagtagcgtttatatcgggatgtaaccctatgataagttgacgaacacatactctttttgtgtgtctactgtgattcacgctatttcttaaatcatcagccaagcatgttacgctacgtatacactatgacttcctaaacacatgtgcatggcttccctgcacggagatctaccaattcgcctctgagactacacactcatcaaggtctaccaagataatcaatgtaatgatgtatcagttggctatctagcgacactacattaacttagtgcatattacacatcagggttaaaactaattcagacatagagccactttccatccaattctattaacattctccaaacataatcctttgcaccaagggacagtcatatcattcacatattcacagtgactccgacacttacccaatcaagtgggcagaagtcatgcagcataactactccagcgctccacagacctactccacagaggccacaccaccacgcacaaaggggctggcacactactaacacccgcaagcacgtgcgaccacctgggcacacactcactcacataccacaccacgcccaccgtgccagaacgagaccacaacccagcagtggcacaaacccaacgctacctcacacaccactgatcccaagcgcgcaccatcgcacaacgcgcaagcccccaccaccgttcagcaccgcaacaccaacacagacccaacaacaacgaaacaaccatgactccaccccacacccacgactccccacagccaaccaccaacacccaccaagcacaccgtcactccatcaactcagtcaagccacatcaatcgcaccacgatgactaataaacaag

SEQ ID NO: 698252 - DNA, 236 bp, Homo sapiens
cgcaatatcgactcgtgatccacccgactacggctcccaaagtgctgggaatacaggtgtgagccactgcgcctggccagtagttatcttttaagttatttactctgttttttaaacttgatgtataacattgagatgcatttattatatatcacatggtaaaataatccctctaaataatacttctctttctggattactatgaatctctgtcatttacagctcagccataagct

SEQ ID NO: 698253 - DNA, 329 bp, Homo sapiens
gttgcagtagactacaccttgcacaagtgccctaaagagaatgcaaagaaaaacactagtctcaaggactaggtttaattcaggcaatggacagtgatgcctacaatgggactgtgagggaggtagattgaaaggtatagtgccctgtctcaataaacttcaggtttttaggggggtgagagtgtttaacatgttaatttaggggagtctcacactggacggtgtcttttgtgtgttaaattaagggtcggggttcgcctcaggggagtttcgcatcgggggtctaagcgtactgctgtaattccctccctctctggggagtactgata

SEQ ID NO: 698254 - DNA, 382 bp, Homo sapiens
tggaaacagagtctcgcttggtcgtccaggcgggagtgcaggggcgagatctgggctaacggcgaccttcacctccggggtccaagcagtcctccgtgactcagcctcccaagtagctgaaacatacgggcgcatgtcatggcgcccgatataattatgtgtattttaagtaaagaggggggtcggccaggttgggccaggcgggtctcaaactctggacctcgggtgatcggcccacctgggcctcccaaggggtagggttacgggtgtgaagccaggcgccgggccggggtttcctttttcaactcttctatcctaaggtctccattaattgggcgggttaagatatccaaggcagggctcacaagaagtagtgatagtt

SEQ ID NO: 698255 - DNA, 418 bp, Homo sapiens
tgcagatcggcgggggtgttgccgccggcgttgcgggtgaaggctttgaccagcaccacggcgagcacgactacgcccgcgatcagcagaagccagaagatccaggcaagtcccatcccgcccataccaaagccgttcatcatcaaaggggattccttatctcttgtcgtgcacggccaggccgttcctgaccgtggactttcaggggccgtgcagtgccggtggttctaggccttggctgactggccggagttctgccaggtttgccagccagcgtagctgccctcgagctcgacgacgtcgtacccggcccggcgcagggcgctggccgcgacggagttccgcacgccggactggcagtagctcacgatagtgccttcggccggaagctcatccaggtgccacatggcgcggccgc

SEQ ID NO: 698256 - DNA, 105 bp, Homo sapiens
ggatttgctggtgcagtacaactaggcttaatagggactcgaattcgaggctcgaattcgagctcgaattcgagccactcccgacccggggaggtagtgccaaaa

SEQ ID NO: 698257 - DNA, 1016 bp, Homo sapiens
  misc_feature (26)..(26): n is a, c, g, or t
  misc_feature (93)..(93): n is a, c, g, or t
  misc_feature (104)..(104): n is a, c, g, or t
  misc_feature (107)..(107): n is a, c, g, or t
  misc_feature (109)..(109): n is a, c, g, or t
  misc_feature (186)..(186): n is a, c, g, or t
  misc_feature (193)..(194): n is a, c, g, or t
  misc_feature (235)..(235): n is a, c, g, or t
  misc_feature (252)..(253): n is a, c, g, or t
tgggctgggtttggccccagctgganggaagaggggtggagactgtttccatcctaccctcgggcccacctggcaccctgaggggccaaggancagctggggcntgngngagggccataccccaccctcagcaccccttccatgtggagaaaggagtgaaacctttagggcagcttgcccggcccnggcccanncagagttcctgcggagtgaagaggggcagcccttgcttgtngggattcctgacccagnncgcagctcttgcccttccctgtccctctaaagcaataatggtcccatccaggcatgtcgggggctggcctagcgagcatatctgagggaggaggcacctctccaagggcttctgcaccactccaccctgtcccccaatctctggtgagtcttggctggcagcaagccatcatacggaagggaccaacggcaacggcacggtgccctccagagtgtgcacgtgcccatgtggcctgtggcctgtgtcccatgacccacacctgtgatccgtgcctccaacaccactggccaccaggctgcagcagccaaggccgaagctctggctgaaacctagtgctggtgtcctgaccaggccattagagccttctcatttgcaccacagcatcatcgctggtcaaggaaccgaaagtccccatagtcaacctagagcaccgggagttagctagcggcttgtaggcgacatccccaacaacctagatgccaccttgagtatgggatgaatagatagacgcaagctgagcaaaatgggaaccaataacttagataacatcccacaaccgagagctatttcattatcccacactaacacaatacatctaaagccaaaacaataacaaagcctatatacttctcacactaaacaaactcattacactttatacaatataataaacaattatatcaagaattttacacatcacactcaaacaagacataccaccatatcaaacccaaaaataatacgactacacacaccatacact

SEQ ID NO: 698258 - DNA, 616 bp, Homo sapiens
caataccaacatattgtacaacagctattaatgaacatcacctggagttcaagtgtgcctgacagctgacacttagttaatttctccctgaaacaagaaccgtgaaacttccacagcatgcagaaaacagcaatcatccagtggccactgggcatgttaaccccaagtacctgcgtttgccatttccatttgcgtctggtatttccagcaactacaactttacgcacatgcagaaaaactgggtataagcagcacatgttcctcacatttcagttaatatccagttctcacatttcaatagcatcaaatgcacttgttcccacatcccttcacttcagactcccatgtcacagggcgaggagcacaaagggggggcacacattcagcagtgggggcaagatgcaatccaaatccacatttggtaaaaccacacttataacccattgggcacgctaccttactcatacttttcctacagataaacgctttcgtccggactcctacataatgggacaggactttcacacgagacttttaaacaggtaggacacgctacattctcccccccaatcctccaccgttgagtcctcatcgggccgactggtcgaatgctctg

SEQ ID NO: 698259 - DNA, 926 bp, Homo sapiens
agcgggctctctcggccgggcggcggtgactgtgcaccgacgtcggcgcgggctgcaaccgctcgcgtccggccgcccgccatcatggtccacgcactcgcacacctgtcacccggtttcaccgatcgtactaccagactcttcgcaggagcttggcaaggcgtgcattgtcgtctgctggtccgcagagtgtgtgcaagcagaacctaccatcgacaggacgtacgcagacagaatagatcatcacataccaagaaacttgtctgcccaggtgatcaccagaagtctagaacagtagaggctcaggatacttgtcgcacttctcgaagcagtccaatagcagtccgtgcgcgctccagtgatcatgtattttctgagctgaccggcgtgtacactacactgcgtgcctttgacccttgttcacccggtcggcggacgctgctttgacacgcatcgcttagtgcgccacgagacgtgacataccagtgcgaagcacggatgcctagtccacctgtgatacgatcagcatccgtggcacgcagtgttacaccagcagtccgagcgcagactattgaccagtccgatcgcgacaggagacgctgtagatgcctgatgagacctgcttgcatgagcccagctacaatgtctcggtcgtgccacggtcgtcgacgactgtgctgcatgttcgaggcctacgccgagtcgcaattcccaggggacgaagcagctattgcgtagggactcggtgatgcgtgcgcaccgcctaggtgtagcttgttcctccttgacggtctccgacggcaaccagattccgctagtggacaaaagcctgtgcgactatcctgggtccctgcgggagtccatccgtgctatatacctcctgcgtggggcctattccttcgccttctgcggcactgacggctccg

SEQ ID NO: 698260 - DNA, 258 bp, Homo sapiens
  misc_feature (8)..(8): n is a, c, g, or t
gggttttngggggggggttttcccccccccggggggaaaatttggggggaaacccccctttttttccgggggcccccggggaaaacccccctttttttaaaaaaaaaaatttttgggggggggggggggggggcctttttttccccccctttcggggggggggggcaaaaattttttttttcctgggggggggggggggggggggggggggtttttccccccccccccccccgggggggggggggttttttttcccca

SEQ ID NO: 698261 - DNA, 268 bp, Homo sapiens
tcggtacccccatagtcttcacttgcaggaaaacgagggttaggcgcatagggctatcaggacatgatgaatcgcttaaacagcagctgctggatgtcctgatggtatgacaatggggtcaatacagtgccttacggtacgcgtgtactccaaggccacctgctgttccactgcaatcccttaatgttgagcactgtaatgcttaaagcccatccagcagctgttccttcgagaacacgcgcccttccgctttatctttctctgaaag

SEQ ID NO: 698262 - DNA, 228 bp, Homo sapiens
gagcacgctgactttgtaaaaaatagctgagacactagatgtaaaaaaatagctgagatgctgggcgcagtggctcgagcctgtaatcccagcactttgggaggccaaggtggatggatcacccgaggttaggagttcgagaccagccttgccaacactgtgaaaccctgtctctactaaaaatacaaaaattagctgggcatggaggcacacacccctgtgcgcaag

SEQ ID NO: 698263 - DNA, 318 bp, Homo sapiens
gctcgactttctttttttttttgagatggagttttgcctctgttgcccaggctggagtgcagtggccaatcccagctcactaaaacctccgcctcccaggttcaagcaattctcctgcctcggcctaccgagtagctggaaccacaagcacggaccaagtaactggaactacaggcacacaccacttagtagagatgggttttcaccttgtttgccagggtggtctcaaactcctgacctcaagtgatccgcccacctcaatcttccaaagtgctgggattacaggggtgagccaccacacccaggctggtgtcgacg

SEQ ID NO: 698264 - DNA, 431 bp, Homo sapiens
agcatacttaattagctaagacttcttattctaggcttgaccctatgttccacatcttgtgaatttgtagttgcataggctgctctctgacactggttagtgacctggaagctatagtaacgttaggggaggtgttgtatgagcatagaggtatccttgcaaggaaagacttgtcttatctcaatacgtctttgtttttgcacacaagaaagtcaatgtatgagtcttctaaaatcttcctatttccaagttgcagagtaccactgattcctaaacaaagatctaatttttgactcagagacgtagcaaggtctgaatcgcaattataatttaatgatcattaagataaattttctctctgatatttagattttgcccaattattaagatatttgggtgtctcgtaaagaatggaagactctagtctcttg

SEQ ID NO: 698265 - DNA, 645 bp, Homo sapiens
ggtgggtgatagaagacaaagtcgtttttgtcgtaaaacgattggatgtggtggagaggagagtggtgttgcggagaggatttaaatggggtgaaattggggaatggtggattagagtgttttatggactgcatagtggcgcgtaggcctttggtgagaggtatctgtggggggaggaaatgtcggatcgtttaggaccatatagtagaggacataatatggcggggtattgatgggtatacagcgcaggaaccgggtacactcgcgtgtgtggctgcatacacgcctcgcgtacagatacgcgcactggatacttgtatgcgaaacgtgccgcgggagggggagcagcattcatgacggtacaaggacgatttcagatcgcggcaccgtgtggaccaaacaagtgcgtgagaagcaccgcgtattttgcccctaaaaaagcgacaagaattagcgtgggctgtggtgggcggcgttgccactggtatgtgcccaggctagatcacggagggtttaaccagcgagatattcacttgtacttgggcggcgcggggttgcagtgagaccgagattgtccccactgcatttcagcctggacaactagaacgagaatccatttccaaaaaaagaagaacaaaaaaaagg

SEQ ID NO: 698266 - DNA, 205 bp, Homo sapiens
gaataagaacctgtctcaaaaaaataaaaaggatgcatgtaagccataagtgaagaaatgaaaagagatattccatggaaatggcaaccaaaaaggacagagctggctatacttacatcagacaaaatagatgttaaatcaaaaactgtcacaagaggtggcacacacctatagtcccagctactcaggaggctgaagcagtggc

SEQ ID NO: 698267 - DNA, 307 bp, Homo sapiens
taatggctcactctacctcttcttgccaggttcaaaggattctcatgcctcagcatcccgagtagctgggattacaaccacgcaccaccacccagcacttggaagaccacgggggacagattgcttgagctcaggagttcgagaccagcctgggcaacatgatgaagccctctctacaaaaaatacacaaattagccgggggtgatggggtgcacctgtagtcccagctactcgggaggctgaggttggaggatatcttgagcccagaaggtccttcacccagaccctgtctcaaagaaacaaagga

SEQ ID NO: 698268 - DNA, 150 bp, Homo sapiens
ggctcggtaccgatcagcacgcaccaggtgaaaccgccgcccacgccctcgagctgagcgtgtcgccgcgctggatgcgccccgtgcgcacggcatggccgagggccagcggaatggaggccgccgaggtgcgtgctgatcatcctaatg

SEQ ID NO: 698269 - DNA, 762 bp, Homo sapiens
aagaagtttgctgaggcatttgaagctattccccgcgcacgtggcaggaaaactctggaggttcaaggccaatgaagtaatctctaaactttatgcagaacatcaagaaggaaatcagaacgtggattagatattgaggctgaagtccctgctgtaaagggacatgcgtggagcgctggtattctagatacttaccgtggtgaaaatattgggctatcgaagactcgctactaatgcgttgcagtcactgtacgttagagtggatcagatcatcatggcgatagaccagcatggatgggcccaagcctccaagtgggaagaaagactggtgagtgatgaccagaaagtgacttgaaagttggcttagagttttctagctgtgaggtggaaggctgtagtttgatatgtaggtactgaaagaatcaccctgatgttttcttagttctccttaaattagatgagttactgtgtgtttgtatgcttggactggatgttataaataaagatattgtgactgaaaagtaaataacactaaatcgaaatcaactcagaagcagctgcggcgactgccagatgcagacaaaaagaaagaacacaactacgttgggggaccggcccacgaatgcatctgcactggacactgggcgaccaagaagaccggcaccgcatgccgtcggtgcctccacatggaacagccgcggcacccggctctggaacaccccccggctacgggcaccggctcaccggccaggcctgaaaccc

SEQ ID NO: 698270 - DNA, 289 bp, Homo sapiens
ggtttcctgtgtgtgtggacggagtggtcccccaggaccctctggtactgcttggccctcctggctccccctgtgtcctgcggtgggaaagaacgggcttcgtggtcctcgtggtgactcaaggtccacgttggccgacactggagacgtcggtgccgttggtccccctggcttcgctggtgacgaagggtccctctggagacggctggtactgctggaccctcctggcactccacggtcctcagggtcttcttggtgctcctggtattctgggtctccctggctcgct

SEQ ID NO: 698271 - DNA, 492 bp, Homo sapiens
ataaacagaaacagtcagaaaattacttctgggagatggcagatgatgagatattaagacagaaggcagacactctgcacagcagctggagaggagaaaaggtgcattagtcaaatgaattatgaaaaaaaaatgaaatcaagttccagagaggtgccaacattttcttcatgctattgagtattttcactttctgagatatattcattagttgcaattttggtcagtttattacttggacaaaaacaatttggattatagcttttggggaaaaatatactatttaagtgattaacttaagaatgatatgatggttcgtaaaaatagacttattttaacttagttaacttgaataacttacttttaaaagtcattctcacagatcatatccaaaatgtttgtttttcaattcatgaattaatcctcaggatgaatgttattactttgttaagttagattttctgggcaatatggtgaaaatataagtaatac

SEQ ID NO: 698272 - DNA, 197 bp, Homo sapiens
taacgagcttatataatgggatgtcagcctcttaactgctaagacacttagatgggtctcagcgtaaaatcataaaagaacttttgtatttaatacacagtttgctttgagactttacagcatatgatcttttttccataaacttgtacagtgcaaacgacattttgaataccatgatcgatgatgtcccatgcttc

SEQ ID NO: 698273 - DNA, 900 bp, Homo sapiens
  misc_feature (1)..(1): n is a, c, g, or t
  misc_feature (77)..(77): n is a, c, g, or t
  misc_feature (105)..(105): n is a, c, g, or t
  misc_feature (136)..(136): n is a, c, g, or t
  misc_feature (153)..(153): n is a, c, g, or t
  misc_feature (164)..(164): n is a, c, g, or t
  misc_feature (181)..(182): n is a, c, g, or t
  misc_feature (184)..(184): n is a, c, g, or t
  misc_feature (193)..(193): n is a, c, g, or t
  misc_feature (211)..(212): n is a, c, g, or t
  misc_feature (254)..(254): n is a, c, g, or t
  misc_feature (264)..(264): n is a, c, g, or t
  misc_feature (273)..(273): n is a, c, g, or t
  misc_feature (290)..(290): n is a, c, g, or t
  misc_feature (354)..(354): n is a, c, g, or t
  misc_feature (368)..(372): n is a, c, g, or t
  misc_feature (400)..(400): n is a, c, g, or t
  misc_feature (404)..(404): n is a, c, g, or t
  misc_feature (406)..(406): n is a, c, g, or t
  misc_feature (415)..(415): n is a, c, g, or t
  misc_feature (417)..(417): n is a, c, g, or t
  misc_feature (425)..(425): n is a, c, g, or t
  misc_feature (508)..(508): n is a, c, g, or t
  misc_feature (628)..(628): n is a, c, g, or t
  misc_feature (803)..(803): n is a, c, g, or t
  misc_feature (812)..(812): n is a, c, g, or t
  misc_feature (879)..(879): n is a, c, g, or t
naaaaattcaaatacagcgagtcaccattgagtcagactagaacgcggactgacagggcatcaccataccgcggganaggagccgggtcaggggaggggtatacnaaacagggcagaggggaggggactgacaatngtggcgtgccggggggngggggccggcngggcccccccagcatcnngngcctatcanccgatggcggcaacagannccctgggatagacaggaggctgcgcggcaggaggagaaatcngatgtgagcncgctccccncacgtcccccaagggcncctgcggagctcgccggcattggagggtccagcccaaggggccagggtgagggggtctttggcnggcgcgcgtccccnnnnnggcccacctcccctgagggaggaagganggcnanctttgtgcngnaagggctnggggggcggcaggcccggggcccgccggggtctccacaaattgtgtctgaagagaatgcaaaaggtcctcctgcccgtgtgcnaaatagaaaccggggtctgcaggctcagctccggcctcctgctcctctgcaggtgctctgcatgtcctcatggggtgccgggctcagatcaagagactgctggcagtggcggcacggcancagggccagagtgatggggacgctgaccaagaagggtgccgagggtcccccgccgctgcccagctccccagggtcacagatcttcgtggtaggtgggggtgccagggagctggtggtgctggtcgtggtctccgcagcctgggcctccgtggtgaggtgtcgcggttcctcagtncagggcgtncgttgggcggctacgctccagttactccatgtcccaatctcattgtcctttggctgccacctggatnatgtactccttcccggcgtag

SEQ ID NO: 698274 - DNA, 391 bp, Homo sapiens
tccaatgcgctctccctttcaaaggatcctagggctgtgggacaaagaacatacatttacacatgcgacagagcttcgcagccgtcagagactgccacaccgaccaaggctgaagtactagcactcgcgtctggatggcccacaatagcaccggcacacacgacatccgtgaccaggtgctcatggactacactgtccttctcacaacggcgctgtacggcgagagtgacctctaatccaccccgcccgagccgccctcagtcttgtgcgccgtgcactgccttgcacatccagccgtcgccagtctccatgcctgggttcggtttcagctcccagcctcacccggtacgctgggccaacgtgatgataaaaccccgcaagacagttaaat

SEQ ID NO: 698275 - DNA, 296 bp, Homo sapiens
cggacgcgtgggcagtggtgcagtcttggctcactgcattccagcctgggtgacagagcgagagtctgtctcaaaaaaaaaaaaataaaaaaaaataagggcttccggtaggaagcttagtcaggggaaaggatttagagaggaagggacaggaaatagagaacagcaggccgggcgtggtgggctcacgcctgtcatcccagcatttggggaggctgaggtgggcggatcatgaggtcaggatatcgagaccatccgggctaacattggtgaaaccccgtctctactaaaaatac

SEQ ID NO: 698276 - DNA, 662 bp, Homo sapiens
cgatatgagcttataaaataaagtagtatttgggatgtagatcagaaataaatgctagtcaagagataaatctagctgcactgagagctcgtagaatctagaaacttgaacatgctactatcggatgagtagaaggcagatccgtgtcgtcagatacacgagagattgccatagtgatgcgactcaacagtttaatgaaactgattcatacgaatactccagtacttcaacccgtgttgtagttgaagcctactgaaaaacacatttgtatgtttactaaagagatctaacagttttaactgacgaaaaatactgcagctacatttcagtcttttaaggtaaaacaagatctagaatattctagttcagtatactgggctcaaaaccaactttccttttgaaatgcatctagactagactatattccttacataatatcattgtcatcatcatcttcatgttttctcttcagtgggttgcttcattggctggtggttcttgtgacgaaaccatgtggtggtaataagaatattttgggcccaatcattgaaggattaatcagaacattttgaactgcaagttgttgcaggaaactgtaaacagagaagaaagccccccaaagacaagctatgaattacccaagaatctgaaacatattgata

SEQ ID NO: 698277 - DNA, 444 bp, Homo sapiens
  misc_feature (250)..(250): n is a, c, g, or t
agtgaccttatattattgctaagggaatatgagattaacttcctacaggggccaaaaccagagaaaggcttccagcaacttcgatgaaagtagtttggccacatgtcaagccaattgtatgtaatatttatgtacctttttcataactggaattgccaaataagcatggagatctaaatgatgtacttgttagtgtattcattcatatgactgtaaagattatttttcactccataaccaagtacttggnatatctaccggaaaacatttgaacaaaaaacaatagggtttttactatctttcttggtataaaacatattgttccaaaaaaaataacacaccctcccttttttttgagtgagggcagggagtacctgaaataagacaatgtttactaaggcaaataattgaaaattaaatctgcactttatagcaaattataaa

SEQ ID NO: 698278 - DNA, 104 bp, Homo sapiens
attactatttatcgatcaagggaaacttgaagaacagagaccagaaagagtaaaagcttttatagacaggggctgcagaacaaataaagcacattctggtaccg

SEQ ID NO: 698279 - DNA, 434 bp, Homo sapiens
cactctaaggatccccaacgatggtcctcagcttcccgagtagctaggattacaggtgtgcaccaccacgcccggcttctttttgtattgggagcagagatggcgtttcaccatgttggccaggctggtcttgaactcccaacctcaagtgatctgcctgccttggcctcccaaagtgctgggattacaggtgtgagccactgtgcatggccagattaccagatattaattgagtgcctggattatatggcaatataaagttctaggttcttgccttcatggggcatagcgtcatgggagtaatgcagacagcgggctgttaccgtgtgatttctcctcaggtatgtctagattctctgaggcttgagaccatttctcttgttttcatggttctttatttgccccagatgaatgtgcactttgggattcctcct

SEQ ID NO: 698280 - DNA, 624 bp, Homo sapiens
cagccagttgaatcccgttatttctatatttactttaggcttgactttcagggatcttagtaatttttgcctgttttgtcactacatatgtcatcagatcagactagaacaaagaaaagcttactgttttcaaacagggaaatgtgcatagtaatgctttactctgaattagaaacatgtttatgataatcctattagaaaatttgattgattgattaaagtgtctttttgggtcgacatccctagcgtttctgatcctgagtaatcaaatttaaagactacccagcagcaaaacttttattaaataattatctacttttattaaggctgtatgcctaggaattccatctgtttggtataattagaaataccaaggtgaggtaaaatcttaagaagttatttggccttggatttcagttctactcctgggctcttgggtcttgatttttgcatattcccatgttggaaaatacaatagagcttaatagtagttattgggggggaggaggtaccaacttttttgtggtttagaactttgggatagtcaggttacctcattggacattaggcatttttttatattgccagaaggatggaaacctaagttttggggtgtcacggggg

SEQ ID NO: 698281 - DNA, 386 bp, Homo sapiens
  misc_feature (345)..(345): n is a, c, g, or t
  misc_feature (379)..(379): n is a, c, g, or t
tttagccctttgaacatatttaagatagttgttttaaagtatttgtctaggaatatacattattacagtcattatagagaacagttcggaggttcctcaggaaactaaatatagagctaccatgtggatcctgcagtcccactgctaggtatatgcccaaaagaaaggaaatcagtatgtcacagagatatctgcattcccatgtttattttaggcactcttcacaatagccaagatatgggaagtccattcaacagatggaatgggataaaggaaaatgtgggtacatctattattaactggggtactatttcagggccttaaggaaaggaatgggggtttacntccttttggccaccaacctggggggggggaggtngaagggt

SEQ ID NO: 698282 - DNA, 299 bp, Homo sapiens
gctgggttgacgatgatttcaccatgattgagtcaagctggtctatgatcctggtgacctctgaatatccgtcgcctaccctcagccttccaaacactgctgggattacaagagtcagtccactgtgcccagcctgtaaaactttaattaaattaatctgttatgcttttctcttgttagcctttttttttttgagacagggtcttgcttctgtcaaccaggcggaaggtccgtggcaccaccagagctcacgtgcagccttaacctcccaggtctcaataatcttcgaaacctcttct

SEQ ID NO: 698283 - DNA, 295 bp, Homo sapiens
ccgtccgggccagcagggcatcgccgatttagactccggttccaacgcgaacctgaagccggaaaccgccaagacctggaccgtgggcctggtgaacagccccgagttcgtgccgggcatggatgtcagcctggactggtggaagatccgcatcaacaacgcgatcgtgggcgagtcggccaccgacatcctcaaccagtgctacgtgcagggcgtggattcggcctgtgcccgcttcacccgttcgaccggcgcccagacgctgggccaggtgaccgcgctggatcgctcgctg

SEQ ID NO: 698284 - DNA, 1468 bp, Homo sapiens
  misc_feature (441)..(441): n is a, c, g, or t
  misc_feature (551)..(551): n is a, c, g, or t
  misc_feature (691)..(691): n is a, c, g, or t
  misc_feature (699)..(699): n is a, c, g, or t
gaaagcgaagaaggaagctcctgcccctcctaaagctgaagcgcacaagctgaaggcttgtacaggccagagaaggcagtgttgaaaggtgtccacagccacaataaagaagaagatccgtcactgtcacctcgaaccgtatcgcggcggacgcgatacgacgacgtgcgattccggatgacagccgcagaagtatcctcgggatagagcgctcccagggaggaaacaagcgttgaccattatgctatcatcaagtgtccgcgtgaccatcttgtaggtctgccagtgagagaagagtagaagtagaacaacgacacttgctgcttcagttgttggactgttaaacgtccaacaaggacacgcagcatttagaaccaggtctgtcgcacaggcataggcctcgttactgaccaattagactagtgcgtcccatagggttanataccatcgcctggatgtccggggccctgcatggggacgatggataggagagcgcgattagtgttcgacatggactccgtggagttgacgaagtgcctctgggggcatgntttgccccacacgagacacactgtggggatcagtctcaacacgtgaagcgtccaagacgtggcgctgagatgtctgggagatcatgagtcattgatttattatcatccatcgtgttctgcactcgagttacttgagacanacaggagnacataaacaagacagaaacagatatatatacacaagaaattccaagacttgcgtgcacgaaggcttggcccactattaagggggggtgggctggaaaatagggacggatgcttgccgacactatggcgaacccaaggggccccttggagtagccaaggcaacgggagacattccggggcccctttttctggtcctggaaaccagagacccggggggaccttttcatagcactgcgcgatttgccccgggtcggtaggagatatgggaccccgagaggcgcgtggacccaggcaaaagacatatctggagcgtttatacaaggggaggaaggataaacctccggagaagacaagaagggagacaacacatcacgcgtagtgacgcacaacaaggcggggccggccaaagccccccaccaaaggcgcaaggtaactgtcgcgccaaacacattcgttttctacccggcggggccaaaagcccgcgggacaagtcacggcccacaaaagggatccctccggacaggggggcacacaggtgtggctggtaaaaccgaacgggacgccagccgaaaaacagggagaggacggccagtgcacatgtgtgtgacgcacagaggcaagatccgcgggaacgagggggcccattaccctcgggaacccggaggggccagctagacaccgcacgagggggcacggggggcgaccaaggcatacatagagcacccagagtgatacaggaggacgcgacataagacaaagggataacccga

SEQ ID NO: 698285 - DNA, 381 bp, Homo sapiens
gtccctattttttataacgtattaactttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttcaaaataacaatgtgtatatgctgttttatatcctactttttcacttacagcatcacattttccaatgtcattaaaattctctgtgaatgtaaattttaaaaactgtacctactgttttttggaaatctgtaacaagctatgtgtaatcattcttctaatattaaacatattgtgtccagaaaaaaa

SEQ ID NO: 698286 - DNA, 210 bp, Homo sapiens
gaagaggtacgcagttactgggtactccagtctcctccctttatctgtatgtgtatccctgtgctggttgcacacatgcctcgttcactgatgtatataataagcctgcaccatttgtatgtcaattctacctgctcttcttatccatcaaaaatcactttaacttatctctgtccatttactcttccatataaatagttaatcaaccca

SEQ ID NO: 698287 - DNA, 142 bp, Homo sapiens
tttctgggaaggggccctccaacaagtggggaaaaccttccatcagggcaaaattttcaaaggaaaattttttgccataacccaaaagcctgcacctgcccttcaaggaaatgggggtccttaaaagaaactccacctttga

SEQ ID NO: 698288 - DNA, 1061 bp, Homo sapiens
  misc_feature (279)..(279): n is a, c, g, or t
  misc_feature (802)..(802): n is a, c, g, or t
  misc_feature (816)..(816): n is a, c, g, or t
  misc_feature (1019)..(1019): n is a, c, g, or t
gctccaatgggggtggggggcacaggcttcatacctagtggagcatcataggattagtgggaaaagtaggtcggtagcaaatggggatgcagcaatacagagtaaatccagtggtagtcagggtggcagagatgggtagaggcaagggtaattctttcttggaggcaagagaggaggaaaggcagaacaggatggatggcaggacctgtgtaagaagaaggtcttaaattctaaacaagggtatagtaaaggtagtgtggccaagagggaaagaggaancggtggatctggacagccacaatagcaagcaatatgggcaggggtgcatgggctcactgggaccctatccaaggtaaatggaaataatggagatgaagaaaggaggaagaggaggaagtggcgggactggctgtagagttttgtaggaactcacttcatggaacagaaagaaagaagaggagaacaaggcttgagtggaagaggggaaggaaaaggcagcctaagggaaggcgctggcctgaatcagtggaagatctggaggagcaacagaaaacagttcttgaagagaaggtgggatagagagaggatggaaaagtttgagcggtgagagagcaggtcaaagtagtgagcacatccctatggagaagagatgactgagcccgatgaagcaataggccctgggtggttgagagaaatatgggccacagacaggcaggtaccttcccttggccaaggaagcaaggagaagaaatgtggacgcaaggggaaaggcttcaagaaagaatgtggaagtgggacgatnaggcagcgccaacnggggagtcacctacagaagacagggtggaggggcccccagggaaggatggagggcagaaagcgtggtggaagggagctgggcaggacagccacaggcaggacagccataggtggagtgaggtgaaggggcaggtcccagagtaggaacaaaggaatttggagtgctcagagcagcctgcaaggttcagcatggggcaaggaangtattagaggggggaagtcgacgcggccgcgaatttatagta

SEQ ID NO: 698289 - DNA, 130 bp, Homo sapiens
gtctggtgccagtcctaagagctggtgcgagggctcgtggatgtgctactcagggaaatgacttaggttctcccaggtgctctgttgataaggatggaagcagaactactttgagacaccagcacgaatt

SEQ ID NO: 698290 - DNA, 996 bp, Homo sapiens
  misc_feature (279)..(279): n is a, c, g, or t
  misc_feature (903)..(903): n is a, c, g, or t
gctccaatgggggtggggggcacaggcttcatacctagtggagcatcataggattagtgggaaaagtaggtcggtagcaaatggggatgcagcaatacagagtaaatccagtggtagtcagggtggcagagatgggtagaggcaagggtaattctttcttggaggcaagagaggaggaaaggcagaacaggatggatggcaggacctgtgtaagaagaaggtcttaaattctaaacaagggtatagtaaaggtagtgtggccaagagggaaagaggaancggtggatctggacagccacaatagcaagcaatatgggcaggggtgcatgggctcactgggaccctatccaaggtaaatggaaataatggagatgaagaaaggaggaagaggaggaagtggcgggactggctgtagagttttgtaggaactcacttcatggaacagaaagaaagaagaggagaacaaggctgtggaaggatgccagaggaagaaaaggaaatgtgcagaagaaaaggaaatgtgcaaaagaaagtgcttccatgggaagactaccaggttagttagaatgcgaaaaacacaaaaaatgctaagtaagaagtataaaaagcacatgaaagaagtagtaaaaaaacgaacaaacaaaaacaggtataaaggggcattctggcccttcaaaacaatgatcttcaacagtaaatgcaagcacaagaaggctccaggcttgggaggccaaggtgggtggatcgcttgaggtcaggagttcgagaccagcctggccaacatggcgaaaccctgtctctacttaaaaagaaaaaaatcagctgggcgtggtggtggatgcctgtaatcccagctacttgggaggctgaggcaggagaattgttgaagtccagaggtgaggntgcagtgagccgagatcgcaccacctacactccagcgtggcgacagagtgacttcttcgtctcaaaaacacaccacccccaccaaacacacag

SEQ ID NO: 698291 - DNA, 424 bp, Homo sapiens
agccgaagatagaaatcaacaccaagagaaactctcaaaagcacacaattacctggaaaccaaacttgctcctgaatgactttggtgtaaaaaacaaaattaaagcagaaatcaaaaaaattactttaaataaatgaaaacagagatacaatataccaaaatcttggggcatgcagcaaaagcagtgttaagaggaacgtttatagccactaaatgcttacatcaagcacaaatcagcaaagatctcaaattaaccaatctcaatattgcagctcagatgacactcagaaaacacaagacacaaattaacccgcaaagctcagaaggcaaagaaatacactaaaatccagaaccagaactcaaatgtcaattgcaggctccaaaaatcccagcacaaagcactcccatgcaacccaaaaaagtt

SEQ ID NO: 698292 - DNA, 146 bp, Homo sapiens
tgacacgcacaagttccctaaggataacagcgcaatcctattctagagtccatatcaacacatagggtttactgaactcgcattttggctctagagatttccgatggtgcagtcgcaattagaggttcgtatgttcaacgatttat

SEQ ID NO: 698293 - DNA, 114 bp, Homo sapiens
gacagccgaggcacataatgagacctcacctccacaaaactttttcaaaattagctgggcatgctggcacatccctgcagtcccagccactcagggtggctgaggcgggagggt

SEQ ID NO: 698294 - DNA, 803 bp, Homo sapiens
gaacgaaaatctgttcgcttcattcattgcccccacaatcctaggcctacccgccgcagctactgcatcatatctatttcccccctcatatatgatcccccaccctcccaaatatctccatccaacaaccgacataatcaccaccccaaccacatgcactaactcacaactaaccttccaacacaccaaatgcataacccataccacaccccactccacaaggacgcaacctggatcctccttatcacatagctatccctctcactccatctttcattgcaccaacaactaaccctccctcgccactccatgcctcactccattctaccaccacaccaccccaactatctataaacctcagccatggacatcccccttatgagcgcggcgcacgctgattataggctctcgctctaagattacaaaatgccctagcccacttcttaccacaaggcacacctacaccaccttatccccatactagttattatcgaaaccatcagccctactcactccaacccaatagcccctgccccgtcacgcctaaccgctaaccattactgacacggccacctacttcatgcacctaattggaagcaggcacccctagcaactatcaaccattaaccttccctctacacctcatcaatcttcccacattcctaatcctactacttatcctacaaatcgcctcgtgcccttcaatccacgcctcagtcctcacactctagtagcctctcaccttgccgacacccctccacaccaacccccccccaacccccaccccatacaccaccacccac

SEQ ID NO: 698295 - DNA, 409 bp, Homo sapiens
cgcttgtagtatgtcatggaataatgtctcctctatagctgctcagttctcctggagtaccatctaatcaggactgtgtaatccatgtatcgcatggtctgtatgcctcactagagtgtactcttctccatggtaggatcttactttggtccaactttttatttccaccagtttatagtgccttgccatatagtaggcagtgttagtaacaatttaaagatcagtacaatgcaataaaccattatacatagaacggcatcatagctcttgaccagctaagaagagtacacaaaagaccttgcggtatttcgcatgatggaacgctcattcaaagcaaaagcacataaaccatgataaaatatgacaagctttccccagatgcagtctcaatcattagtctggaagagac

SEQ ID NO: 698296 - DNA, 215 bp, Homo sapiens
acaactcttgcatgtcgtgtgtctacacggtggatcccagctgaggcatgagaggcatctcagtgggggtaatatctcctatgcttcttgcatacatcactaagtggctaaatgattagcacttatctgctctatgagaaacatgcagaagcgtcaatctacctaagtatacatttttaaattgcagccgaacagaaattcactttgttgcagtg

SEQ ID NO: 698297 - DNA, 192 bp, Homo sapiens
gaaggtgctacggttcccagacaacggacccagagtgaggccgaggcaggacgggcaggcagcaggcaggtgtggggaccctggattccccggcaggggaacccccaaacaccaggccctttccagtgtgaaatggggcccctctttcagttaattattccatccctggagagtctggggcctccactgcag

SEQ ID NO: 698298 - DNA, 488 bp, Homo sapiens
  misc_feature (391)..(391): n is a, c, g, or t
cataacctttaatgagatcagcttcatgaaatggaagagagcttcatttgcatttgggaggaaaaaggatttgtaagtcgataggacttttggaagaagagcccgcctgggacagggagcatggtgctgttggccagtggggcaagatgggcagtcagaaaatcccaggaatctcaggggactttctgagcaatagtagaggaataaaagtaaattaacaaaatgtgcaaagagtgaaaaatataaaaagcaaactatttccaaatattctcccagatagccctactcaataaaaaataaggagtaaaattttcttttgttcccagaatcctgatctcttttactattactactataattcattttcattatgggctgatcaaacccacanggaacccagaaacctaaccagcattttccccaaaatatagtatctctaggactaggctctaaacaattgactgaaaagtaaactatggggacctgat

SEQ ID NO: 698299 - DNA, 592 bp, Homo sapiens
caattttataaaagtggatttccacaaaaaggttcttttaaccgccaattttctttttattaaagctgtgagggtaaaggtaggcatttgtcaaggttctcaaaataggctaatttgcaatcaattatctaagttcagtatttgtgtaaagatttatcttttagtgtgaaatctgtgcaaatcttatgtgtacattcactgagttttgacaaatgcagatacatgtgtaactgaacttatgactttccttatagaaacttcagaaagttccctcataccccttatctcaatcttgtcactaccccttttccctcaggcaaccaccattctgatgttttttccactatagaataagagttgcctgttttagaatttcatataaatgcagtcatacaatatttagtctttctgtaagacttattttgctcagcatgtttttgattttgtaacgtgtatcagtagtttctttttactgctgagtagatttcattatatgaatatgctgcagtttgtgtatcccttcaattgatagacccttaagctgattcctgttttggctattatgaataaagtcgcaatgaacattcttata

SEQ ID NO: 698300 - DNA, 781 bp, Homo sapiens
ccacgcgttcggcaacctccgcctcccgtgttcgagtgattctcctgcctcagcctcccaagtagctgggactacaggcacgcaccactacgcccagctaattttgtgtttttagtagagatggggtttcaccgtgttggccaggatggtctccatctattgacctcgtgatccgccccctcagccttccaaagtgctgggattacaggcgtgagccactgtgcccggcaaaactctgtctcaaaaaaaaaaagtaagaggaggaacacattcaccctcggtataatgctggtatatatggagagatgtgctctgctacaaaagttggtgataaaggattaattttcttaaaaaaaaaaaaaaaaaaaaaaaaaaaaaccaaacaccacaaaaacagagagggggggcgccgcgcgcgcctacaagagagagtattcccccgtccgaggggggggcgcgccccacacgggtttgtcgcgcgcgcgttacacgcgcgcggtttttttgtggtgggaaacccagcgggggggcgccccccatgagggggggcgcgccgctattattctaaaccgcctcgagcgagccccccgtctgacgcgcgcggcgcgcgtgttataaacccacgccggtccccgggagagagggggggacaaaacagaccgtgcgctcccggggcgggcaacaccctctgtggggagaaggggcgacccccctttacctcgccgccgggggggggcggggcgacaccccaatggcggggcaccacaacacactcccccca

SEQ ID NO: 698301 - DNA, 96 bp, Homo sapiens
taactggaaaaaaagtttattaggggaaacgggatagaatctattcccaatttctgagggtacaaactttaggggccttgaaaaattcaggatcct

SEQ ID NO: 698302 - DNA, 422 bp, Homo sapiens
  misc_feature (35)..(35): n is a, c, g, or t
  misc_feature (116)..(116): n is a, c, g, or t
  misc_feature (119)..(119): n is a, c, g, or t
  misc_feature (140)..(140): n is a, c, g, or t
  misc_feature (142)..(143): n is a, c, g, or t
  misc_feature (165)..(165): n is a, c, g, or t
  misc_feature (188)..(188): n is a, c, g, or t
  misc_feature (190)..(190): n is a, c, g, or t
aataagcccatataggtgttccactggaatggggnaaagaaaagcagaggtcggcaaaacattttgtaaaggacagattttgtaaatgcctttgtgggacatatggtctcttaaanccnagtaagctttgatgtgagtanannagtgtctgagcgctagtcttgnaaatggtgcagtgtacctgtgcntnaataccaacttatgatggacactgggatttgaatttcatgtgatggtcatgtgtcgtgaaatattattgttttgaattatgtttccagccattaaaaaaatgtaaaatctcagccgggcacagcggctcatgcctgtaattctgccactttgggaggctgaggcaggcggatcacttgaggtcaggagttcgtgaccagcctggctaacatggggaaaaaatgtctccactg

SEQ ID NO: 698303 - DNA, 112 bp, Homo sapiens
ggtagctggaaatggtagacactcaccgtctgccggtcaccttcgaacagtgagtgtctgctgccccagggtaacatcctgtccacctgacttgccactcaccacgccggag

SEQ ID NO: 698304 - DNA, 264 bp, Homo sapiens
acatgtgtatacgcgtgcatgcgtgtcatgtaatgtgtgtgtatgtctagcatgcttgtgattgcatgtgtgcatgtgtatacgtgtgcatgatccatgtgtatgtgtgtacatgtgagagtgcatctgtgtatgcatgtgtgagcgtgtttgcaagtgtgtctatgtatgtgtccgtgtgcatgtgcatgtgcgtgcatctgtgtatacataagtgtgtctgtgtgtctgcgtgtgtgtccgtgggccttatgatagggtacc

SEQ ID NO: 698305 - DNA, 117 bp, Homo sapiens
cctcagtaatgcctttcttgttgggtaggggttgggagtccccgtgcatcctgtttttggcccataaggggctgcagcactgtgggcgccaaagcacaaattaaattttcaaaccca

SEQ ID NO: 698306 - DNA, 235 bp, Homo sapiens
  misc_feature (25)..(26): n is a, c, g, or t
  misc_feature (196)..(196): n is a, c, g, or t
gatggtaaaacctcgtctctactannaatacaaaaattagccaggtgtggtggcaggctcctgtaatcccagctactcaggaggctgaggcagagaattgcttgaacccgggatgcagagtttgcagtgagccaagatcacaccactgcactccagcttggacgacagagcgagactctgtctcaaaaaataatanggccaggcatggtggctcaacgtctgtaatcccaagcac

SEQ ID NO: 698307 - DNA, 191 bp, Homo sapiens
tttttcccccctttaattttaaattattgggggccacccttccccggaccggggggggtaattttccgggccttttggggccccttgggggatttaagggatgggaggggtttttccccgggccccggttttgccccccccggggaattggggccaccccggcttttgaaaaaaagaaaaatttctttaga

SEQ ID NO: 698308 - DNA, 582 bp, Homo sapiens
  misc_feature (7)..(7): n is a, c, g, or t
  misc_feature (185)..(185): n is a, c, g, or t
  misc_feature (191)..(191): n is a, c, g, or t
  misc_feature (199)..(199): n is a, c, g, or t
  misc_feature (225)..(225): n is a, c, g, or t
  misc_feature (234)..(234): n is a, c, g, or t
  misc_feature (283)..(283): n is a, c, g, or t
  misc_feature (291)..(291): n is a, c, g, or t
  misc_feature (309)..(309): n is a, c, g, or t
  misc_feature (337)..(337): n is a, c, g, or t
  misc_feature (339)..(339): n is a, c, g, or t
  misc_feature (344)..(344): n is a, c, g, or t
  misc_feature (365)..(365): n is a, c, g, or t
  misc_feature (390)..(390): n is a, c, g, or t
  misc_feature (392)..(392): n is a, c, g, or t
  misc_feature (416)..(416): n is a, c, g, or t
  misc_feature (422)..(422): n is a, c, g, or t
  misc_feature (431)..(431): n is a, c, g, or t
  misc_feature (438)..(438): n is a, c, g, or t
  misc_feature (456)..(456): n is a, c, g, or t
  misc_feature (459)..(459): n is a, c, g, or t
  misc_feature (465)..(465): n is a, c, g, or t
  misc_feature (476)..(476): n is a, c, g, or t
  misc_feature (484)..(484): n is a, c, g, or t
  misc_feature (514)..(514): n is a, c, g, or t
  misc_feature (519)..(519): n is a, c, g, or t
  misc_feature (527)..(527): n is a, c, g, or t
tgcagtngacagcgtcaggggggtgggagaaaagggaagtgagggagggaagataaagaaaaggaattaagttgatcaagtggaattcttttttttttttaaattctggggaactatgaagtcttggcaagcacagctcggtcctgcagataatttcccaaccgtgtacaaatgggacccaaaanggagantcccttangaccctgaagaggcgcaacattaaangctacgatnatccagtagcaggtgtcccagccttcagtggccagccgctcctcctctnatccccangataagggggatgaaaangtctcccccgtgatggtttccattcctntntcctnggcatcggggcgtgcgcggtncagcaccttgaggaagtcagacgtntncgcccgcatacgtgtgtgaatatnggcctnagagcactngatgtgntagtgcaggtagccccgnaangtgtgnatcaggtgganggtgtagnctcgagcacgggcatcggggtacgagggancagcncaaggtantgtagccaatgttgtcacccaaaggggggactgtgtctaccagctccagaggagg

SEQ ID NO: 698309 - DNA, 221 bp, Homo sapiens
ggttgcaggtcacacaggggaggtgatagcatggctttcgggtacattatgtaatgcaaaatttgtgaatctgcgccttaatactttttgatgtggtttgatggggaatgatgagccttcggccccccgcttccccctttttggtcccccaacttgagatgtatgaaggctttgggtctccctgggagtgggtggaggcagccagggcttacctgtacact

SEQ ID NO: 698310 - DNA, 342 bp, Homo sapiens
  misc_feature (11)..(11): n is a, c, g, or t
  misc_feature (73)..(73): n is a, c, g, or t
  misc_feature (82)..(82): n is a, c, g, or t
  misc_feature (101)..(101): n is a, c, g, or t
  misc_feature (129)..(129): n is a, c, g, or t
  misc_feature (143)..(143): n is a, c, g, or t
  misc_feature (188)..(188): n is a, c, g, or t
  misc_feature (212)..(212): n is a, c, g, or t
  misc_feature (217)..(217): n is a, c, g, or t
  misc_feature (258)..(258): n is a, c, g, or t
ggcaggtaggngttactcttggcattatgatctaagagtcgtagattagagtttgaagacataatgagtagtnttattaaanatagctattatcattctgnatttaggtgcaatattcagaattcaganttggtaataacttnctttgagcactgtttcagcagcttttatcctattcatatgactgncagacatattccagggaactattntactnagccttgttgattgtccctgcattaaataaaatccacaggngcaaaattgtaaagtaggccttttagttcaatttgggcatctttttttcccgggggtgatattctcagtcccagggggtttgga

SEQ ID NO: 698311 - DNA, 432 bp, Homo sapiens
  misc_feature (422)..(422): n is a, c, g, or t
ccctgggtctgacttagtttgggggcatttaatgctttggtaaagttaatatcctcttactccctggcaaaactgttcattactcttacctcaaatgtacacttgatttgctgaggctttttaaaaacaggccggccggccgggcgcggtggctcacgcctgtaatcccagcactttgggaggccgaggcgggtggatcaataaggtcaggagatcgagaccatcctggctaacaaggtgaaaccccgtctttactaaaaatacaaaaaaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagnctccgtctca

SEQ ID NO: 698312 - DNA, 861 bp, Homo sapiens
  misc_feature (53)..(53): n is a, c, g, or t
  misc_feature (590)..(590): n is a, c, g, or t
  misc_feature (737)..(739): n is a, c, g, or t
gatagatcacatcagaactcctgtggggaggaaaggcttgataagtttaaacncatggcccccttagagaccacaggcgatgtctgtctccatccttccctctccttttctgtcacctttccccctagctggctcctttggacctaccccatgtccttagctgacattgtgtggcatagtattccaaacgtgttttacgggtactctctaagcaaatgtagctcatatgtgcaggacttatcatgaataccaaatctgctttttagtaaagcgtaaaaacatcacaaagtaggtcattccatcgaccacccttgtctctctacacatttagccttgaggggatctggatcggggtctttgggataacagtatgtagtctgtattagtatcgttatatgaaaaaggtgacacttgcagcttctttaacacaatatatacattgtgttgtagcttacattatactctagcatgtttgtttcttcaaccgctgcaagcttagtagcgtaaaatttgatacaagagttgggaacaaaaactaaggttatagtgatcgatattcttgaggataacagcttgaacaggctctaagntaaatctcaggctatggaagtctagtccctggtttattggcctggtaactcgtggtgccatgtgtgaatcttatgcgggtaatgattaaggagtgtggttaatttcttcaagacagaaccaagggtttaacataccctggaacgatnnnttcttgcagagcctggtgggtaagcgattgttgtaagcctggtatgggctttggcatttaggtagttgtccttggttaacatggaacttgtccagtatggctaaagtgcgtctaaaattaat

SEQ ID NO: 698313 - DNA, 859 bp, Homo sapiens
ggcgcgctttgggaccaggaaggttgagagagaggcccaggatgaggaggagcttggctcccagtcagctggccaagagaaaacctgaacggcaggtcctgtgatgatgacgactggcaacctggcctagtgactccgtaggaaactggaaatccagcagtgagacccgagatccaggagtgttccctgtctccttttctcggaaactttgagtcacgctaatcacatcaaaccaacttggtcgtggcacaggcagtcagcatgaagcattcattcgaagcattgtgtcaaagcctttcaaagtccccattccaaattatcaaggtcctctgggctctcgagcacttgagtgcctgaatagagggactgtgggtaccagccggagccctccatgaccccctggaaaaagatgccttggttctgtatgatgcctcccccgctgagcgctcatgaccagctagaagcttgacaaggagaaactccctgtccatgtggttgttgaccctattctcagtaaggttttgcggcctcatcagagagagggagtgaaattcctgtgggagtgtgctcaccagtcggcgcatccctggcagccatggcgtgcatcatggcttgatgagatgggcctaggaacacgacgcttgcagtgcatcacattgatgtggaccacctttccccaaaacacaccaaccaaacacacaaacaaaacaacacaagacagaccgacagacagccacaggaagaagaaaaggaggagggacgagaaaaggaaaagagacacagagagacaacaacgcaccaaagcgacagcagcgaaacacaacccgaacacacaagaacacagaacagcaaaccagcc

SEQ ID NO: 698314 - DNA, 185 bp, Homo sapiens
  misc_feature (53)..(53): n is a, c, g, or t
gatagatcacatcagaactcctgtggggaggaaaggcttgataagtttaaacncatggcccccttagagaccacaggcgatgtctgtctccatccttccctctccttttctgtcacctttccccctagctggctcctttggacctaccctgtcgggctagtcggggggaccgagctgattgtagt

SEQ ID NO: 698315 - DNA, 167 bp, Homo sapiens
ctctctatagatagtgctctctctctaccctactctctcccactccccagctctggactaacatacctgcatgtccacagaggcaccaatctgcaatgatagatgagactactctcacccacccatgctactcaggaaacttcttcacatatctcataacacagaga

SEQ ID NO: 698316 - DNA, 248 bp, Homo sapiens
acctggactaagccaacattaatccaagaaacagcatatacagtgccatataataagaatatggaaagttcatagctgtttacattttagttccctgtatactaataagtttcctaagatgttatataattaggtagtctaagataacaatataggctgggcgttgtgacttacgcctgtgatcccagcacttttggaggccgaggcaggccgttcacctgaggtgaggacgtcgagatcagcctggc

SEQ ID NO: 698317 - DNA, 412 bp, Homo sapiens
aaagggaaagccatgtggaagcgggaatgttgagccttatcataattccatttaattcaccactctgacctctgtaaaaaccagacactggagaatgaaagtggactattgaaaactcagccaagtagtaaccgtaactgcagcgtctgtaccagatgtgaaacattggctagaatagactaagacaaggtcagctacatggtttgtggccactgatctgtcaaatgttttcttcccccacccatcagaatggtagatcaaaaactgtattcccttgagatagaaaatatttatgatggacacacacacacgcgcgcacacacacaacacacatacacttacattgctccagagttccctattaggttggctgaggcttttgttgtgactgcatcttagtaaaatctctccc

SEQ ID NO: 698318 - DNA, 293 bp, Homo sapiens
ggtaattcatgctttttaaattcagccagccccccctctttgaaattttattatgtaaataatttgtgttccctgatccctcgtttaagtttttagttgtatgtcatcttttctctagcaggaattggcaaacttttttgtaaaggggtaaaaagtgaagattttaggctttgcaggccatatagcctttgctgcaaatgctcagccctgctgttgtaatgtaaaagctcccccagcccctccatgaacccgaatgagtgtggctggtgttccaataaacctttttttcccca

SEQ ID NO: 698319 - DNA, 240 bp, Homo sapiens
  misc_feature (61)..(61): n is a, c, g, or t
ctgcattcgttacaccatctcagccagatctgagctcctgacaaaatatgttcaccattancaggaacacaggagtcatcagtgtggtcaccactgggctggaccgagagagtttccctacgataccctggtggttcaagctgctgaccttaaggagggtaagcaccagcaacagcggtcagtcacgacacacgattcctccgatcttcaatccccacgtacagggtcaggtgcctgaga

SEQ ID NO: 698320 - DNA, 162 bp, Homo sapiens
agggcccgtgggagccgcttgctcgggatcggagtcgcttcgcacgccgtatcacccaggcccaggaggagctgagctcctgcctcatccctggtgcccgggtcagggcctgggcacgcctcaggaacccaccttgagcccccatccctgccctcacccaga

SEQ ID NO: 698321 - DNA, 409 bp, Homo sapiens
aagttcacacttatatgaatctgtatgccatatgccggccctgactcgtggaaatgtccacgtggacattaccacaaatcaaagttccagaacctgagtaaggatccttagtacttgagtggcatcttgttgacctggaggagcatttctcattgtacaagatggcctttgttctagctaaaatgtctggagaattcccaaagactttccctaatgtactaggcattttattcggatggactatacaaactcttcttagtcattatcaatctcggtttcttggtggtgcagtgaagggagaaataggtctagtttcctgcctctgattagccgcacagctttgaacaaatcacatttcatctttgaacttacctctactgtaagactaggtgactcgtggaattgtcca

SEQ ID NO: 698322 - DNA, 476 bp, Homo sapiens
  misc_feature (6)..(6): n is a, c, g, or t
  misc_feature (449)..(449): n is a, c, g, or t
agcccngacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttggccaaagctcccagccaaataaagcccttccttctttaactcggtgtctgaggggatttgtctgcggcttgtcctgctacagggttacagggcgtgagtaaccacatccaggcacatgtgtattaactttctttaaaacattttaaggcactgcagtaaatttgggtctcaaagttggacacaaggaggttcctgggccgggtgtaggtnaggtaggttttgcccattaatccaaac

SEQ ID NO: 698323 - DNA, 308 bp, Homo sapiens
gcggctccgggtacctcttttgcagtttccgccgtaccgaacaggcggctgatgtcgattcccaggcctttactgatccgcaccagcttgtcgtagctcagggataacttgtcgttttcgatcttggacagcgtggtcgtcggcaggccggttttctcgctgacctgtgccagcgtccaaccgcgctcgacccgaatcgccctcaagatgctgcctgggtgagcggtcgtggatttgccgcgcttatttgcctcattcggcaatgttccgttcgccatcgagcaatactagcgcctgcggctttggtt

SEQ ID NO: 698324 - DNA, 417 bp, Homo sapiens
  misc_feature (15)..(15): n is a, c, g, or t
ttggcccaaggcaanttcgttgggtcaaacaaaccaacccccagaaaaaggccagtgtggttacctttcctgtttacctgaaatttacccgggcagaccttatttttcccgtgggctttgaaattgcttcaaaggaggatccttgcagctttttcgaacggggggttgcagttttgtgcccaaagtaaacttttttagctgcccccttttgtaataatgaaaggtgggattttaccttttttccttttttaaaaatttggaaggtttgagcttgttaaaaaaaaatggttggttttaggttggaggaaactgaatggaatttttcggttgggagtggtggaaattggaaggatacccggagggttttgggaaggcccatggggggggtccttttaggaaattaaacccttagcctta

SEQ ID NO: 698325 - DNA, 196 bp, Homo sapiens
tacctcttctcccctgacaccctgatagcgcatcacgatgaaggcgatcagcaccccaaccggcaggaaatgattgccaccagagatgaacgcaggtgccagagaaagattccgcagaccaacgcgacgacgatgaactcttcgatcagcttgtggctgaggttttccacggcacgatcaatcaacttgctgcggt

SEQ ID NO: 698326 - DNA, 229 bp, Homo sapiens
atggttttaatttctatttccttgatgacatatgactctgagtatcttttcatgtgattattagccatttgcatatctcctttggagaaatgtctattcaaactgtttacccattttaaaaatttggttatttgtctttttattgttagttttaagagttctctatatgtctggacacagcccttatcagatatatgatttgcagatatttcttccattctgtggattt

SEQ ID NO: 698327 - DNA, 524 bp, Homo sapiens
cagtgttctctcctgagcatgaagctgactcttggtgttgcttcactgcacctgccatgtgccactgatgattgttcttgtcttcctctgggagagtaagacggagagcatgcagtctgagtgcttcccattttattgttgtgtactaagaacagtgtttttgttgtacatgagggtgatagctttaacatttagcaggcaaattgttttgagaacatgtcaagtgagagcttttttcctttgttctttgcttgctgaagggatccttgtggggtgggctgcttggtctgtcacatggctctcaaaaatagtctttctaattccagtattccttggtttttctgggcttctgaaggtttttactatgtagtgatttcagaaagttcattattgcttagtctgctgtgtttagttctcttcaaggttttgtaaaagagacaaaagcttttatttcttggtaggtaaagcatgttgaagttatccatttactctttttttcctttttttctttcctttctttctta

SEQ ID NO: 698328 - DNA, 216 bp, Homo sapiens
gtacgggatgcttcacagctactcgggaggctgaggtacgagaatcgctggactgggaggcagaggatgcagtgagccgggatcacgccattgcactccagcctgggggacaagagtgaatctgtgtctcaccaaataaaaaaaaagaaaacgaaagatgcttaccaaaggttaccataagccacaaattcatacccacttatccttccagtttca

SEQ ID NO: 698329 - DNA, 146 bp, Homo sapiens
taaatttggggggggcccggggggaattatatggtttgggggggtcccccccccccaatctcatgttgaattgggatcctgagttttgggggtaaagcctgggggggggggattgggtcctgggggccgatttcccccctgcggtt

SEQ ID NO: 698330 - DNA, 410 bp, Homo sapiens
  misc_feature (298)..(298): n is a, c, g, or t
  misc_feature (302)..(302): n is a, c, g, or t
  misc_feature (346)..(346): n is a, c, g, or t
  misc_feature (400)..(400): n is a, c, g, or t
ccatggatgaatggataagcaaaacgtgtcatgtacatacagtggcatgttactcagccttaaaaaagaagaaaactctggggtgggcacagtggctcatgtctgtaatctcagcactttgggaggccaaggcgggtggatcacctggggtcaggaagctcgagaccagtctggccaacatggcgaaaccccatctctaataaaaatacaaaaattagactctacctcaaaaaaaaaagaagaaaaagcagaagaagaggaagaacaggaagaagctgtggagacatggtactgctanaccngtaggaatgttgacatgatgctaagtgaaataagccagtcacangacaatgctatgtgatttctctatatgagatgtctatggtactcaatttaccgngacagggcag

SEQ ID NO: 698331 - DNA, 135 bp, Homo sapiens
cgtgctcgcttacgtgatcctggtcataggtgatgctctgtgtggtatagtgatacggtagcagaaacggggaagtgcattactacctcaaggaacatcatgaacactttcaaattggacccttgggtgaaattt

SEQ ID NO: 698332 - DNA, 174 bp, Homo sapiens
  misc_feature (40)..(40): n is a, c, g, or t
agcggggcacgtgtcgctgagtctagtggcggcacccccntgttgtggtcaggctatctgcccgtcaacgagtctttggcttcaccgctgacctgaggtcaacacgggcggcaggcgttcccccagtgtgtgtttgaccactggcagatcctgcccggagaccccttaaactcg

SEQ ID NO: 698333 - DNA, 1173 bp, Homo sapiens
caagcgccttctccgacaccaggaagcccacaccgcaccagaagaccaagatgtccagcgaagcgggccaaagccgaagaccaccaagaagcggccacgagcggggccacgatccaatgatctgtcgcaaatgtgtagaccgagtcccagagtccaaggagtattaatggacggcatgttcagaccattgatgtgaccagaaccgtgatggcttcgttgacaaggaggaacctgacacgacatagcatggcactcgcctgagggaagaaccgccgacagacgaataccatggcagggtcatgatgagcgaggccccggggcccatcaacattcactcatgtgtcctcactcagtgttcgagggagaagcatgaacggagaacggtacctccgaggatgtgattctgtaacgcgctttgcgctgcttcgaccgaggaagcctcaggtttcatccaatgaggactcacctccgaggacgctggtcacacacacatgggtgaccgcttcaacagatgacggaagtggacgagatgtaccgggaggcaaccattgataagcacaaggcgactctcgactacgtggagtgcacccgacatcctcgaaacatggcgccaaggatgaaagacgactacggccaaccaaagtccaatcggccgggagctgacggcacaagactctcatcttcctatgcgctagacccagcacatagctaccggacctcatatatagtgaaaaagcaggactacaccataacgcgacgacccaaaggtgccagaactggaccacaaagaacaggtccaggaatcaggccagaacaagaaatcacagggctgcacagtgaacaaaaaaacagcggaagaccagcgccgcacagaagaagaacacaaggccacaaatcagcacaacagactaacaggaacaccacgggcggagacacgagacacggagagcagccacggcgagaaacaccaaggcgccaacagaaggagaacaggcagcacgacaccacgggcacaaaaaacgagcagggcagggcacgcaacggacgccagccccacaacaaccggagcaagaacggcgaggaaacaagcaagacacaacaacaagagccagagagagagacgagagaaggcgagagacctagagaacgcactgcgcaagcgtctccgagaga

SEQ ID NO: 698334 - DNA, 440 bp, Homo sapiens
ggggggaccacacgcgctgcaaaacggtgctcacgggcaaggtggggggcctcctggcctttgccaaacgccgcaaattttgcattggctgccgcccagtgttcagcccccagggagccgtgtgtgagttttgccagccccgggagttttagctgtatcaaaaaaaggtatcccatttgaatgccctggaggagcgcttcttgcgcctttggacccagtgccagccctgccagggcagcctgcacgaggacgtcatttgccccaaccgggactgccccattttttacatgcgcaaaaaggtgcggaaggacctggaaaaccaggaacagctccttcggcgctttggaccccctggacctaaggcctggtgaccttgcaagcatcccatggggcgggggcgggcccagggagaattaataaagttttggacttttgctata

SEQ ID NO: 698335 - DNA, 238 bp, Homo sapiens
cgacacggtggtgttagacaggtgcggtctgtacgtacgtactacgtgctgccacgccgctacggacctgggacgacgactacgacgaccgtacgacctgctgtgactagaccggactacgaccgaccgacggggcgtttggtgttgggttactggccgggggtttactacttgactaacttgttgtgactgacacacttgactggcggggactcctctacgacgtcgaccctgcacg

SEQ ID NO: 698336 - DNA, 147 bp, Homo sapiens
ccatcttagtcagagtggttatgacctgtcagggtcacatgaggtctcgccagtttcctgggtcctcttcagaggccagaaagttctaagttctgagtccccggccagggtccctataacacctcggtcacagaaggctgttggcaa

SEQ ID NO: 698337 - DNA, 195 bp, Homo sapiens
agaggcatcatctttggagtcctgcctccagcggaacgtgtggtctcttctatccataatgtatgcacagaagctgtttatttattattggggaatgctcctgcagcatgctgacttcaccttgtgcaatccagaagaagagggatctgtggctaccgagcaatatcctggtgacccctgatgcatgttctgggt

SEQ ID NO: 698338 - DNA, 180 bp, Homo sapiens
cgagatcgcgccactgcactccagcttaggcaacagaaagagactccgtctccattaaaaaaaaaaaaaatcagggatagaagggctcctgaatgctttagtcttactgttgtaagatatgaagaggccaggtgcaggggctcacaccagtaatcacagcacttggggaggctgaggtgg

SEQ ID NO: 698339 - DNA, 171 bp, Homo sapiens
caagccccctatcttacttttcaagtgccatcctactaagcactcatactatatgcatcccctcagctacacacgagacaacacacagcacacgcatgaacacagcacacacacgagcacagcacacacacgagcatacagcacacacacaaacgcacagcacacactgtt

SEQ ID NO: 698340 - DNA, 857 bp, Homo sapiens
cacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctcttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattaaattaaacaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataaactctgcacttcagcctgggcaataaagcaagacccagtctctagaaaaaaaaaatgattaggtaaagaaaagaaatcaaattttcacaatgggagaatgtggttttactatctgctaggccccttccatcaattcttattaaattctcaaaataatcctttgaaaagggagtataattcacattttacagtgacctgaaccttacccaaacaagtgggagagcaggagccaaatatcaggctccaaagcttttttttagtgcatcacaatgacaaggggtgggttctttcacccaagaatgtgcttcctggaaattttttagatgaattc

SEQ ID NO: 698341 - DNA, 449 bp, Homo sapiens
ggtagaaatgaggaacgtgttattggacaggtggagaaaaggtgatccttgttataaagtagcaaagaactggctgaattgtgtttacgtattagtgtttgtagagggtaggacttgtgaacagtggaatggggatttaggctgaggaggtctctaagcaaagtgttgaaaggagagggtttggtcctcctgactgcttataagtcgaattttgtgagcagagcgagactcccatctataaaaaaaaaggaaaagggaaaaaaggaaaaatcctatattgccattgaatgtgccctttaaaggtgattctgatgaggcagtcagaaagaaatgaggagagctgtagagaaagcttctgctttcttaaagaatacataagtaatcatgaacagattgggggtagaaatatgggtggttaaaggctgttctgatgtggtctcaggtagaaa

SEQ ID NO: 698342 - DNA, 101 bp, Homo sapiens
ttggtcgtgtggcgtgtggtgtgtatgttgacgtggtgtgttgggtgtgaatgtggtgtgttgtgtggtgtgtgtttagtgtgtgagtgtggtgtgtggtg

SEQ ID NO: 698343 - DNA, 401 bp, Homo sapiens
actagtgtactatttgtataccaattatttagatatctgggacgaatatgttctagttcctttaacatagtaatacataccaaagctgactcaagcaagttatagataaatctgaatagactcataccaagttagaaaagattgagctaatattgaaaacactttccatcaaagagaacaagattttattaaatatttaaagaagatttaacatcaatctttcacaaattcttccaagaaaagaacaagaagaaggagaagaaggaggagaaggaggaggaggactttcatacttattctagaaggtcaatattacactgatgccaaaaccagaaaaagctaccacaagaaaactacagacaaatatctcttatgaatatagacacaattagatagtggta

SEQ ID NO: 698344 - DNA, 157 bp, Homo sapiens
cagccacttggtagtacctcatggaggcctgtccatggctgctcatacacttctacactggacattggtctcatagttggcccaggctttggctgctctcccctcatttcctgatgccgggtggtgtatgttaggtcccagctcagcaggtgtgtct

SEQ ID NO: 698345 - DNA, 501 bp, Homo sapiens
cactcccttatatggaatttcaggtgtgtattttttatttatttttattttttattttgggagtacccaggctggattgcagtggtgcgatctcggcttattgcagcctccgcctttgggggtcacatgattctcgtgcctcagtctcctgagtggctgggattacaggcatgcaccaccatgcctggttaatttttttgtattttaatagagatgggatttcaccatgttggccaggctggtcttgaacttatgacctcatgtgttccacctgcctcagcctcccagagtactgggattacaagtgtgatccaccatgatctggcctcactccagcttttttgtattttcagtagaaacaggattttgccgtgttggccaggctggtcttgaactcctagcctcgagtgatctgcctgccttagccttccaagatgctgggattacaggtgtgagccaccatgcccaagtgggtttctggtctttaggtaaactagtttg

SEQ ID NO: 698346 - DNA, 216 bp, Homo sapiens
tacagactgaatgttttcatgttacttatactaacattagtttcttctatagggtgatagattggtccaattggcgtgtgaggagctcagtttatatgtttgggattttttaggtcgtgggtgttgatcttgaacgctttcttaattggtggctgcatttaggcctactattggtgttaaattttttactctctctacaaggttttttcctacgtg

SEQ ID NO: 698347 - DNA, 179 bp, Homo sapiens
atctagaggaccagaagcgcaggaggaaggacatagagaagacgacacacaggggaatgcaagacaggaggaagacagagcagggagatcaaaatcaccagggataagagcagcgaggacggaagacagggggcacccggaagtttgccctgtgaaggacagcagagggcagaggggtg

SEQ ID NO: 698348 - DNA, 113 bp, Homo sapiens
gtatatggtgagccgtatatgggtgagccgtatatgggagcatctgaaattatgttagccttggcctagttatggtgaattaaccttagcatatgatagttctcttaatgttt

SEQ ID NO: 698349 - DNA, 145 bp, Homo sapiens
atcgcggaccttcgctggcgggcacttagaggtggggagcgaaatctcttatccaacatcaactatctggtcgattgaactcttcaatctctgcactcaaagcttgttaagatagttaagcgtgcataagtgcccgccaatcgaa

SEQ ID NO: 698350 - DNA, 1463 bp, Homo sapiens
  misc_feature (314)..(314): n is a, c, g, or t
tgggatagtgggacaacataacaccaaattcccccagcccagcttctgggggcatgcaaaattccttccttaccacgccgggaccaccttcttcatatacactgtggaaaaactgtggattcctgtgttagcgagaacgcccacaccgcccctgtggaacctgtggcgctgtgataaccgggtggaaacgcagcaccggtcccattcggtttctccgagaggtggtatttcacaagtgggcgcctcatctcggtctcctcatctcttctcgggtacacccagaaatatattattctcagagaacatctcttttnaccttttctccccgctatagcgcgcggtttgctgtggagaaacgcccagacagggagaccaccgagaagcgacagcgcgagagcggagagcccaaaatgcgcgcgagcgccacagagcacaccgcggtgttcgtgctctcccacacacaaaaagggggcgcgcaatagagagcgcgcggcctctctctctcccccccggcgcacacccggggggctcctctctctcaccccacgcggtgttgtcgcccgtgtctcccaagagaggtgtgcggaagagcggccccccgagaaggaagagaagctcccacgaaagtgaacccctttctctcccccccgagggggacactctgcgggggctagtgacctctcccggtgggaaaaaatttcccgaacgcgctatacgagagaaaaaaggcctctgtgaagaaggctcctaaagagttttaaaacccgccgagggacaccccataagggggcgcgtgaaaaaaaagagcgtccgttgaaaaacgacatttgtggcgaaacaccacacggcgcgtgggtggggcaccctggataattaagggagacgttcgtgtaaacccgctgggaaaaccccgtggtggggggttctccaaaagacaacctctagctttctctcttaaaaaacatgccggccaagaagatgcggggcccccggcctcctcactaacgaaagttattatcccccgtccagcaggggggcgccaccaaaaagccatatacccgccgatggaaccaccaaaggttctgatcctttgtgtaccaccaaaggggggtgggcccccctataatagggaagagagctcccggatatatataaaacgactaaaggacacctgtggcccgggctgtttttaaacaaacccgtctcgctgtaccgcggcgcacaaacaaccggtctaacccttggggacccccttgtggggaaagcaaccccctactatctccgggggccgtggcacccaacattgtcgccacacacaccctagaagagagattaaacgggctctcaggcgcagatattatccaacttctcagcaggttattccggttggttgacaccaacagccgcggcattttgtctgctcgctgaacaacattggctctcgcgacaatggatcttaaatc

SEQ ID NO: 698351 - DNA, 585 bp, Homo sapiens
tttgtataggtactagggagcagattaaactatatcagagtgtactttcaatatcaaagcagggagaggccaagcatgaaagttcctcagatcagaaaggcaggctgtgttccatgccctgaagagctatataggaaaacagtgtggaactataaaaacgtactaaaaaattaaaaataagtggcttctctagcgtattccaacagattctaagattacacagcaggataagactcaactcctaactactttcttcattgcatggcattaaatggatctaacgtgtggttctccaaacttacttgaacatggagcaacatacaagtgctgccactcggatggcctgccccactggaaggcacattacttcgtcaccaatcacaggagaggttcatggaacaagcaaataccaccgcgacagaggccctgaataggatcccagaccttatctttgtacccaagaccaggcgtcaggaacatttctacttctcagtgccaccaggggggtttgacaatgctacttaaataggtggaagggggtgccccaaagagaaattttggtaaattaggattaacagaaagcct

SEQ ID NO: 698352 - DNA, 110 bp, Homo sapiens
acaagctgagaaacttgaactctatatcgagttacacaagtactccctgataaaggggaattcatgcgtctacaggatgactgaagaaattgtagagacgagtgtctccg

SEQ ID NO: 698353 - DNA, 1004 bp, Homo sapiens
tggatggaagaccaagggttgccaggcccacggtaactgccgagctgcctgctgtcaggtgacactgagggagtggctgtgttttttccgggtgtgggaggatgggtggtcagagccaggagtatggagatctgagaccgtgagcagggaaaaaagccaggtgctaacattgcaaccattcctcacgccaccgccacattcagagcgtggtgtgggaaccctttgtgcgtgctgggagaggcgtggaagcattatttccccaagagcacgtgcccgtgggcattcatttcccttccgtgcgaggagcttgagccagttccccttcacagatgtggtctaaactgaggctgagtgttgggacgggcagaggcacaccggtaaacgtggcatccccttaggcgcctcttggggaaaggaaagtgtggatgcctccttggaggacaggcaaggggctgggagtgggtagccgtcatgtggtcccccggggaatcccattttaaacttgacccagaatggcctggggctcctttcactttcagggggcctgttttcctgggccaggcttgtgtagcacttcccaccctcaggcatgagtacagacgggtcaaaaggtttatgcagtcaaggccaaagcctgccctgagcccagacacactcggtggtcccattctgggggcctgggcccctaaacaatctcttctcagcagaaaggcgaactccagagtcaggtccccgaaatccccgttccagagcaaaccactcagggatttcctatagggggtaaatacgcgttgaagttacagccctgtgaagcggagcaggtcccattcaaaacagcgttgcgacaactactcgggccaaggaaaagcgggaaaaccccctggcacccgaggacaaaggggctgtctgtctgggtcccgacaggcaagcggaacacaggcaaaagagacgcgtgggagataggctcctcgcaggttgacgacacactccactagggtgggaga

SEQ ID NO: 698354 - DNA, 979 bp, Homo sapiens
gattccgaatggagagagcgagctgactgattgtgtgttcgcgtctcgcaaaccggtacgctagaatcatgtatgaccaattgagctgaaggagcagaatgactgaattcaatagaagcgtttcctcactactcttgaccagaagatggtgatggacactaataaacagaacatagggggacattgtgcgtaccctgtatctgattgtatctctgtgagagcaagaagtcccagcacgaatgcagtagtcatcaagcgacagtgcagtcaatgaaagatacgatgcctgattggcatgtggcagcagagttgacttccctggaatttctgacaatgctggcgagaataaatgcctgaccacagacagggatcgacgacatccatagaagacatatccgatgtgtgggcataaggatggcactggtttacattagtgctgctagaaagcttcgctcatgtgatgactgaactcttggtagtagacagttaccgagatggatcgtacaatggctgaaatgtgcgtggccaagccttatattgatggtgatgctccagtatactattgaagagttggttcacatgatgtacaggtaaggtgacagaccttgtcagactgtgtacagattttcttggtcaactgtgttgttcgcttttgcttgtagagcttcatcctgttacaggtttccgcctactggtcaaccacctttttgcctggttttgcttactaacgcgttcagttccttgccgttttctcccttaatctttcctgtgctgttctaaacccttgtttaagaacttgttccgggactgttgccgtgcgttcggcgggaatataagggggaggggctcagagtaaaggcggcacaacggagcgggtggccctcccatgtggggaacaggcgctggtggtcttccctatccctttggctcagggcggcgctgcgccgcctagtgtggctccatcgccgggcctactccg

SEQ ID NO: 698355 - DNA, 836 bp, Homo sapiens
  misc_feature (398)..(398): n is a, c, g, or t
aaagttaaaaaatacacatgtcatactgatctatacccgtatcaattcattccttcatctctttgccaagttgtccttcctttcagggcctgctccttccagctttcagaacagtaccatgcaatcccacttgctgctcaatattcgaaagataggctggacaacgcactcttttcaaattggccatcgagttgccctgctttcataagaatgtctacatatactaatgtgtgtcactgtctgtgcctagttcattggatttcgacattcctaggatgttcaaattcatcgactgcttgactagtatgcaaacctcatatacttattcatttaactccactattttaggtgttactctagagtctataacaacgatagaatgtgctcatcatgtctgnattaaagtgcacgattgcgaccgattctctctgaattggtcagcgcatgctctccctctgtgcgcagtgaactgcgagcgtctcttgttcatgccagtcccacttcgctatatgctagagcagaacagatggcgtgtgtatgtatcctcgagagggctgttgtgcgttcagtggagtcttttgcgcaagtcctgttgggcgcactttaactatcaaggaaggctccgatttcagcgcatttgatgagttgcacttatcaggagcgtaactgattgcgtgtcgatcatgtgactgtattactcacggtatacccctagtttaccttctcagatctagtgccatacgattttgccagccgagttctgtccgcagtgctctgaaaatcctttcctttctctattccctcgctaagtcttttgaagtgtccctcatgtactg

SEQ ID NO: 698356 - DNA, 124 bp, Homo sapiens
tcacacaaagccctctcctaacacctctactcctgcccacgctgcccccagggtggtctgctccccctcttccccagactcccccagtggccactcccttggcttcaccaggctaccaagactg

SEQ ID NO: 698357 - DNA, 287 bp, Homo sapiens
gacttgtgtctgtgtttttgttaactatgcacatcgatttgactgagagacatagcacagtttttcgctggtgaccgtttcagcatctgctaaccatgaaagtcaggacatgcatcatccatcctacctcactgttgcttcttttccagcaaaagttcagttttgtttgttttgaatttttaaaatcacaaccagaatgtccttgaggtattccttgtttgtgtttttatcttgtgagtatttgtttcatcctttattaaaaacatgtctttagagcaaaaaaaaaa

SEQ ID NO: 698358 - DNA, 112 bp, Homo sapiens
tcagaggggggaggatggctcgagctccggagtcagaggggggaggatgtgttgagccccgaagactgggtttgcagtgagccgagatggcagcatggactctagcgtggac

SEQ ID NO: 698359 - DNA, 419 bp, Homo sapiens
ctatgggatcaacagttttgtgatgagtctgagcctggatcctgccaatatcagtgtattggtcatagcttgtacctgctgtgacagcaactcagtgtgcatttagcagaaaggaatttctacgatggcatgacagacacttggagtgtgacagacatgagagaagctacaaggctctatctgccaagaactgagagcagggcgctgaacggacacacgccacagtttaaacgatttttaatcagatttaccattcaccattcagctaagcaacccagggacagacaaggttataggttcaccatccatttcatcaatggtgaaacgctttacatacattaagaatgacgttgacatatagactttcacattaatagttcttcgctacagtgataaagggatgtagacattataagcaa

SEQ ID NO: 698360 - DNA, 284 bp, Homo sapiens
agacggggacagaacgtttcactttagccagcatgagctacattaacctgtatttttccaacgttcagtacaaccttagtgggatttctggcgctgtggcaagaaatatacacacaccacagtacaggttagcagaaatatagaagcaccatccggtcaaaaccgtgctgcggagatgggagagcaatacacgaaggaacttttgtctacactcaatgcttacggaaaaatgccggacattattagatgttaagactcccaaaattagcattcaaaaagggtta

SEQ ID NO: 698361 - DNA, 655 bp, Homo sapiens
tgcgggccgagatgtctcgctccgagaacttaggctgtgctcgcgcattactctctcttactggcctgcaggctatccagcgtactccaaagatgcaggtctgactcaacgtcatcctagctgacagaatggcaacagtcggaattgtcctagacattagcgtatgtgtcatgggtttcaatccgatcccgactattgacacgttgacttaacttgaagaatggacgcagagcaatggatagagtggagcaatacttggacgttgtcgttgacagcgagaggagttggtcgtttctatctcattgtactacgggtgaattccaccgccccactgaagagagatgagtatgccgtgccgtgtgaatgagtgtgactagtcgcagcgaagatagtaaagtgggatcgaaacatgtacggcagaatcatggaggttggaagatgcccgcattgggaatctggcatgagattcctgattctgctagctatgctatagaatatgatatgcttatatacttacgactttatgcacaaaatgtagggttatgataaggtcgaacgatgggacatgatccttctttataattctactttgagtgctgtctccaggttggatgtatctgagcaggttgctccataggtagctctaagatggccg

SEQ ID NO: 698362 - DNA, 221 bp, Homo sapiens
atgtgggctaccgccacgtgctcatcccagcttcttgggcaggacatgcaccccaaacggggtacttgtctggctgggtccacagctcgatctgcgcctcacctggttggtgaaggagtcactcatcacgcagctggggtggcccatggcacaaacccaggttgaacagccgaccctcggccagcaggatgctgcggcgcacacttcttcaaccgataccg

SEQ ID NO: 698363 - DNA, 843 bp, Homo sapiens
  misc_feature (1)..(1): n is a, c, g, or t
  misc_feature (67)..(67): n is a, c, g, or t
  misc_feature (69)..(69): n is a, c, g, or t
  misc_feature (112)..(112): n is a, c, g, or t
  misc_feature (158)..(158): n is a, c, g, or t
  misc_feature (164)..(164): n is a, c, g, or t
  misc_feature (171)..(171): n is a, c, g, or t
  misc_feature (174)..(174): n is a, c, g, or t
  misc_feature (177)..(178): n is a, c, g, or t
  misc_feature (180)..(180): n is a, c, g, or t
  misc_feature (183)..(183): n is a, c, g, or t
  misc_feature (186)..(186): n is a, c, g, or t
  misc_feature (188)..(189): n is a, c, g, or t
  misc_feature (203)..(203): n is a, c, g, or t
  misc_feature (213)..(213): n is a, c, g, or t
  misc_feature (216)..(216): n is a, c, g, or t
  misc_feature (218)..(219): n is a, c, g, or t
  misc_feature (226)..(226): n is a, c, g, or t
  misc_feature (238)..(238): n is a, c, g, or t
  misc_feature (241)..(241): n is a, c, g, or t
  misc_feature (245)..(246): n is a, c, g, or t
  misc_feature (254)..(254): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (268)..(268): n is a, c, g, or t
  misc_feature (270)..(271): n is a, c, g, or t
  misc_feature (280)..(280): n is a, c, g, or t
  misc_feature (288)..(288): n is a, c, g, or t
  misc_feature (293)..(293): n is a, c, g, or t
  misc_feature (300)..(301): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (369)..(369): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (381)..(382): n is a, c, g, or t
  misc_feature (392)..(392): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (421)..(421): n is a, c, g, or t
  misc_feature (439)..(439): n is a, c, g, or t
  misc_feature (441)..(442): n is a, c, g, or t
  misc_feature (457)..(457): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (497)..(497): n is a, c, g, or t
  misc_feature (532)..(532): n is a, c, g, or t
  misc_feature (545)..(545): n is a, c, g, or t
  misc_feature (550)..(550): n is a, c, g, or t
  misc_feature (553)..(553): n is a, c, g, or t
  misc_feature (566)..(566): n is a, c, g, or t
  misc_feature (570)..(570): n is a, c, g, or t
  misc_feature (586)..(586): n is a, c, g, or t
  misc_feature (599)..(599): n is a, c, g, or t
  misc_feature (603)..(603): n is a, c, g, or t
  misc_feature (631)..(631): n is a, c, g, or t
  misc_feature (640)..(640): n is a, c, g, or t
  misc_feature (655)..(655): n is a, c, g, or t
  misc_feature (666)..(666): n is a, c, g, or t
  misc_feature (669)..(669): n is a, c, g, or t
  misc_feature (698)..(698): n is a, c, g, or t
  misc_feature (714)..(714): n is a, c, g, or t
  misc_feature (737)..(737): n is a, c, g, or t
  misc_feature (766)..(766): n is a, c, g, or t
  misc_feature (779)..(779): n is a, c, g, or t
  misc_feature (782)..(782): n is a, c, g, or t
  misc_feature (817)..(817): n is a, c, g, or t
ngttcggcccgtgaggggaagggaattggtggtcaaggggaaccgggggaaggagatcagctggagngnattgatttcggaggtttgtgttcatttcgcccgtaggccctgntcgatggggtttccaatgtcctttcgcccgggggttgagggctganatgagngagagcnagnggnnantgnggngnnagggcgcgcgtgcntccccccaangcngnnccgtgtngagaggatgctnccnaggnnaggggggngaggcngntnccgngnntgagtgggntgtgaggngaggnggggtcnnggttccgcgacatgaatgggncgntngattttgcgcaaggancnggntattgggtatgggcgcggtgngntntnatagtnngggagtcgangctggtggnttntnattgattttcgtggncgagggtccttctgcgtnannccgtgtgcgtcgtgncngaccnttgcntgggatcacctttgccccaccctccagngggtcacccctgttcaatggttgcagcctccctcntgtcttcccgggntccangcnttgggcccggtgnttcnttgtgtaaataagaantgtttggttttgnttcntgggccaagcaggccccaattttctttnggaaggtcntccaacaatctttcntccctcggtcntcntgttgcccgcataaagaataagccttgcnttgggattttgggccntggggcgggccggtaggggcccnttcttgtgccgcacacccggttcacccgntgttcccaagttngcntcttcggcccaatccccggggaaattccgggaccngggtacccaagccttgcttttttttt

SEQ ID NO: 698364 - DNA, 526 bp, Homo sapiens
tcgcagtcggagtccgcgctaatcttcgccaccatgccgcctacacgtggtctatatcccagttcgaggccgctgcgcggcctgcgcatgctgctggcagatcagggccagagctggaaaggagaggtggtgaccgtggaaacgtggcaggagggctcactcacagcctcctgcctatacgggcagctccccaagtaccaggacggagacctcaccctgtaccagtccaataccatcctgcgtcacctgggccgcactcttgggctctatgggaaggaccagcaggaggcagccctggtggacatggtgaatgacggcgtgaaggacctccggtgcaaatacgtctccctcatctacaccaactatgaggcgggcaaggatgactatgtgaaggcactgccccgggcaacagaagccttttgagaccctgctgtccccagaaccagggaaggcaagaccttcatagtgggagaccagatctccttcgctgactacaaactgctggacttgcgaaccggcctatggg

SEQ ID NO: 698365 - DNA, 933 bp, Homo sapiens
gacctgaacctgactgagctccgagccaggactcgggtgcctggggcggacgaggccggttctccgggacaggagggagagtgtcctgggtgtcagccagaacatgtcttcaacctgcaactcatcaaagaaatgttcactttatctgtaggaaaagtcactgtcttgagtctttctggaggctatgatttttgccttactcccaaagccacggaagaaacgtggctggtgaaattagtcctcatcacagggtgctggaggttggactcggagggctcttagcccttgcaggtgtgcccggctgtagactcctgttcttgtcctctgggaatatcaataaggaggggcaatgaggaaaacatgtaatgatggctcgggaaagctggtagcccatcaaggagtgcagcgcctattacctggcgaattgcatgccaaaaaggaaggagtggtatacggagttaaccccgaccaggtttatcaaaacgacacgttcggggaatggtttccactcctaatcaaacatgccggaaatcgtaacagcggccagcacgttcccttgactggtcaagatgaagcttaatgggaacacctcctttgacggggacatttcaacacgccatttcaagggctttttaaagctttctacctgctatgatggttatgggcccatgccattggttgcatgcaaggtccgctgtgtcccgggggacaacggcggcggatcacgtgccagaattgggccctggggtccggcctctgttgtggcaaccactgtccccacgacccggcgcaacccgctgggtccgccttttaaaagcgtttgtagtgcacaagccctgtgttcaccatgcataaaggatcataactgatgggtcgtatttacaacgcgacgttcacggcacacttaccatacttccatgaatttttacttag

SEQ ID NO: 698366 - DNA, 151 bp, Homo sapiens
ccttttgggggggggggaaaagtttccccgggttttccccccccttttccccccccggggttttttttttttccccccaaagggcgggggagggtttttaatacccaaggggttccccccccttcctttttaaaaattgccccccaaagga

SEQ ID NO: 698367 - DNA, 174 bp, Homo sapiens
aagcgcacgataggcgcgtccccgaaatcctggtgtgtcaatcactgtacagcttcatccggacgcctttctcctcaagtatcgtgcgtgatggacttgatctcgatggtcttggggtgtgcgctcctactaagtgtgggctgcaccgacgttccgtgctgatatttggatttg

SEQ ID NO: 698368 - DNA, 384 bp, Homo sapiens
cttctcctccccactcagtcctcggttccggcccggttcggttcgttagggtttagtagtggggaagaggaggaatgaatggcggacgtcgagtaccgctgcttcgtcggcggcctcgccatgggccaccgacgaccagtccctccagaacgccttctccaagtacggcgacgtcatcgactccgaagatcatcactgacagggagacgggccgttcccgcgggttcgggttcgtcgaccttcgcgtcggacgaggcgatgcgccaggcgatcgaggccatgaacggccaggacctggacgtgcgcaacatcaccgtcaacgaggcccagtcccgccgctccggcggaggcggcggcggctgcagccggcggcggcggcgggcg

SEQ ID NO: 698369 - DNA, 168 bp, Homo sapiens
ccgctcgtacagtttctgaaaaggggatgagaagagaggtgaacaccccctccccatacccaaccccctgctcaccctgatcagaggattgagtaaacggctaggctggagggggtaccaggtggccaggtgggactgtttcaaatttccctgatccccaggcttggg

SEQ ID NO: 698370 - DNA, 162 bp, Homo sapiens
gctggtccgctttcagagtagcacagactgaatataagcacaggaacactcgtgaaaccaactgagcttttcttttgcctagaagggctataatcctgccttctacatcagttcccatttatgctgaagacccagttgaaagaattgtttcctactctgtga

SEQ ID NO: 698371 - DNA, 463 bp, Homo sapiens
  misc_feature (38)..(38): n is a, c, g, or t
accctcttctgctgggttcagagatatcctgcctcagnctcccagtagctgggattacaggcagctgccaccacgcccagctaatttgtatttttagtagaggtggggtttcaccatgtggcaaggctggtctcaaactccagacttcaggtgatccacctgccctggcctcccaaagtgttggaattataggtgtgagccaccacgccctgcctaatgtttgtatttttagtagagacagggtttcaccatgtttgccaggctagtctcaagctcctgacctcaggttatctgtctgcctcgacctcccagaatgctgggattacaggcgtgagtcatcgtgcccagcctcatccttaataaattgaggttttaatttgcatttctctaacagccaatgctattaagcatctttccatgtgggtatttgttatctattttgatgaagtgattgttccccgct

SEQ ID NO: 698372 - DNA, 203 bp, Homo sapiens
gccatccgccaacaccaaatagacacgacattaagttaatataatggctgttatctgcagctggataattattcagtaaaccaaattatacaaatattgtttgtagcccactgtggtgtgtgtgttgagtgtgtgtgcgtgttagtgaggaggtgggtgctgaggggaaagatgagctgagtgttgggcgataacatcaggag

SEQ ID NO: 698373 - DNA, 253 bp, Homo sapiens
  misc_feature (22)..(22): n is a, c, g, or t
  misc_feature (79)..(79): n is a, c, g, or t
  misc_feature (146)..(146): n is a, c, g, or t
  misc_feature (196)..(196): n is a, c, g, or t
tctactaaacgcaaagtagagnaaatggaagtggatgacttctatgatgtaatcaaacggctctataatgaagataatntctcagaaaatgtgggttctgtgtgtgcactattttatcaagacaagaggacatcttccccttgtcnacctttcagcctgttctgtcatgtagtttaacaagtgctcctttgagtgnaactaaggaggactactttggaatagaacatgcaaaatcaggaaaggctgtagaagg

SEQ ID NO: 698374 - DNA, 407 bp, Homo sapiens
gcgtcgacccaaggccgagctggccgtgaaggactcacagaaaggtgttcaggaactgcgccaggaaagccagcgctccgtgcaaccggtgcagtaagcatcggccccgcttgacgcctgctttccctgaagcttgaaccctaaaaaggatgaaccattatgcgtaaacaattgatgatccccgccctcctggccctcagtgtcggcctggccgcctgctcgtcgcagcccaatgccaacctggagcaggcccgtaccaacttctccggcctgcaagcgaacccgcaagcaagcaaggtcgccgccctggaaaccaaggacgccagcgactacctggacaagaccaacaaggcctaccaggaccatgaaaaggtcgaaaccgtcgaccagctggcttaccgtcgacg

SEQ ID NO: 698375 - DNA, 107 bp, Homo sapiens
atgcgatttgttcctcatgcactttactatagccagcagagcatgaggaacaaatctgcatattttgctgaaacatctggtagctttgaagatgctctgccaagggg

SEQ ID NO: 698376 - DNA, 401 bp, Homo sapiens
gtctggaaacctagccctattctcacacatagtgagacagccaccccttatgccccaacaaagccgaatgccctaagaggccattaatttcttgggataaatggtgttctatggatcataagcctgctagttaatgaatctaactatgaaatctgtctgtctatgctgtttacaggttgagaattaaagtatattagatttctcctagaatctttacaatagtagctctgaatttatgggcatagagttcaaattttaattactcatccaattgggaagatactccatcaataatttaatttaagaccttaatttggtagggctaaaacttgtcatccatagaagaataaaaattctttctggagaaaatcatccttaatccaggaatcttagaactcata

SEQ ID NO: 698377 - DNA, 843 bp, Homo sapiens
  misc_feature (2)..(2): n is a, c, g, or t
  misc_feature (62)..(62): n is a, c, g, or t
  misc_feature (64)..(64): n is a, c, g, or t
  misc_feature (83)..(83): n is a, c, g, or t
  misc_feature (93)..(93): n is a, c, g, or t
  misc_feature (95)..(95): n is a, c, g, or t
  misc_feature (135)..(135): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (150)..(150): n is a, c, g, or t
  misc_feature (154)..(154): n is a, c, g, or t
  misc_feature (167)..(167): n is a, c, g, or t
  misc_feature (175)..(176): n is a, c, g, or t
  misc_feature (180)..(180): n is a, c, g, or t
  misc_feature (183)..(183): n is a, c, g, or t
  misc_feature (188)..(188): n is a, c, g, or t
  misc_feature (192)..(192): n is a, c, g, or t
  misc_feature (218)..(218): n is a, c, g, or t
  misc_feature (236)..(236): n is a, c, g, or t
  misc_feature (239)..(239): n is a, c, g, or t
  misc_feature (258)..(258): n is a, c, g, or t
  misc_feature (260)..(260): n is a, c, g, or t
  misc_feature (278)..(278): n is a, c, g, or t
  misc_feature (283)..(283): n is a, c, g, or t
  misc_feature (299)..(299): n is a, c, g, or t
  misc_feature (313)..(313): n is a, c, g, or t
  misc_feature (316)..(316): n is a, c, g, or t
  misc_feature (326)..(326): n is a, c, g, or t
  misc_feature (335)..(335): n is a, c, g, or t
  misc_feature (351)..(351): n is a, c, g, or t
  misc_feature (365)..(365): n is a, c, g, or t
  misc_feature (374)..(374): n is a, c, g, or t
  misc_feature (389)..(389): n is a, c, g, or t
  misc_feature (405)..(405): n is a, c, g, or t
  misc_feature (437)..(437): n is a, c, g, or t
  misc_feature (440)..(440): n is a, c, g, or t
  misc_feature (480)..(480): n is a, c, g, or t
cncttgccccccaccacccccccccccccccccccccccccccccccccccccccccggggncnccgcggggggggggggggngcgggttccnanacacccccaaacctgaccccgtccaacccccgcatttgantaaaccncangnncntttntttaatatttgcncagtttgnncttngcntttcngtcnggggggaatatgggcaaaacccaggnttaccatgctaagataanggntcatatgactgccatagangnggtacatacaaacaatgnaaacnaatcacatccttaggntccatgattaccgngangatttccccngccccaagngctttattatatttcntaaaaaatataggngcagcagcntatcacaagtctccncaagtgcattaatganggaatcaaaacaacacaacagattcataaggntgngagaactgcagaacaaccagaagtcagttttatgcttctncttgttctggataattcagaattttgcggtgtgcctgtcgtaaatattgctgctgtttgaagtaaactttaaatgctccttttatggcaacaaacgcaattccacccaagattgtcctttgtaaattagagttaacactactgaacatcaatttaccaactattgtagcaatagtaggaaagacaagggctccacacaagattcgagtagcagagacatgatctgctaaaggattggcctcagctggaattcgaggaacaggacaacctatccctggaaatatactatttaaaatttgtagtttattcgagtatttgcgccacagtctaagcacatagtcctcccagcgaatcatcttgccta

SEQ ID NO: 698378 - DNA, 98 bp, Homo sapiens
ccttatccccatactagttattatcgaaacattgctactcattcaacaatagcctggcgtacgctaacgtaacattactgcaggcactactatgacaa

SEQ ID NO: 698379 - DNA, 1449 bp, Homo sapiens
ggatcagcgatggcctcatactcccatgaagctgacagttcatcctacgcctcgtgtgggatcactcagtctatgccctccggaccatggacctagaaggacagaatggacagcctaatcgaggaacggagtgctggcacacagcatcgagcaggggtaaccacggaaaatggaccaatgaacgcacacgactggagcactggtagtcatgcacggtaatcacagggctgtctcgaagaatgaaatgcggccatacatgtgtggagacgattgcaaccagagaggtaggaatatccggattgaactgagaggttaagcctaagaagggaacgtcttccgtaggcagtggagatcacaatgccttcgagtttgctttggggaagcgttggacagcatggggcaggttccctctcgtgccatcatcgagcccacggtaatgggtcactttgcattgtgtccacctatgggatctagaagaacatcttctagacttcacctcttttgcgaatgcggtccaacagaaaggcgtgcatccaaggttgaacgaaagccgacagaacttgtggaagttgaccacacactatactacgagccccggattcgttgtcattggaggccccgatcacgagtccgggtcctttcacagtactttgggaaccaatatgcgggagacaggttacgccaaggtggccttcggtcgtccaatccttgccggtaagtaattgcgcgagacaaagggccaagtttggaaaaggtttggctcgcagaagtactcaacatacggcaatggcgaggcatgtgcgggaggccaattacatttaacgcgaatttcgttgcaaccatccggaatggcaaggacatggccccaccacccttaagaattggaagccacagtgggatccattcgcgcgtttggccccagtctgtgtaggttgggactcggggaaaaggatgccgggaacgaaacagcggaaggataagtgggactcccaagttggctttcgagaggagaagcagaggtagggggggaaagaaatggttgtgggtttgggacattacggttaagaagggaaattgcctgggaacgtagtttggaaggcaaaaagggctatagagattgggaaagggcattaccgttcagaaggaattttgggggccctggggtgcatcgtagaaggccatttgggtacattggactcctggaagcgggaaacgtgggcacggtaagatgaagtttgagaggggaggcacagtcgggatagtgcaaactctacattttggcaggcttgtggtaacctttgggaagatattatacagtgcaacagtcgtttggccacaaagtggggcagaggtggaacaaaagggaagaggcacttactaaaaagggcagcagtattcagaggaatgacgcacgggctattgggaaggcagagttgtaagggagtgtgg

SEQ ID NO: 698380 - DNA, 835 bp, Homo sapiens
gagagcaaagagcgagcgagggagaggagagagagagagaggagagagaaagactacacgcgcggcagagacacacggtcactggaattccattattaaataagtgagccgagcaatggtgttatgcgggagaagatttttcttgaactcgttgtcttcgtcttggtgcgaaagaagcgactccagtctcgtcgtcctcgaagctccgagctggattgttcttgggcgctgacacccgtctgtggtattgcttttcgtatttgcattttattccgaccccctccctcggcgcgttccttccagcccgttcatctctgcaaatcgccgtcgtctccctcgactcccctaggtcccctctcgtgggaagctgcaggaggaagttggaccgcgcggggaactcaacgccttcacggacgatatggaggggagggctgagccctggacgtgggcatgttggcttatgacaagccgtatacatcacgatacgcgtatatttgacttgtagcgggcaaggggggcgtcgagaggcagaagcccagtcgcccgcctctcacgccgagccccatccagccagaggcgaagactcggaggacctcgggcgatcttcatcgggtggaactagcatgggatctccgcattggatttggggctgattaccacgtgcttgcctattatgagggccgtagtgactactatcatctatctctataccaagggagaactgacaacaacacatggtgcgcataccttaacgcatgactctggcaaacggtcgtctgcctcttcttctttttagggccccgtagctccacgctggcgccccccagtggacgcg

SEQ ID NO: 698381 - DNA, 881 bp, Homo sapiens
agtacataaactaaagctactccaatgctgaccagtaatgggcccagcacacctcctattgactaaccactgacatgactttcacaaaagaaacacgataattctgaatgcaacacaaccgacccacaggctaacttgattagggagtcatcccgtctactatttcttaagcagatcaacactaaagctatttagctgttccccaagctttgtactcggaccccctagagcaacccccctcctaatattaactgacctggactcctagccctcacaatcatggcgaagccaacgccacttatccagtgaaccactatcacgaaaaaaactctacctctctatactaatctccctacaaatctccttaatgataacattcacagccaagaactaatcatattttatatcttcttcgaaaccacacttattccccaacttggctagtcatgcaccgcgatgaggcaaaccagtcagaacgcgctgaactgcatggctagcatacttcctgattactagaccctagtaggctcccttcccctactcatcgcactaattttacactcacaaaccctaggtcactaagacattctactactcactctcactgcccaagaactatcaaagtcctgagcccaacaaattaatatgactagcttacacaatagcttttatagtaaaagataccctctttacggacatccacttatgactccctaaaagcccatgtcgaagccccccatcgctgggtcaatagtacttgccgaggttactctttaaaactaggcgggtatggtatatacgcctcacaatcatttctcaaccctgagaaaaagataggctacccctcctgttatcctttgaaggctaatttaaaaggtcct

SEQ ID NO: 698382 - DNA, 139 bp, Homo sapiens
  misc_feature (72)..(72): n is a, c, g, or t
  misc_feature (119)..(119): n is a, c, g, or t
aacgggctgcgcaccacagaggaggctctccatgccagccacggcttcatgtggtacacgtaggcccttgtnctccggccacctggatccctgcccctcccactgggacggaataaatntctgcagacctgaaaaaaaa

SEQ ID NO: 698383 - DNA, 311 bp, Homo sapiens
agatcccgtttattttttatcactaagttacaaacatcttacaatcaccaccttggtcagaaacatagcattgccagaatccctgatgcttgtcccttttccctatcccagtcaccactcgtggtcccaccctcaaatatcaatcactttcttatttttcctgtatacatttaccacctgaatattcatccgaaataccattggtctacttttgctattgaacaaagggttatctactagtggatatccatagcacattccctcttgaaccggctccttttgctgccgtgtttgctagactctgttgtcta

SEQ ID NO: 698384 - DNA, 942 bp, Homo sapiens
  misc_feature (201)..(201): n is a, c, g, or t
attaggatagggggctgtattgcccgctcctcctgttgagacgtggtgaaggcttgaatagggcctctattatgataagcgccgggctcagcgtccctgggtttaataaacgggcaaaaactcatgtgttccgcatgtttgatctagtggtgcgcgcaaattggttgcggacgagcagttgtgctgtgcccttcatagggntgtcacaggccgccacagatggtgttgcaccacgccgtgctgtacagctcgtgccaccgatgaggggctcgctaattgcctgtcactaacgaagctcgaggcaggtttatctgtcagggttgcccccccgaattattagcgccggcttctaatccccagcgcccctccaaatgataggggccccggccttttcttatacaaaatgtatagaatgtggtgatgtttcgcaatccccgattaatagacgctcggactgtcctatctctagataaatttcataagcgtactatgtggagaaaccaccctattgctcgttatacccttgtgcggagacacttatgtataggaaaaggggggagaatgtaatagtggctctaaaatcagaagcgaaaggaggtctcacaagacacccccacgagtcgaaagaaggcttggttgtctcgattaaggaagcccatcaaaacaaagcgtctttgttatctctaccttgagtcaaggcgcggcaggatgcgtgccttcgaaacccccgatgtacccggcgtggtggtgactatcttttttactttcctcagagccggagttttcgttgtatgcggtacccaactatttaggattgtgaggatcacgccgattagccagagtctccccctacctgttcacggtgtcaacaaaggagggaaatcttcgtttttggggcgcacaaaaagaaaatatgacaattaaacgccccacatagacaac

SEQ ID NO: 698385 - DNA, 723 bp, Homo sapiens
tccctctcttaccatcaaatcaattggccaccaatggtactgaacctacgagtacaccgactacggcggactaatcttcaactcctacatagcttcccccagttattcctagaaccaggcgacctgcgagctccttggagcgttgacaatcgaggtagtactcccgattgaagcccccgattcgatagtaactaattacatcagcaagacgtcttgcactcatgatcgtgtccccacattaggcttagagaacagatgcaatgtcccggacgtcgtaaaccagaccactttcattccgatacatcgaccggggtgtatactacaggtcaagtgctcttgaaatctgtggagcaaaccgacagtatctatgccgcatcgttcctagaattaattcccctaaaaatctttgagaatggggcccgtatttaccctagtagcaccccctctaccccctcgtagagccgaaaaaaaaggaaggaccaacaaaaagacgaggacagaataaataagcaaaggacagcaagaaacaacaaagaggggcggagccgccgcaatgaggcaccacccggggagcccgcgaatactggggcaaccgaccccttacgttcctgagggggggggcccctaggggcgacagggttaatatacgaaggagtgcacgagcgcgacggtaacctataccgcgtggggaggcagcacaaacggtgccgggactacctggga

SEQ ID NO: 698386 - DNA, 361 bp, Homo sapiens
gcgtcgacgctgagcaaaagatataaagttattagtagcctccatagtctagaaaacagtgctgtttgaacgaaatatgatggaagccacataggtaatttaaaattttctaagagccacattaaaatagtaaaatcaaaaaagaggtgaattcattttaataatatatttatttagcctgttgtatccataatactatttcaacatgtaatcaatagaaaattattaatatgttttactttttttcacaacaagtcttcaaattctggagtttattttatgctttgagcatgaaactagccatattttgaggactcagtggccacatgttgctgtggctaccatagtgcacagcacattc

SEQ ID NO: 698387 - DNA, 775 bp, Homo sapiens
aaaaaatgaagtttcctccccctctccgggagaatctcttcacttgttgagcacccatgaaaacgccccatgaaggagccattcacggagtatttaccaggccctcttcagttatgccggggcacactacggtgagcaagacagctgtggggcccgccctcactggaactcaccaccttagggggattgtcccattacaaattggctgggggaggccaggcacgatgggctcacacccataatcccagcacgtggggagggcaaaagcaggtgggatcacttgagctcaggagttcaagaccagccgggggaaaagggtgacaaccagtctctacaaaaaatacaacaattagccaggcttggaggcgcacacctgtaggcccagcaacttgtaggactgaggcgagaggatcacttgagcccaggaggtcaaggctacgtgagccatgtgcatatcactgcttccgtctgggagacaaagtgagacccgtgtctcaacaaaaaaccacaaatgccgtcgacggaatgttgggagggaactcacggggactcacagacccgcttacacaggggaccttgacgcccgtggtaaaaagaactttcagtggccccaggcgggcccccactgggggaacccggtttctttgtggaaaaatacaaatttttacccggcattggggggcagctgtaacccccgtatcagagcgcacgttgcatgacccaattgccttgcctcagtgggaaaagcaaactttcactcacagaagagacatag

SEQ ID NO: 698388 - DNA, 1557 bp, Homo sapiens
  misc_feature (280)..(280): n is a, c, g, or t
  misc_feature (299)..(299): n is a, c, g, or t
  misc_feature (314)..(314): n is a, c, g, or t
  misc_feature (368)..(368): n is a, c, g, or t
  misc_feature (521)..(521): n is a, c, g, or t
  misc_feature (736)..(736): n is a, c, g, or t
gctcttaccttattacctcaatcaaccattagtccaaatcattttacccaaattaagatacttagctactctcacctagagacctgtgcgcatatagaatataagttaccagcaacacggtgaagaagaactcgaaaatagtataactgaaaccatcgtcgatacagtattacgactaacggtagtacaccccactaaattaccctatgcgtgctaatacactggacagtttagcttcatggaatactatatcttatgtctacacggcacgtacgtcctnagagtctcacacgaacccntcccgacaaataacncagtcaatcagaacctacccctgaagctaaactagccactcaacacagcaagancacaagccacgttacatcatgatacgtcaaaccttcagatggcgaaagtgatattacatccggttaagaagagacgaactaaaagcgtaagcagacagctgtaggctgcatttaagtcatcgtagttgtccccatatgaactcacgaatattncttaatgttgtccaaacatatttcaaaactcttttcgctcccgagcacgtacactcgcttcctttcaatattccactctcttattgatccacaaattctgcaaaaccctaagatataagttcttcaattaaagaacgcgaaagccaggactggcgtgcctctgatgacaccccacctttaaaatggaaaagagccgaggaggcccgttcggagtnaggcaagtctaagattaacggttgacacatttaatagcagtcctctttacctcacaagccaactcatttacacgatataaaggtgcgccccttcaataaagaaaggcccaaggcgttttacatttctaaacttctataacagagaaggcagacggaatctcttaaaaggaagcgtccccacatgataaattccacaaccctaaattcacctttacagtctataacatttcacttccggaaaaaagtcaaatatacagttgtccttaactctcctatctatcaaaacgccataatttagaggcacccctgggggtccgtaataccgacccctttaaatccggccattccaacctattatactgcgtggtcaacgcggcactcaacggccttaaaacttctgagatgaacaaagccaatataactttcggggttcaccaggccgagctccaaaggcccccttgagggttatcgttagatgtataagccaatttatatttggccaatattctcgcctccataatgacacttatagttccaatatcctattacacccaacatgtgcgcctaaaaatgtgcgtataacttgaactgtacattaccttacagaacaatatccgggcgtaggttcaggaccttctaagatcgccgacaagggcccataacacagtatttttcacaaccagacttttctttagggatcaaaggccagtacttacaccactgtgcatctcgacatgcagacaccaattaatcaagctctcacagaccagcaacagagacagctcccgcgcacggcgcatctctatatcacttcacagggg

SEQ ID NO: 698389 - DNA, 1145 bp, Homo sapiens
agcggagcggcgcagggataacccgcggccgcgcctgcccgctcgcacccctctcccgcgcccggttctccctcgcagcacctcgaagtagcgcccctcgccctcctgctcgcgccccgccgccatggctgcgctcccccgcgcggctgcgtgtcctggccctgtaccggggctggcgctgcgtcctgtcgtcctgtgccgtggggccccaggtgggcattaagtggaaatataactccagctgatgcttcaaaaacgagaaagcaccctgtgtcccaaacctatagacataataaggtgtggccgtggagtagagaaataaaaggccacaaagaaaattttcctttgtgcgagacctgtagaagcggcccagaaaagcggggcgagcgttgtgtgggacccggacatctgcgcccccgagggtgcgacgcacggttgggtgaccccacgcgacgatgtttcctcttcatcacttgtggggcgtctttggaggcgcagaaggcgagaaattttggagagagttgtagcaattttaccctatattgggcgtttaaaccaagaagaagtctgcaaaaatggggaccacttgtagaataatccttatagggcgagtataaccttaccccaaacgctttacctatttgaattggagagaacatcttcgtcaacatttggggtgccccccgagaaggaccccccttaacagggcgttttaagggcactgggagagcccaagcggtgtcaaatcctatcagagatggagcctatcctataaaccacttgaaccttggtgcccacaacggcgttgtgtacaaggaaaagccaaaattaagcaggaaattccttctttccacctgtgactctcccctaaaatgcgccttgggcacctaaatttgggctgttttccctgagaaattgcggtcctaatttcaaagccagaaatcttttttcctaaacctatacttttggtggtgggatctaccccaaaaccgaaagaaggtttaaaaaccaacaccatgttaaaatggcctcttttgagtaattttccctggggagaatggccctcctccacttttacaacaaatgtgaaaaaataaaaaggcacttttgggttgtaacacaaaaaaccaaacaaaaacgcgagc

SEQ ID NO: 698390 - DNA, 308 bp, Homo sapiens
tttccttgccccatttaaaaaaaaaccccaatttgcaagccaaaaggcccttttggttacctttttatttttttttgtgaaaggcaagggcaaccccaaaaacttcaaagctggttggggtggcccttttacctcccggcaatttcctcaaattatttttaaaacctttcaagggccttcgatggatgggtagggggaaatttgggaattaattttataaagacctggggatttacttaggattgcaaaggaaggttccccattcccccaaggttttccacaattaaaacatttttttcccccttcca

SEQ ID NO: 698391 - DNA, 194 bp, Homo sapiens
tgttgtgggcttcagtcgaggccctgatgcattgcatagtctaccatgtgttctgatgctcccttgccctgcagaggtcgagtgcagacgcgggggccagtcctgcacccgcctctacccctcgccgacagccagaccacaacaccatattgtacccagattgctaggattggaagtgaggaggtttctcaccc

SEQ ID NO: 698392 - DNA, 163 bp, Homo sapiens
tgtacacgcccttgggccagctgcccgggtgagagctccgccgccacgcgacaggcctgaaagcgagcgcctgggttaaaccagccgtaacagccatggggacaccccgttccctgacccacgggacggaacccacctgtgctggaggtcgtgactgctaact

SEQ ID NO: 698393 - DNA, 184 bp, Homo sapiens
ggaacagcagggtcttgaacgggcgaaaaagctaaatatcgatgtatgttaggtgtcagctatccatgtaggaagcggctagtaccgatacctgagaccttcgtgcaggcaatctctgatgcccgctgtgttttatgacatgggggctagaggttggtttcagcatgtatctgcttgatatatg

SEQ ID NO: 698394 - DNA, 165 bp, Homo sapiens
ggcaaattacagaaatagttcctgcaaaatcagataggtattcagcatcataggaaaggggcgaaaatcagataggtaggtattcttaagaagttgtggccgccggcgcggtggctcccggtaaatcccaagactttggaggccgaggtgggtggatcacctgag

SEQ ID NO: 698395 - DNA, 379 bp, Homo sapiens
  misc_feature (95)..(95): n is a, c, g, or t
gagcataaatgacatttaaagctgcttccagaccaaaaaattttgtcatttcactggtacggttcaacaaccggggtgtctgataactgaacagngcctaaacattccagtaagaaccattattttctttaatgaagaatgactaatccatattctacaaggggcggtatggttagtaattctatagggaatgtcccgacataattttcaaattgtacaataacacaaacaactttgttaaggccatgttttatttgctgattaatggacagaaggcaatgtaatttattttcaagtattttcttgaaagtctgtgctcataaaaatcatgaaaagttggaaagactgttaaatcactgaaactttaaatatatcttat

SEQ ID NO: 698396 - DNA, 262 bp, Homo sapiens
agtattcgcctcaccaagaccgtctactatctcgcacatgaaacaagctaacatgactaacacccttcaattccatccaccctccatctcccataggatggcctgcaccccgacataaccggtctttttgcccaaactgggccatttatcgaatgaatgcactaaaaacaagtagcctcatcatccccaccatcatagccaccagcaccctccttaacctctacttctacctacgcctaattcctccacgcaaatagtaatt

SEQ ID NO: 698397 - DNA, 819 bp, Homo sapiens
ggtgattaagctgtaccggtagacccgtctcagggcatgaaggcgctgcaggcgcgatgactccactgtggaccctcccggcccaccaggtttcgcgcgcgttcttcggtgggtctcaccagggttggcatatcctagtatctgggtgtggcctctcctgacgatgcatcgtgtggtggctcggatgcacactcgcctatgtacgctttcggcatctcgtggtcctggtgcttgcatcctaggaatcagtctggtcctctggggcgtgcaaagcagtgccagtgagatatttcttgatccggatgtcagccgcttggcatggctggttgcgcaatgaaaccgccagtcccattgtgcggtttggccacggcgatcacaccacatcgggggagtcatcagtccattaaccggtttgtttggtggacttcccaaaagagctttttgccacaattgggggcgcgccgtgagcggtggaccagtgtgtgcccccgcgcgcatcgcgaatggggttctccgaccaatttggcctcaggggtgcgaaagcgttgcgggttcccgtgactgcatgacggaggatgctgccttgaatggttttgaagccgctagatttttatgctggattcacgtctgcgtaaactcacaactgcgaactggtttcgggagtagggagcaacatgtctacctttgatgaaaatgtgtgttacaaacactagagggtattgtcaaccacctggcttgggtgaatactatatgaaaaaccgatgcagggggttgtggcagtggagaacagaaccaaaaagaaggtaaaacagtacttgg

SEQ ID NO: 698398 - DNA, 439 bp, Homo sapiens
  misc_feature (316)..(316): n is a, c, g, or t
  misc_feature (410)..(411): n is a, c, g, or t
gacgaaactcagctcgtcactcgggtaattgccctgcatcacattgtaaatgctgaactcggccgcgatcggttgccgggagaacaggcgctcgaacatctgcccgtagccctgatattgatcgaccagttccgggcgcaggacatcggtttccagaatgcagatgcgtaacgacataaaaatacctgacacaaaaagataaagaatgaaacccgagcctgccttgaaacctgctttcaaggcaagcacagaacgcgcgctcgcaagctccggttcagcttgccggcaaaccgacgaaagggaggccgaaccgtgntcctcctcacactcggacgaacggtagtctgctaagggacagtcgcttttcacccttgcacgtgtctagcaaaaggcccgctagccggctggannaatgcctcatgcctttttaaaaagactt

SEQ ID NO: 698399 - DNA, 123 bp, Homo sapiens
agaggcgtttagtcacacgattacccatgtcatagaagccgcgtacgagtgtttagatcaccccctccccaagtaagctaaactcacctgagttgtaaaaaactccagttgacaccaaaaata

SEQ ID NO: 698400 - DNA, 183 bp, Homo sapiens
tttacatttgatgtgctacaaggatccaaactgctgtccaagagagtataagaatcggtctgaatgagaactcctgcccacgtccctatctgttatggatcactgcagcttgcacatcatgttatgcaccgtattacgtcaacatatagaccttggcctgaagtggtgctctctagtctagac

SEQ ID NO: 698401 - DNA, 225 bp, Homo sapiens
  misc_feature (29)..(29): n is a, c, g, or t
gatgccttcctcttggaggcagctcggtnccaatgtgctgctgttcctctgcaccaccgtcattggcatctgcacacactatccagcagaggtgtctcagccaggcctttcaggagacccgcggttacatccaggccggctcactgcagcatgagatcggcagcaggagcgctctgctgtcggtattgcccagcacgttgccatggagatgaagaggcatcacac

SEQ ID NO: 698402 - DNA, 322 bp, Homo sapiens
gtttttttcctcttaatgtagttttgactctgccttacctttgtaaatatttggcttacagtgtctcaaggggtattttggaaagacaccaaaattgtgggttcactttttttttttaaataacttcagctgtgctaaacagcatattacctctgtacaaaattcttcagggagtgtcacctcaaatgcaatactttggggttggtttcttcctcttaaaaaaaatacgacactggagtgtgtgtatgtgtgcgagtattagcgcccatctggtggatgcacaggtgagaggagggagaattaactgctcatgatgtcgtgg

SEQ ID NO: 698403 - DNA, 438 bp, Homo sapiens
  misc_feature (18)..(18): n is a, c, g, or t
  misc_feature (54)..(54): n is a, c, g, or t
  misc_feature (72)..(72): n is a, c, g, or t
  misc_feature (108)..(108): n is a, c, g, or t
  misc_feature (119)..(119): n is a, c, g, or t
  misc_feature (171)..(171): n is a, c, g, or t
  misc_feature (199)..(199): n is a, c, g, or t
  misc_feature (421)..(421): n is a, c, g, or t
tttaccccctaaaaaccnccccttaatttgaaccctaatccattttttgaaaancccatcaatctggggatnaattctggaagcccctttgccaaatggggaaaaggnaatgggacgcnattcccagctcttttttaaaaatttaaatttaggctgagcgcagtggctcanaccctgtaatccccagcactttgggagnccaaggcaggcagatcacaaggtcaagagatcgagacccatccctggccaacatggtgaaaccccatatctactaaaaatacaaaaattagctgggtgtagtggtgtgtgcctgtaatcccagctacttgggaggctgaggcaggagaattgcttgaacctgggaggcagaagttgcagtgagcagagattgtgccactgtactccagcctggcgacagagncgagactctgtctcaaa

SEQ ID NO: 698404 - DNA, 843 bp, Homo sapiens
tatctctgcgactatgtattggtccaagagtgaccgccactggtgtatgaaatgcagtatggatctctttaacatgcctctcactcttatcaagatagttatggctttgaggataataaacttacccgttctcactttaatcatttaacagctggcatatatgaatagaaaggaggattatctgcattgtaaaataatcagtatggtttatatgttgaatttgagatttgtgtgtccatttcattggtggcctatatggtggctggtgtcttctggtaatggtaagtagaagtctcaatcgtattttctctctgatggcattatcgaagttttcaatcatacacgaagtctcatagcacagtgacatttcttaatggtgggagtccagctcatgcatttctgattatacaaaacagttcgcagtaggttattagtgactctctgagtttattagtgaaattctgagcgtaaacatttattatgtgttattatcttgtatgtaccgaaagattgaaatctacgttagattaagttaattaactcaaatactgtgaactatcatttaataagactagaagagagaaagtgttagtatctcaatgtacaccaactgtgcaatgtgatctttgattggagttgaaataatctaattggcctttgtgaaatctggggaagagctgtcggattctagtagatggatactgaggtactcaggcccacttaaacttattaatgtatacccttgtggtttcggcctttatgcttatgtaccgagacacgtggtattttttaattaacttttgtttgagtcaaaaaacaaagaaaggggggccgttaaggacc

SEQ ID NO: 698405 - DNA, 757 bp, Homo sapiens
  misc_feature (757)..(757): n is a, c, g, or t
ctgatgctgcgactggaggctatgattctggatctaccgatgatggatcgctggggagagtccagcaaattgaaaaaccggacagttgtagatgacttactgctccaaaaaccatttcacaaagaaaacatggaaaggtggcccatatcaagttgcagactgaattgctgcatagggaagacgcattatatagatggtttcatctcatatctatggatgcttatcaaagacatacaaaggtcgtaaatgactatattttatactatggtggcaaaaacgaagacttcaagcgtttggtggaatatgacaagacagacttgcatgttatacgataaaattatatattcctatggaatgaggaggaccaaatggacattacttgggagaagagacttgctaagacctactatgatctatctttttatgattactgcatagctcatctcaatacctataatgataattagtcaggatttaggtggccagtctaaaatgaattctttacaagataaggtcagttttaccgggcatgcaatattgttataaaaaccaccgctcactcagatggcaagttgatattggttctattgacactgtgtgagaaaagacctgtactccgttaagttccacgttatgccagaaatgttctcttaaacggaattcccctactgatctaaaagaaactccgtcactaacctgaagccagacatcctctatacattggatcttgtatcacttatattgtccaattatcttn

SEQ ID NO: 698406 - DNA, 955 bp, Homo sapiens
  misc_feature (451)..(451): n is a, c, g, or t
ttctgcactgtatccccgacgggcactcctcggactaacagcatgcattcgtatcttagagctgtattagactggctttgcatcgttgacccatatactcttcaataacccttattcaatactatcattgttgcttacttcagttcgaagtagacgattactagcacatgggtcgctgaggaggtccagtcacccgaagggccatgtcacgctagcctgatgatcccattccttcccttggtacatcgtcccggaatgattcctgggcgccagtctgaaatggataattagcatcaaaagactaccctccatgtgatccgttcagtagccctagccagtcatgcgacacatcacatgcagacatgggatccacttcgtggataatctgatcctggaatcctccggatctttggttcgattgaattcattgccaccgatacgtcccctgcgngaaagtgacatgaatactgtcctaacccgagagaggtgaataggctcaccattgcaaacgcaactcatgagtccacaaagagagacgtattgaaaaaacagggattgtagacgacacctactatggatcatggtacaaggtactcgagtgacatgtaaaaccccccagatgaaaagaacacgtcatacatatacctctggaacaaaggattcgcggtaccctatcccgagttcccctgtagagagtaaggactccgatgcccaaaaggatttccagcccattaggttccgcataattaatttgccctaacctaacaattagacttatctctataggcacccatgatttaacaaccggaaacaatctctctacacttattccacataccctttataccactccaattgacaccctaacagcatttactaaataacctcaattcaaagctacttccctataacacacgtctattacattgcccccatccccttttctatcacaccc

SEQ ID NO: 698407 - DNA, 1158 bp, Homo sapiens
  misc_feature (338)..(338): n is a, c, g, or t
tgtcgcctggtttttacagacaaggtgtctctcaagtcttaaacacaagggtaatctacacccagttggggcctcaattataccgttctagctctcccttgaaaaaaacgtttcttgtgggaaatttaaaatggttggaaattcagagaagggtgtccgtcccctaagtgtgataatatttccccccctggtaataggccgttttttccagaagaagaaaatttgtcacggagtcgccccaagagtgccccccgggaatctcgcccagagtgattaaataagaaaaatggaaaaattggggggaaaaaattggccccaaagggtaaatggaatttgcnccagggtttcataggaagaagttgcccatagacttgattcagcgtcctgaaaattcaaaaggcacaataatgtgtccctcctgaaaaagtgtactccggacaaccctgcccttgaggatttttgaaatatagaatccaagtctttaaggcccagaggaaggaagcttgcgcccgataataagttgaccaattagaggacctaataatctctcggtcaccgatggaatggggaaatatgaattagcctcccggacccaatttccctcgtgcttaaagccctcttttctgatattgtgactcttgtaaagcccacggagaaataattactctgttattcttataatagagatagttttggcaccactcttgagggtaaatgtgcacccaaatgtttgtgcaccacatttgagggtataatgggtgttgtagaataagtgtaatgtgtgttaaagaagaggaatacccgcgaagccactatgaaatgtaaattatgcgttaacaccaagtcaccatttcccagtgttcgccatgagaataaaataatttgtggaaagattttgagtaaaactccaaaccgttgggataataaataaaggagaaatttgtgtttttaacctttctggagtagaataatttctaaagtggtattctaaaatgcaccagtgtttcccaggaaatagctgatagtgtaaatagttaggtggtttgtgaaatagttaggtgatatccattttcccaggaaatagctaagatattttgaaatgttaggtattcccaaaatttcatatgtaaagaaaatataagtgccttttatattata

SEQ ID NO: 698408 - DNA, 879 bp, Homo sapiens
gatagagagaaactccgggacactccctgatggccaacttcctagtccgagatgcttgctaggcaatgatccaggagtcgaggtacactggcgtgacgcctcaggcaaaggcgggtaacaataagctcgagtcaaggtcttccatcgagatgggcactatggcttctcagaagccactcactctatctggcttccgattgtgcgagcctcatgtcaattcacctacctggcacgatgctcatctgggcccagctacaggtgcgcaagctggacagcatctggctcctctaggcctgttgtactaaatactcatgcaaggaacggagatagtcaatggaggactagagtggaggcagtgggcgccccaggcgttacaggtctgatcaccagtggtagtcatggacacagagcctcggcgagatagtgaggccgagttttatgaagagtagcgacacggaccgtcccaggagtctgctaggatgacatgcgtacgtgtcgacactctgaaggctcttcacatgagatcgttatcaccgatctttgaatgagcagggccagactcaagagacaatgcaggacggattacctggagcgcgtccggcgtgaggggcaccgagacagacgatgccaaggatcctgcttgaactccgagctggttcaacgtcccgcatgcccgagatcgcatgagcagccgcactgaaggctggagcatcagctgcgggtcgcaggcctcggaccacagagagatcgaaaagcgcatgaacggccttcaaggcggaacctcatgcaggtgggcaagagtccgagaccagtacctcgggtgaggtccccggaatggccccggcggaccaatcacgccggtgctggggttacttgcgg

SEQ ID NO: 698409 - DNA, 439 bp, Homo sapiens
  misc_feature (25)..(25): n is a, c, g, or t
  misc_feature (72)..(72): n is a, c, g, or t
  misc_feature (408)..(408): n is a, c, g, or t
ccaacaggcaattaaactgtggacnggggagcataaacatatcctgtgtcaacttctcctacccatggaatnagtaaatgcataagttgggatgaggtgaaacaacacctctggggaacctttcatgacaatttaacagcagacataaggcaacttaaaaatacaattttagaatcccttcaaactgtagatctacacacccaacaaacagccatatggaagggtgtgtgagattatctctcctggatagaccaccgctcctgggggcggggggtggtgggtcactccttgattagaaaagaatgttgctaattatactcatgtttgtcttatgttatttactaattttaggatgaaagccggaataagagcaatgtccaccatgcctgacagacccttgctgcgcanacctgactctccaatgaacaagactaatgca

SEQ ID NO: 698410 - DNA, 911 bp, Homo sapiens
  misc_feature (90)..(90): n is a, c, g, or t
  misc_feature (139)..(139): n is a, c, g, or t
  misc_feature (141)..(142): n is a, c, g, or t
  misc_feature (147)..(149): n is a, c, g, or t
  misc_feature (187)..(187): n is a, c, g, or t
  misc_feature (242)..(242): n is a, c, g, or t
  misc_feature (244)..(244): n is a, c, g, or t
  misc_feature (257)..(257): n is a, c, g, or t
  misc_feature (293)..(295): n is a, c, g, or t
  misc_feature (300)..(300): n is a, c, g, or t
  misc_feature (307)..(307): n is a, c, g, or t
  misc_feature (314)..(314): n is a, c, g, or t
  misc_feature (317)..(317): n is a, c, g, or t
  misc_feature (320)..(322): n is a, c, g, or t
  misc_feature (324)..(325): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (345)..(345): n is a, c, g, or t
  misc_feature (353)..(353): n is a, c, g, or t
  misc_feature (363)..(365): n is a, c, g, or t
  misc_feature (367)..(367): n is a, c, g, or t
  misc_feature (369)..(369): n is a, c, g, or t
  misc_feature (378)..(378): n is a, c, g, or t
  misc_feature (390)..(390): n is a, c, g, or t
  misc_feature (394)..(394): n is a, c, g, or t
  misc_feature (397)..(397): n is a, c, g, or t
  misc_feature (422)..(422): n is a, c, g, or t
  misc_feature (525)..(525): n is a, c, g, or t
  misc_feature (544)..(544): n is a, c, g, or t
  misc_feature (546)..(546): n is a, c, g, or t
  misc_feature (548)..(548): n is a, c, g, or t
  misc_feature (602)..(602): n is a, c, g, or t
  misc_feature (686)..(686): n is a, c, g, or t
  misc_feature (903)..(903): n is a, c, g, or t
gtatacatattagggaatcccttaaaattcaactctagagttatacaccatctagtacttttgcaatgaatgttaacaacaacaaaaaanatctctaaacacctgaaagccccactattaacatggactatggtaatanannatttnnncatttaatttgttcaacatatagtatttacattatganaccaatggtgatgatacaataaagtgataaagaaatagtaaaaataaactttaanangcaaaggtttatngtctgacaatgctaattatcctaattgtatatgagnnnttaanccatagngctttcngtnacnnncnncttccccctcnggntngtgntcgtggcnggcgaccggnnngngngcgacggcngcgagggctganattnganttttttccccaagaatgtgtgagtngataaatgacatttcagagcagatattaatttacttgtggacagaaaaagaaactcaagattggtactggtcacaagcctcttcccaatagaaattataaaancagtaagataaaatttaanananatctaaaaaggggatgcataggcaaagagtaccataaatggcacagctcaaaanatcccaggaccaatcagacacacatcttttctctctccttcagcgacaagaggtcgattttgccatcaaataaccatgattgangcaagcgaggggcaccaggtgtacaactgattagatcttgcaaaatactaagatgggagcaggggtggccagaagaaggggtaatttatatataattcaaactatatacagcataaatggaatgcagcccatcccaaactggctctgtgaaacaattggacctttatagttaaaattataacaagtgtaataataaaatagatttacatgggaagcnaaatccaa

SEQ ID NO: 698411 - DNA, 126 bp, Homo sapiens
ctctaaaacgatcctagcacctcagtctaacaaagcgctgtcataggcgggagccaccacacctagcctatacaaggagcattgagctactctcagggccgagcacacagacgccatgcacgaagg

SEQ ID NO: 698412 - DNA, 997 bp, Homo sapiens
aactggtgagtctgtgggagttagcgaataacaggggctggggagcccgcagacgcctttgtcatagctccgggccggagccagaccccggaaggtgcgagagagaggtccatggatggtatatggatatggatgtcttggatggataacatgggaagcgatgtgggtggatgcttgtaagatcagggagctcatcagaaatcgtctatcttttggcgtggaaggaatgcccgatcacccaagaactggggagtcttgtttgagagactgatagatggtctggggaacatggatctgagtacagttgtcttttcggaggtctcaaaggagcagttaagaggttggccaagagtagatctgtgtcgcaggtagaatgcagacagaacaggaggaagacgcgattggacagcttgcatggagtatcttgagtagagaggctttgaagtgtctggaaagaggtcgtcatgggtgataattgatattcgttgaatgtgggaggatggccttgattcggacatcgattctgatttgccaaatccagatgtgtgctccatgtgtcctctgggtactgaatgctcgattgcttgtatcctaatcattattctcatataaaatgttgtagggataccgcttatgtgtcggttgatgatgtgggatgctggccgaaaggtggatgtcggattgtatgtataaaatttaatgaggctacacgattaattctaatggtcgaaatgtgatgagtcagttggtctagcggaggctgacaggggtcaggggaataattgttaacccaggcaagttttaattcgaagtggggagttggattggggacctctgatgaatttttgagtgggccagagaaggggatatagggcggttaaaaaagcggagatattaaagactcggttgtgcacagggtcaccgttttttctgtggaagaccacgattttgatagtcgtcacaagttttgtacgatcgtggattcgggtttttagaa

SEQ ID NO: 698413 - DNA, 303 bp, Homo sapiens
gcctgatccgctttagggtgggaggattacaaagtacattgatcagttagggtggggcagtaacatatcacaatggtgcaatgtcatcagttaaggctattttcacttctgtggatcttcagtaacttcaggccatctggatgtatatgtgcaggtcactgggatatgatggcttagcttgagctcagaggacggacagagaccagcctagccaacatggcaaaacgccctctctactaaaaatacaaaaatgagccaggatggtctcgatctcctgcttaagcggatcagcgggtaccgagc

SEQ ID NO: 698414 - DNA, 227 bp, Homo sapiens
ctcttgggagggcaggtgggaagaccacttgatgtcgggagtttgagaccaggctaggcaatatagtgagaccccatctctattgaaaaaagcaaaaaaaaaaaatactatttaaaatagcttattaaaggattccagtgaaaagtgtaagactaactgttagccattgtttaagtttgggatgcacaaagagccacgcaaagagccacacaaagaggggtcccgag

SEQ ID NO: 698415 - DNA, 230 bp, Homo sapiens
taggggtcctcttgctccttcttggcccgtcctgaaaagaatggtcgcacttggacaatcctcgtacagttggaccttcttgcatttgaggcccttaggtcaccaaggcccttcttgcccccattagtccccctgcccatctggaccttccaaggcttaagcgtagttggttattactttggtacgatggagacttttcaggcattgccagcttgttagaacttttttaa

SEQ ID NO: 698416 - DNA, 86 bp, Homo sapiens
ggggggggggggggggggcctcttttccaaaaaaacccttttttttttttgggggggggggggaaaagggcccccccctttttgta

SEQ ID NO: 698417 - DNA, 262 bp, Homo sapiens
gcaatcccgcgtctagaactggacaggatgattctgcctactctcttgagcaagcaatgatactggtgaatgggctgaagccacattgtgggggggcagagacaccctgggagacagagagctcccaccctacacaccacccccctgggtaataccctggactggtggggagctcacacgaggggaacgagggacgtgactccttagacagccaaagtggacgtcgtaagacgcagagcccggtaagtcagaacaccctggg

SEQ ID NO: 698418 - DNA, 690 bp, Homo sapiens
tccctggatccctcttttgtgcggccaggagattgatagaaaaatcatatttgttttgccaaatgacagcaagatttagacatctgaaatccacgcggggtcccatccaacgcatggtgaaatagattatgaagcaattgtgaagctttcggatggctttaatggagcagactgagaaatgtttgtcctaagcacggtatgttcccaattcgtgctgatcatgattttgtagcacaggaagacttcatgaaaccagtcagaaaagtggctgattctaagaagctggggtttaaattggcctccaaacctgtgtaatttcctgtaagatttttgagggcggcatgccaaatgttggcttattgtaaaaataaagttaaagaaaataatgtatgtattggtaatgaggtccttaaaagtatatgaataaaaatatgggtaccctcataaaaattagtaattcaccttttaagatccagaagaaatttgtatgtttgttaaagttgcctttattgcagcaagttccaaagggaaagtgttgaagcttttcatatttgcggggtgagccttttgtaaaatattgaaaggggtttgagataggggtataaaaaagccttttttatgccttattttgtatcatttgttttcctcatctaaaaagttgaataaaatctgtttgattcggttttccta

SEQ ID NO: 698419 - DNA, 876 bp, Homo sapiens
ggtcgacccacgcgtccgcggacgcgtgggtcaaatacttaaagcttccagaaccttcagcctcattgccaaatcctccatcaaagaaaataaagttatcagatgagcctgtagaagccaacaacgaacgattacactaacgctttaactactaaagatttgaagacctgaaaacgaacacacactacgcaaaatgaactgcagctcagaaggcttctggctacaacgttgaccaagagtggcaactgaaacgtacttgactacccttttttggggtaccaccacactacaacacaacaacacaacacaagcgcgaccgggcccgccaccataagaaacggcctatcccacatcaacagggagcgcccccaaaacgcattgtaacggcgtctaacccccaagggcttctcacaactgtcggtaccaaacacgtgcagcgctccccctatatctacagcaggacgctcgctaactatcaatcaacgccctacggcgcccactcctgcgccccgacccggcctcttccacaccaaacacgcgtctccggctgcaaccgggcgcgcaacaacttcgcctcaccccctgcggcgggcacccctcgccgctccaaacgccgcacacctcctcacctctcactcagtcggcccgctcgcaccccataacctctcgcgccacccacccaccctacgcacctcccaccccgacacgcactccccacacacgccttcctccacacgcggtcacccctcatatcacaccacacccccctccaacccgcgcgccccctacacatcgctccgcctccaacacacctccagccacgccccaccatccccccccgccccgccctcccgcacccacctcccccgcccaccc

SEQ ID NO: 698420 - DNA, 420 bp, Homo sapiens
cacgaggcggacccgagcgcgagcgcaggcccagccagagatggctgattccgatcctggggaaagaagctatgataacatgctgaaaatgctgtctgacctgaacaaggacctggaaaagctattggaagagatggaaaaaatctcagtgcaggcaacctggatggcctatgatatggtggtcatgcgtacgaaccccacactagcagagtccatgcgccggctagaagacgccttcctcaactgcaaagaggagatggagaagaactggcaagagctgctcactgagaccaagcgcaagcagtgagctaccatctgtcagcagcctgtgggccgaagccagggacatgggtccagaagcccagacgtgtagccatgtgcatggtacttgtttctccaataaacttatttcacggggaa

SEQ ID NO: 698421 - DNA, 515 bp, Homo sapiens
  misc_feature (386)..(386): n is a, c, g, or t
  misc_feature (395)..(395): n is a, c, g, or t
atctctacctaaaagtacaaaatgagctggtctcaaaccagctggccaagctggtctcaaactcctgacctcaagtgatccatccaccttggccttcccgaagtgttgggacttacaggcgtgtgccaccgtgcccagccgagccttcttagctttttggggttttttttggttgtttgtttgtttaagacagagtcttactctgtttcccaggatgctggagtgcaggggtgcaatctcggctcactgcatcctcgacctcccaggctcaaggtgatccttccatctcagcctcccaagtagctgggactattagcaaggtgcatgcctggctaatatatgtatttcttgtaaagtctcaaacttctggacttaagcaatccaancaatccacntgcctcagtctcccaatgtgctgagattacaggcttgagccatagcgcctggctgatatttgtccctttgtgtctagctcattttacttggcataatatttagaaaattcatgtttaaaa

SEQ ID NO: 698422 - DNA, 172 bp, Homo sapiens
ctagaggatcccgcactgtagttcatacatgcactgtagttcatacctggtcgctgtatcggggtggtcgcagtatcgggggggtatgaacaacagtgcaggtatgaacaacagtgcaagtatgaacaacagtgcatgtatgaacaacagtgcaggtatgaacaacagtgca

SEQ ID NO: 698423 - DNA, 816 bp, Homo sapiens
gggttttcacaagtgcacttggttcaatctatcttgtctctgatataggctagtggctgtaattcctaacgaaaagctttcactgtagacgtcatacagtctgcatacacagagatgaagttagtccacttggatcaagatagcctgcgtctgcgtttacaaaagatgcacaccaggcttcctttacaagtgaactccaaggggctggttgttaaagtaccacccttcctgacagacgttatgtggggctcgtgtctacttggcctgaaaacaagatgtgtcctaatcatatgctatgctcacagctagtagcatccctcatgcgtcctttgtcatactctggaaagaaaaaaattctgctatcttcagagaaaccatctattcatacttaaatatggaagcctttacaaggaactcaaatactacatttcattctcatttgtacaatgtagacaactaagcatgaaaaggccaggttgtaatccgcagttgacattgtcagacctgacttgaggctttatgtacatctaaaatcgcacaagggggaacggaggacaacgacagaagctcaactttagaaaccatggaacatcacctccctctttgacgagagagctgctttgtagaaaccaggctccatgtcttacttgttgggcttctcacaggtagaccctgcccctttcttacctcacatggggcaagagggactctaaaggagggcgtaagccaatagaggcacctgtgagccctcctttactcaggaagggacatccatgtgggaggccccacgagggacattttaatctcaaagaccag

SEQ ID NO: 698424 - DNA, 843 bp, Homo sapiens
  misc_feature (13)..(13): n is a, c, g, or t
  misc_feature (64)..(65): n is a, c, g, or t
  misc_feature (68)..(68): n is a, c, g, or t
  misc_feature (73)..(73): n is a, c, g, or t
  misc_feature (121)..(121): n is a, c, g, or t
  misc_feature (303)..(303): n is a, c, g, or t
  misc_feature (364)..(364): n is a, c, g, or t
  misc_feature (427)..(427): n is a, c, g, or t
  misc_feature (561)..(561): n is a, c, g, or t
  misc_feature (630)..(630): n is a, c, g, or t
  misc_feature (698)..(698): n is a, c, g, or t
  misc_feature (732)..(732): n is a, c, g, or t
  misc_feature (734)..(734): n is a, c, g, or t
  misc_feature (736)..(736): n is a, c, g, or t
  misc_feature (746)..(746): n is a, c, g, or t
  misc_feature (748)..(748): n is a, c, g, or t
  misc_feature (753)..(754): n is a, c, g, or t
  misc_feature (759)..(759): n is a, c, g, or t
  misc_feature (763)..(763): n is a, c, g, or t
  misc_feature (767)..(767): n is a, c, g, or t
  misc_feature (783)..(783): n is a, c, g, or t
  misc_feature (810)..(810): n is a, c, g, or t
ttattatattctnccccatggggccttgcaggaaaagggacccaagccatacccccaccccttnnccnacgcncaccccacctgaaccaagggacaggattctaagagaatcaagtatctnaaataagccagaatgtatctggggaagaatagccattaatttcctagacctgacactgggtttatttgtgtctgccaggaagacggggagtcagtaagaatcgtaaatggactagatgaggggaaaaaggatgggcccccctttatcacagcctgagcccaaaaaggttgggataaacaggngtgtaaaaaagagaggagggaaaagggaggatgggcaggggagagaggaagggcaggggcngggttcacccaaatcacacagcattgtaggaagaagcaggggaaccattggagtccccagccnggaacaggaggggagggcccagcacccagagagaggagaatcccaaggcccccctgtcaaccccatcgtgaatagatgcaaaagccccccccccccagagaatccagaatgggccgtccgaaggcaagagagcntagggacagacccgcagccccacgcccaggccgcccccccccacccccaaaggccccgccaggagaacnatagaaatacagagttccaggtctctgccccccctccccagacccaagagagggagtagagacaaggnacaaagaccctggacgtaaaggtgaacatcagtntngncacatataanantattnngaganaggnaagntagtgcatgccccaanatggatgcctcccttcaccttgcaggnagccggaactttgatagttgcagataccacaat

SEQ ID NO: 698425 - DNA, 625 bp, Homo sapiens
taaaaaaagagtcccatttggtggcccaggcgggattgcagtaggcatgatctgggttcacggcaacctccacctccggggttcaagcaattctcatgcctcaaccagggcccaccaaaccgggctaattttggttttttaatgtaaaagagggggtttcaccatggtgggccaggctgtgtcttgaactcctggacctcaggtgatccacccacctcgagctcccaaagtgctgggagataacagggctgtagaagccaccggggccgggcctcatctaaccaatttgggatctcggggtgggatgtcacagagaaacactatgtccccattatcttccaagattatttcaaaacataaaaaatcatggactgactggggaggacacagggacagaacatcgtcaaatcctgagcatacctcttcagaggctcgagggccccacgaggacgggtctggcggcgtacaagaggaggtaccagctgcacaggcccctcccatcgtgatagtgccagggggggaaacaacggcgcctccccgggagagacgagacctcttacaccaccaaaggtggcggaccccaaaaaggtacccccaccagaaccgggatagcatcgcagacatg

SEQ ID NO: 698426 - DNA, 330 bp, Homo sapiens
  misc_feature (16)..(16): n is a, c, g, or t
gactctagacgatccnctgctgcagactatccgtagtacagtacggttagcaattttagacgtttggcatctaccgctgtgtcacccggtgaatatcaggcagctgtgagatactaggaaagctaacagtgatcgaacatggaaagagctctgcttgacctggagagataggagagaataccgagctgctcagacgagtgaacttcatagcgtggacatgcagatgaattagaagaacttatcaactactatcaggatcgtggctattttgaagagctgatcaccatgttggaagcagcactgggacttgagcgagctcacatggggtac

SEQ ID NO: 698427 - DNA, 258 bp, Homo sapiens
cccggaaaaaaaaaaaaggggggggggggggggggggggttttttggggttgcccccttttcccaaattaagccccccctttttttgggggcttttgggggggaaaaagccccccatttttgggaaaaggggggcccccccccccccgggggggttttttccccccttttttttttccccccccccttttcccttttggggggcaagggggggccccgggggggggggggaatcccggcccgggaaaggtttccccca

SEQ ID NO: 698428 - DNA, 1036 bp, Homo sapiens
ctctgtgactattacactaataaaccctgggctaccacgtagcccgttgatctccaagtagtttacctatgcaagacctgtgacactctgaattcacttctctttctttcagaaagtagtccataacatggagcttcaattcatcaacaggtaaacacttgtctccaacccagtttcatttaggccatttctttttcaaaatgtcagctgttctcttccaagatttttcaccaaaacaatgatcataagtgctggaatatataatactttgcaggcctcaaataacccagacatactctcatatttcttaggtgtatttaggtatggtacaacttaccagcattaccctgtacaatatcaggagttaattccttacctagaactatttcttccttttaagattcataagtaacctttatttttacagagctacgtataacttccacattacagtcaggaacctgaggtgtaacttactaagtgaaccccaaggttattcaatcttgcaaaagaaacataaacaaatagggcttacagccatggacagcactgaatcacaagctatcagctcaattgccaaaaccgcttatggatgacacacgccagtctccagccgctcggcatgcctagcaagatcggacaacatctcccccctggcctccttcaacacagatacacctcaaccaaaactcagccccaaccgacaacagacggcacacgcgtgacacagtcaaccacacgcatcaagaaagaaacaaccaggacaggcaacgcccagcccaacaaacgacaccaacgacaacacggcacaacacacaaaccacaaagagcgacacaccatctaccaccacaatagtaacacacacagaatggagaaaactaaacgctgtggtcattgttcatttctttctattaaaaccaacaaaagagagcaaaacaaacaaccaaaagaacacaacaacaccataacacaaagagacaacagacagacaagagaacacacaatacaccaaccacaaaacagagacaaacagca

SEQ ID NO: 698429 - DNA, 86 bp, Homo sapiens
  misc_feature (26)..(27): n is a, c, g, or t
tcgcctgggtcagggggtgcgtgtcnngggaggcagaagcatggatcccgggcagcagcgccgcctcaaccgacaccccacaaggg

SEQ ID NO: 698430 - DNA, 738 bp, Homo sapiens
ctgccacgctgcttccggatcgaccgacgcgccctccgccagccgacagacacagccgcacgcactgacggtctccctgcggatcggacacatagtatgaccattaggatgttcagatctcccacccattctatggaaaaccaaggggatcgggccatgatagccacatggcagctttgaagaacgggacacctttagagaagcttgatcttggaggccatcaccgatgagaacttacaaagccggattccggcagagattcctcatatcatcgatcatgcattgctagattaaagagtgcccctgatctccagatttttctaccatcatcctggagacgtagcagagaaatcagcatcatggttggagttcaaggcacacagactgtgccccctactgaccactgtgaagtttcttggggctggcacagctgcctgacatcgacagatctcatcaccatttcctctggatactgctcaagtccaggttacagatccaacggagaaagatcagggagccagatgcgcgctacaggtcagccgcccagtaccgacggtcgtgatgggcaaccatttctgaccatggtagcgtacatgagggcccccgaagacctctacaatgggactggttgccggcatgcagcgcacaactgagctttgcctctgtacgatatcgggctgtatgattctgtcaaacagtactacaggaagggctctgagcatgcagcatgagagacgc

SEQ ID NO: 698431 - DNA, 300 bp, Homo sapiens
gagaattaatgtcattatacccacctagtaaggtacaatttgatgatatatttttatttcttgaataatatctggataagttcatgcagggctacttacaagtacatccaaaagatcaagaagacttgactagaaaatctcctggaaagatatgaaagatatgaagactctgatggaaaagatgaagacccttaacattggatatctttgggagatgtgtcaaaatgaatgcaggattctgatacctacaaaaagatgtcatgatgaagaaccacctagtaaggtacgatttgatgacac

SEQ ID NO: 698432 - DNA, 300 bp, Homo sapiens
ctcagctatgccttggggaaacaaagtgggatagacgaagaacctctatttacaaagactgtgttctattccggttcttttgttgtgataactatggagaaaatatatctgtttacgaaggtgggctcatgcagatcatacaatactggtccagttaaaaccttactacccaaagtccacagtttcgtagagacaccgtgcaagtgacatatgtattcctattataaggggagtgcagcatgcagaggcgtttttcgctaccagttcctccaaaagcaaaggctaactccagaagtccgc

SEQ ID NO: 698433 - DNA, 174 bp, Homo sapiens
ggacctggtggggcacggggacccttgatcttggaagtcgtggaactgcttgacagccggtcggcggcacttgctggccgcgctctcctccaccttcatgctctgactggcagtgggctcgggcgcggtgccgggcccccctgtctcggtagcactgggtggcgtccgtcgcgg

SEQ ID NO: 698434 - DNA, 216 bp, Homo sapiens
cagtgcaagagcaacacgtttccacagggtagacattatgagaagcaagtattttctctctggaggcagaagatgttctcagcatcgagaaaaccgcctggcagagagaatggccatccttcacgcagagcgacaggttctgtataggtcttggttcagtgtggcaccagcaggcaggagcacgtcaccaggagcaggagtggcgaaacgagtggc

SEQ ID NO: 698435 - DNA, 337 bp, Homo sapiens
tagagatgggtgtctcactctgttgcccaggctgcagtgcggtggcgaatcatggctcactgtaacctagaactcttgggcccaagtgatcctcccacttcagtctcctgaagggctgggactctaggctcatgccactaccaccagctaatttttaaatttttttttgtagagacagggtctcatctctcgatgttgcccaagatggtcttgaactcctgggcctcaagcagtccctcccacctaggcctcccaaagtgatgggattacaggagtaaggccaccacaccgggcctaaaaggtatcctttttaaaatgaagtattttgaataataaa

SEQ ID NO: 698436 - DNA, 112 bp, Homo sapiens
agtctggggtatgcatggcgctctgcgcgcctctgactggttcggtcgatcgggctgtcgtatctttgggcgccgataccgacgccattcgcagggaagaccagtcgagccg

SEQ ID NO: 698437 - DNA, 451 bp, Homo sapiens
  misc_feature (283)..(283): n is a, c, g, or t
  misc_feature (286)..(287): n is a, c, g, or t
  misc_feature (336)..(336): n is a, c, g, or t
  misc_feature (345)..(345): n is a, c, g, or t
ataaaaatctcccgtctggttgctgctcggagaggctccaagaaatgcaaaacaaacccgcctggaaaatgctgccctgagaaccagagcgagggcttgaaagatgccttcaacacagactcttctaggaatccagccagctttgggacggccgtttcacaaaaccaaaaaacaccaagtaacatttctaaccggagaattgccggttttagcaagaaaaaggggcttcacctaaaagggagggtcacaaaacacgaaggtgttccccctgcgcctgcctctnccnntctgagcagatccgtccgttactgttgtcttttatctccaccctggcangagggggcncagcatcctgtctgtgtgtgtgctcactgtttgcccgcctgtctgccaggcttcttctctggctgcctctgcctgtgcccgggatccctctctcgccccggccacc

SEQ ID NO: 698438 - DNA, 406 bp, Homo sapiens
aaggctctctacctagtttgatcaggttaatccggactggaaagggatgggagggagggagctggcaaacaaacccggctctgctggtatctcagctctgtagtcctggttcagttcttagcctctctgagcatgaatttccttgtcagtaaaaagcagtggtactcgtacctacggtgtaggaaggtggtttggtggattaaatgagacagcaaagcacttacagcaatattgggtaaagggtagtggctacaattctaatttaccaagtaagcataatttaccaaataataataattaaaagggaattcattcaaggccccaagtatcactgaaacgggcccaactatcccatagaactaaggtgtatggttgcttttgactatccaggtagagagccgggcaa

SEQ ID NO: 698439 - DNA, 284 bp, Homo sapiens
atggaaagctttgtttgcttccccaaaaacatgcttattccttaagggatgggttagaggtactgtggatttttctgttttctgtcttacaagaaacttgtctatgtaccttaaaactttgtttaggatgaggagtctttgggtccctggacagtagtttgacggatttccccttttgtcccctagtaagcccaggtgctggatttgaacagtttgagctctttttgtaatatactctaaacctggtatttttggggtaataaacgagatgcaggacccttgga

SEQ ID NO: 698440 - DNA, 136 bp, Homo sapiens
ctgggaccactcacacagagagtatctcctcacctccagccagcaccagtacactccatacaacagctgaacccaccctggcacccactaccaccacctcattcacaacttccacaactatggaaccaccttcaac

SEQ ID NO: 698441 - DNA, 130 bp, Homo sapiens
cccattgacagatggagaaactgaggcccaggccaaaaaatatctcactagaggctcacgcatttcttggaaaaatttggggcttggacttaacggacggtcgttcagcagcagcgcggagcttccgaag

SEQ ID NO: 698442 - DNA, 135 bp, Homo sapiens
cgcatattcatgcaccatacccgaagctgccaacttgtatttcaggcaggatcgatgggcttgggcggcgacgtgtacgtctggatatgggcgaaccggtcaaaatcgtggagtaggctgacaagatgatcaatc

SEQ ID NO: 698443 - DNA, 972 bp, Homo sapiens
aaaatagcaaatcacgtgcatggacccctctctacaagtgcagctttttatagaaattctgaacagatatatctatctttatgaaaaggaaaatgatgcggtaacaattcacggttttaaaccagcattatccaaaagattcgagaagacctcccgaatcttgacatccagtgaagaaccacgcagcagattaacaaacatttccataacacactgcgacgcatttgcgcttgcggcgggaatcaccagaatccgaggggccaaatttatcaacggtctcatcctttaccaaacggaaatagctcaccatactcctttccatgtacatccagcgagggttttattaccgctacgctttcccttccatagatcgtgccttccagaaatgctgaggtaggtatcccatttcttacctgcgactgtgttttacccagcacatccggacactcaccttcacgaccataactacacatctattcacttggtaagtgtccaacctctttctgatcaccccaagtagcatgactgatctgcattcaacaaatccctgtgaatctgtaacaacaacaaaaccacacaaacacccacacaccccaaaacacaacctaaaccctggagaaacaccagagacgacccaccccacaacacagccacggacaagcaaacgaacaagcacgagaacaacgaggtgacaacaacaacatcaaaaaccacgaagaacagatacaacgcccccacaagacactactgaaacacggaaaccacaaaacccacggactaacgcaagataaattacaacggaacagcgacataagacacaagtgacaaagtaaacacagcggagacatacacccacaaccagtagcaccagcctcagcccaatgctcctaaacaacctaccgacacagacacgcacaatatacacaaagcccaactacgacaacacaccacagcacacaagagttacacacc

SEQ ID NO: 698444 - DNA, 288 bp, Homo sapiens
tgcgttccatcagcacacctggctaatttttgtatttttagtagagatggggtttcaccatattggccaggctggtctcgaactcctgacctcaggtgatccacccgtctcagcctcccaaaatgttgggattacaggtgtgagccactgcaccgggccacaatttgcttattttcaaataagctgtagtctttcaacaattagcaaattagtatttggaatttgtgtccaccaattatttttaactgatagtttatttagataatatcctgatgggagaagactgcg

SEQ ID NO: 698445 - DNA, 2036 bp, Homo sapiens
  misc_feature (34)..(34): n is a, c, g, or t
taatgttacggataggtaaactgaggcccaaagnggatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgatcagttcactgaaatatttattgaacacctactggaaccaagtgactgtgctagtaacttgtgatatacagtagtgagagtccaggcatgtaaccgatcattatagtacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagat

SEQ ID NO: 698446 - DNA, 721 bp, Homo sapiens
  misc_feature (406)..(406): n is a, c, g, or t
cgccactgcgggctgcctggccggccagccgctacaggagcggacccacgcctggtgcgagcggctgcgcgcgcggctggaggagatggacagccggacccgcgatcgcctggacgaggtgaaggagcacgtggaggcagtgcgcgccaagctggaggagcacgcccagcagatactcctgctggccgaggacttacaggcccgcctcaagaagctggttctagcccctggtggaagacatgcagcgccagtgggccgcactggtggagaaggtgcaggctgtcgtgggcaccatcgccgaccctgtgcccagcgacaatcactgaacgccgaagactgcagccatgcgacctcacgccactccgtgactcctgtctcctcgcaggctgaagagggagaccctgtncccgtcccagccgacctcctggggtggaccctagtgtaataaagatgcaccaagtgtctcgctcgggtgctattggaataatgaaaagaaaaaactcttgggggggcccggtacccaaattgcccatagtgaggaggattaaatatactggccggcgtttacaacgtcgcgatgggaaaccctgccgttcccaacttaacgtcttgagaacaacccctttttcagctggggaatacaaagaggccgacatatcgtcttccaaagtcacctgttggtgaatgcaatgtgagcgtatatttttgtcccgtatttttt

SEQ ID NO: 698447 - DNA, 618 bp, Homo sapiens
  misc_feature (34)..(34): n is a, c, g, or t
taatgttacggataggtaaactgaggcccaaagnggatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagcagaaacttctgaagactaaaacgtccctgtctgacagctctgaagagagcaatcgttctcccagcacagtgtttgagctctgagaatggacagactgcctcctcaagtgggtccctgacccccatgtagcctaactgggagacacctcccagtaggggccaactgacacttcatacagctgggtgtccctctgagacgaagcttccagaggaaggatcaggcaacaatatttgctgttctgcagcctcctctggtgataaccaggcgaacagggtgtggagtggacctccagcaaactccaacagacctgcagctgagggacctgactcttagaagg

SEQ ID NO: 698448 - DNA, 2339 bp, Homo sapiens
  misc_feature (34)..(34): n is a, c, g, or t
  misc_feature (2115)..(2115): n is a, c, g, or t
  misc_feature (2117)..(2117): n is a, c, g, or t
  misc_feature (2132)..(2132): n is a, c, g, or t
  misc_feature (2149)..(2149): n is a, c, g, or t
  misc_feature (2167)..(2167): n is a, c, g, or t
  misc_feature (2173)..(2173): n is a, c, g, or t
  misc_feature (2181)..(2181): n is a, c, g, or t
taatgttacggataggtaaactgaggcccaaagnggatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgatcagttcactgaaatatttattgaacacctactggaaccaagtgactgtgctagtaacttgtgatatacagtagtgagagtccaggcatgtaaccgatcattatagtacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagatgattcatggaaaaaaaaataaaaatctaaatgtgctattaggcagagttattaacttcttttagttgttgtttgagatngngttctgctcttgttncccaggctggagtgcantggcgtgatctcgtctcnctgcancctccgcntccaggttcaagcgattctcctgccccagctactttggaggctgaagtgtaagagttgcttgagcccatgagttagaggctgctgtgagctatgatcatgccactgcactccagcctgggcaacagagcaaaaccccatctctaaataaaaaaaaaaa

SEQ ID NO: 698449 - DNA, 459 bp, Homo sapiens
aacccctcgatcaccacaatccatcgagcagaaagagggaagggatcataatatatacaactcttaaatcttgggacaccactattataaaccaaacccccaaacaatgacgattagcactacgatgaacacgctaaggctcagatcgtacacagtgacctttccaaagagcacagagccgagtatggtcagagcataaattagaacccaggtctagggattcaccatccaacctgtctgttctccaagcgtatcatattgtcttcaaaggcaatcctctggggtacttattggtctgaggaaccaagaccagagaatgacaatgtagtttcacagcctaacatgacgaccgttaacattcgctgaacacctgctatgtaacccagcagtgtgtgaggtgctttataaacattagtaataatacataatgccgctaacattttcaaaacagcatgtctc

SEQ ID NO: 698450 - DNA, 103 bp, Homo sapiens
ctgtggaaaatcgggatcggaggaacgtcactaacttctctgagtcttacaagtggagacaaccattacttcctaccatcagaggattgatgagagtgattcg

SEQ ID NO: 698451 - DNA, 1109 bp, Homo sapiens
acaaccatggacgcaggacggtgcaagcaggttacgaagtgacagtgctggtgcgggactcctccaggctgccatcagaggggccccgggccggcccacgtggtagtgtggagatgttcttgcaggcagacgatgtggtacaatgagccgtggtctgggcaggactgctgtcatcgtagctgctgggcactccgagaatgagctcagtcccagcgacgagtgatgtccgagtggcgcccggaacattgtggcaggccatgaaggctcatggtgtggacaaggtcgtggcctgcaactcggcgttaacctgctctggtgaccctaccaaggtgcccccactgactgcagagctgtgactgattgaccacatccggatggcgcaaggtgctgcgggcatcaggcctgaaggtacgtggctgtgatgcacgacagcacataggagaccagacaataactggggcgtacacaagtgacccctggcatggatcgagaggccttcaaaggggtccatctccaaacattgactgggccatttcatgctgcggctgcttcaccaccgatgagtacgacggacagagcaagctaaccagacacgagcaagtaaccagataggcacactggccacatcatgggaagagtggaccttccagggaccaatgacgggcaagacggaaagggggaacaaactggagagacaacagagccgacagacacctaagacaaacaagacaaaacaggcgcaacgcaccaaaagcataccacaagggggacacgcatacacagatacccaaatatagtgacacaggagccccaaaacagcgcgcacaaagcccaggcgcagaagcggcaacaacacagacaacgagacaacgaaaccggaaccgagacgagaaccacggcgcggggcgacagaggaccaagaccagcaagagaaggtcaaggggcaagaacaccggaacaaggtaaaataggacagagcgagaagtcgtgggacgagagaaacaaccggcacgagacgagaccgaagacgacggacagacgagacgcacggcgagacagaaaagaggcgcgggcaacagagagcaccacaacagcgagaccgaggcaac

SEQ ID NO: 698452 - DNA, 469 bp, Homo sapiens
tacggtagtggtacattattcagtcgtgtgtgcattcttgtgaatctttttttaggcttagtaatgttacacaggctgatagatcatctctttgatgtgaaaagcatcttgggttatacattaaaatcgaggtggacattatttccccaatttcacaacaggattcacattgttaatttataaatctagacttggagaattaaggactgaagaaatgaccataatctaaaactatctacgacaaatgtgaacttaaaaggacatgcccactgaattcagtgtcctttgagtaaaacaaatatctatctgctagcacatttggtattaagtgtctactgttcctgcctgttaatcgctgggaacacaaatagtgcaattagtgcaataggagaactctagccttttatcttgggtccccccaaaaatacaaaccaacagaaacttgttatgcactcatcaaattgtacta

SEQ ID NO: 698453 - DNA, 1332 bp, Homo sapiens
  misc_feature (284)..(284): n is a, c, g, or t
  misc_feature (664)..(664): n is a, c, g, or t
gccatctactttccggtggctggcatgtcacagggagtgctcatgcttgactactggaaggatgaccggtcaggtcccttgctctttgaggagctccacctcgtgagatcttgagagagatgagatgtggcattatggaactatcgagggtaggtgaatgaactgccagagtagttcggctgaaggcttgtcctcgttactgaggggcttgctgatggatcagggatctctggcgaggcaagaaccaaggtgggacacgggctgttcacacagcggcaatcaanagggcagagagagagagtgtgcgcttgagtgcccatgcgaggaggcagtcgtttgagaaagtactaagcattccaatgggtagtgcaaagtcgagtcgggtcgtcgtagtcatgacgatgtatacatgcttccattgtcgtggcttcatgtgtgtcttttaaagggaagtggatacaaatttgttctcgtatacaggattgagtggcatagagtttagttcaaaggattagcttgtttacacctcattaacacgctatactttggcgccatttatataagtgcaattgggggatatgcatatgccgctggaaggtatttaggggatgatttcgtgtgaatgagtggaatgtaattccaggattagtatgcgcccacgtgntacaaaaacagttcaaaaatgcgtagtatcggaggggttttcatttcagcctgttttcgagacaactacccgtaacaatggtccttcacgtgtgcgttcgcaggaaaagctggggggcaccaaggaagtggtcgtccacggtaattgctctaaccgccaaggccctgggaggatggcacacttgggctatttgtattcgttccaatgtcctacagaggtggcgaacaggccgttgtcaggcctttcgctgtggtggggttccaaaaggcggggagtaatccttgcgcttggcccctccgcaggcacgtgccttggaaggttaggcttggtgggaactctactgaagggagcaccaacagagtcgaatacaaggggcccccaggctgtaaaattttgcagtcgggtccgtttccactaccgggtagagcatagcaaccaaggaagggtgttatccaccccggactgtgtttgagcgccaaggggggcttgaggaatcgttcgggacaggtttcccttgaccctttgagagtgatttccaacgccgcaaaccgttaggtggacctctcgccacgagacagttgtggcttggaggaatttacccgtgggctattttgagggctcgaaccatatggggacttggggggatttacacgagaaagcaccccttt

SEQ ID NO: 698454 - DNA, 277 bp, Homo sapiens
tagtcctcaggggagactatagtacagtatacagccacggaccccgtcaggcaataacaggacaggtgatatccatatggtcataaaaggttctcccggggaaaattccattcacaccggtaaatgggggatttaatatgcactccagataatacgggagtcaacggtactttaactggctgggagggctatgatttcacagaaggggtctactggacaatgtattattggtgcttatagaagatggcgtcgggaaaccaacatataccattaaagg

SEQ ID NO: 698455 - DNA, 935 bp, Homo sapiens
ggatggaccgtcagccgtaaggatggcaatgccagtggaaccacgctgcttgaggtctggactgcatcctaccaccaaactcgtccaatgacaagcccttggcctgctctccaggatgtctacaaaattggtggtattggtacttgttcctgtttggcgagtggagactgtgttctcaaacccggtatggtggtcacctttgctccagtcacacgttacaacggaagtaacatctgtcgaaattgcacatgaacgctttgagtgacgctcttcctggggaccatgtgggcttcacatgtcacagaatgtgtcttgtcaaggatgttcgtcgtggcaaacgttgcttggttgaagaaaaaatgagccagcaatggaggcagtggttcacttgtcaggtgatatatcatgaacatccaggcaaataatgagcctggtatgccctgtattggatgggaagaggtcaattgatgcaagttgggtgagtgaaggacacagattgatcgcgttcgtggtaaaaagtggaaagatgggcctaattcttgaagtctggtgattgcgaggcccattgtggctattggtttcctggcaagccatgtgtgtgaagaggcttcttagacttatcacttttggatcggtaggatggttcgtgaatttaggaccggctatgtgcgggtgggtgtattacatgcatgacaatacatggatttgaactgagaaggtcatcaaggttgtcctgaaaaggttaaagggtaatgaattttatccaaaatacgtggaaccaactatatctaggtatggatacaggataagaaagtatgtacatgagctttagtagatacaagaggatatgatacaggattaacgtaagaaacgtagtttgcacatgtatttagggaggcatattagataagcattaggaggcattagtggaaaac

SEQ ID NO: 698456 - DNA, 394 bp, Homo sapiens
ctaccggacgcaacaaatagaaggaactataggcctggtacagtggctcatgactgtaatcctagcactgtgggaagccgaggtagtggatcacttaaggtcaggagtctgagaccaacctggccaacatggtgaaaccctgtctctactaaaaatacagaaattagctgggtgtggtggcgggcgcctgtatcccagccactcaggacgctgaagcagtatattttaccacaattaaacatttttattaaaaaatttagcagaaggccaggcacggtgtttcacacctgtaatcccagcactttgggaggctcaggcaggcagatcacttgagctcaggagctcgagaccagcctgagcagcatgggaaaactccatctctaacagtaccaaa

SEQ ID NO: 698457 - DNA, 171 bp, Homo sapiens
gagaatctggtgtgatagcactatactattcagacactcaggcctttacctagttgctcccctaccttctgtcgagaataggattattcccatgcacctctagggatagagtataagtagtcaggctattgaacggggattattttaccccatggtcacacaggggaaaca

SEQ ID NO: 698458 - DNA, 1008 bp, Homo sapiens
  misc_feature (3)..(3): n is a, c, g, or t
  misc_feature (21)..(21): n is a, c, g, or t
  misc_feature (25)..(25): n is a, c, g, or t
  misc_feature (31)..(32): n is a, c, g, or t
  misc_feature (50)..(50): n is a, c, g, or t
  misc_feature (144)..(144): n is a, c, g, or t
  misc_feature (170)..(170): n is a, c, g, or t
  misc_feature (269)..(269): n is a, c, g, or t
  misc_feature (289)..(290): n is a, c, g, or t
  misc_feature (337)..(338): n is a, c, g, or t
  misc_feature (526)..(526): n is a, c, g, or t
  misc_feature (562)..(562): n is a, c, g, or t
  misc_feature (585)..(585): n is a, c, g, or t
  misc_feature (650)..(650): n is a, c, g, or t
  misc_feature (684)..(684): n is a, c, g, or t
  misc_feature (692)..(692): n is a, c, g, or t
  misc_feature (993)..(994): n is a, c, g, or t
  misc_feature (1008)..(1008): n is a, c, g, or t
agngaaagagggaaggtaggnaggnatgggnnatgggtttaggagggttnatggcttcaatgatagaagagatatgtgaaggtgtggtcaaatgtaatataagaatgaaagtttaggtagagataaggagtatggttattacantattgacatcaagcgaaagagggggngggggagggaggcggcgagcgggggcagggggaggcgtcgaattgcgaggcttcgagtgtgcaccgcagagaatacggggtcaaagagtaggagaaggnaaatcaagacaccatgacannaacggaggacagtagcaccttataatcgagctaagtcgaacactgcnnccgcccgttcccgcgctagctttagccgccttgatcgcaagaaagcgcagtcgcaccttctttctcgtctgcccgccccggccaccgcaccactcgatcgcacgaccatcccgcacgcaacgacaatcagccatcctccctcgcccctttctgctcccttcccattcctctctctacacccaatattnccgcaacctccatccgagctctgaggttgcatcgcnctacgctagcggccggtcgggtnttactgcgcactagtacgcgcgtaccgattcgtccaatacctcccaccgaacacctcaccctgantcgactcgagacatccgaggctcagatctcgcancgaggtgnccgccccgcgaatcaccagcaaccaacacattacgtccgccccagccctccgtcacaaccacactatattccgccgcccttcatccctggtcacccgctctcccctcaagctcacctccctctttccgctccacgccgcctgcgaccgctccccgcaccttcttcaatccgcccgcacttgattctcattatgtatatcccctccgcccccgcaccccgcttcccaagggcgtccacattcccccattaccctacgtctctactgaattccaagtcccaccgtgccaggcagggcgcgcgnncaatagtagtggcn

SEQ ID NO: 698459 - DNA, 892 bp, Homo sapiens
  misc_feature (217)..(217): n is a, c, g, or t
atgtgcttcatcatggttctgggtcgttcacctgccgtttctggtcatataggtgtgcttctttcagcggacttggcgggcgtgtccgatcccgtgtgcctggttgtcctccgattggccgggtccatatgctgccccgggcccctcatttggcgcactatgcggagcttgtaccggttcgcgcctttcggggaaccggttatttcgtgttctagcncccgagggccaccgcccgcgtgtcccgggcgttttattgtttccaccccccgccctggtgcggtgggaacaccacaagctcccctcgcgcaaatggggcggtcaccccccgagcccaaaaacaaaggagccctaccccccatgggctatatggccgaaagagtcgcgcctgagaaattgttgtgccaagaggggggccaacgttccggtggaaccaccccgcgggggtctactcccctggacgttgtagctcttcccacggaagccctcgtaatgcgttgtgagcaaaaatgaccccggccgtccttctatgagaagaggcccagggccacaggagggcaacttccctgggcaacagaaccttgccccgccagctcagtgttcgcagacatatcacaacaagagggctgccacacgtgcctcaaagagatacacgggcccctcctcctgccacatcacgaccagttccccccctgaagaggtgtgtgggggccccacccacgccacccgcgagagagaaggcggttcctcacgatcccccgcaggggaacagcccccggaaagtgggacagagcgaacacccgggcccggtttagcaaacgattctgcgttacaaaagagcctttaacccccacggaaatgggtgtggaaaaaaaaaaccccttttacaataaca

SEQ ID NO: 698460 - DNA, 1152 bp, Homo sapiens
  misc_feature (1152)..(1152): n is a, c, g, or t
ggctgtctgttcaatctcgtggctacaagtgtggatatgagtatgtcctattcaatagacccgcttcagttcgacactcaggactacgagtggttgtgacaatgtgtcctacatagtggattccacaccgatgggcaagatgccagtgggcaccggcaagggctgcagaacggggaagctagtcaatcgaactggaatatcccatcaccatcttccaggagcagagatccctccaaaatcaagtggggcgatgctggcgctgagttacgtcggtggaggtccactggcgatcttcaccaccatggagaaggctggggcatcatcttgcaggggggagccataaaggagtcatcaatctctgaccccctcgtgctgatgcccccagtgttcgtgatgggtgtgaaccatgagaaggtatgacaacagccgtcaagatcatcagcaatgcctcctgcactcaaccaagctggcttagcaccccgtggccaaggtcatcgcatggacaactttggtatcgtggaaggactcatgagcacagaccaatgccatcactgcacacccagaagacgtgtggatggccccgtccgggaaactgtggcgtgatggccgcggggctctaccagaacatcatccctggctctactggcagctgccaaggtgttgtgggcaagggtcatgccctgagctgaaacgggaagctcacgtggcatggacttccgtgtcccaatggcgacgtgtcagtggtggactgactggcgactagaaagactggcccatatgatgacatccagaacgtgcgtgaacaagcgattcgaaaggccccgaagggatacggggaacacactggcaccagggggaacaactgaactcaacagggagccccgtcccccacattgaacgcggggcgggaaagccccaacgacagcatggtgggcccaaataccggcgtagcacaacaatgtcagaaacaggagggggggccaggcggcacagtttacagataaaccaggcaacgccaaacgcaacaggagaacccgtcgagcggacgacacacacaaccatgactgcgacaaacagagaagaccactaccacagaccagaagacttgatcgggaaaagtcgtacgagcaacaaataaaacgacgaagaacn

SEQ ID NO: 698461 - DNA, 1045 bp, Homo sapiens
cactgttgtcacttttgtgtgtcgctacagagcccgtggggtcttttcccctatcgtgtgtgcgcgtttgatgcgctctcgtgacgctgtatggtatttgtcccgttgttgagtgccgctcccttcctgggcaatgtccctttggtgggccaccttcctcgctggtgctatgtttccgctgttgtgatgctccacgctgttgtcggttttatcccctccatgtctgtccctgggcccgggtcgccacttcgtgcccgcttaagactatggcccgcatgtttggatttggtttttccaatgtccccctttcggcttttctggggcctgttcccttgtgtttttgtggccgttcgtttggcacccggtcactacttgtgcccaatttgcccgggtacaggtgacccctcttcaagccccggtcatgatggaggtccccaggcacagggtacccttgagctccgttggtcttggtccagctcccttagtccgtccttccttagcctggaagtccgtatctggagtcacccaagcccatgtgtttttgccatctaggccttcacctggtctgtgggacttagtacctgtgtgctgtggtttacccggtccacctggttcttcaggcccctgacacgatgagacaggggctagtattgacagggccacagatggaactgtttgtttgaattttcctgagagccctggcttatgttctgggccttctctttaacctccttaccatgaggttagtacttttagtccctgttttacccggggttagaatagactgttaaggggccactgagaaatgaaccacgatgaagtgcacacgtctatggggtctgagagggcgcacacgaaaaaccactgaaatgcacggcacgattttcgctgacaatctgccacccacctttataaaccacgatggttcctttcaccaacccctgggtccaaaacgagaataatttggcctataatgttaaaagacaatgcccggaaggttgggttaattaaaatcttggtgcctggaaaaaaaatatataaataa

SEQ ID NO: 698462 - DNA, 640 bp, Homo sapiens
ggtcgctgaggctgctgccccgggcggagaagcttgcgtcggtggctggagcagaggcagcagccggactagcagcggaggcggtcgggatcgatggtgaagatggctggtggctgggcgttcggaggcggcttggtggcctgctatctacgtggcggcggcagtgagggcggcctgggcccctagagcggctcatacgactgatcaatcgccggcgtagccagtcaccggaggcggcggctggtgtgcgtgtggatgtgagccggggctgcgggcggcggtggcggtgggcgagaactacgatgaccctgcacaaaacccctggttctccagttgtccagcgatcacgtggtgccttgtacttgattggtgtggttgtgttggaaaggcaagatcacttgctagggaggggccttttgacgagagaacggttttgggacacccatccagccctattgtgggttgcgctaaatggtccctacatatatgggaaggacacatgcaactgtgctgggaatctcttggaaggaatgctggtgggggggggctttgacatgcgccggttttaaactcatgccatgcacgagctggacccaccggtatgcgacttgctgtgtcacccggactttggtggacctac

SEQ ID NO: 698463 - DNA, 367 bp, Homo sapiens
accgactgagggtcttcctgtccctcatggcgactggctggtacgataaccttactcctggacatagacaaagctgatgccatagtcaagatgctggatgcagccgtgattcagatggacggaggccacggagaatgatcttcgccatcctggagcaggcagaggaggcggagcaggccggaacgctggggagccagcacgaaagcagaaggacgggctggagcaggctagggacggcgacgcaagcaacgaccacccctaccacaacacacagcgcccccccaacgcaaccgccacgcacccaacacccgggccccccaccgccgcacacaccggacgaccacgggagcgaccacagcgcccccac

SEQ ID NO: 698464 - DNA, 583 bp, Homo sapiens
tcaaaccgggcgcgtcgcgacgtgtatccgaatagcatcgatgtcgtacctggctcagtcaatagttgtcacaggtattcagccatttcggaatatgccacgttattctgctgggtaaccatgtttatagtttagtgtacagacatttagaaatcagaaggtaactttatagacagtaacaccaagtatcctatgtcgtgcttgccccgaaatataactaactagtataacggatgtaagcaatattaatgatggtttatataactgtgtgatacacatgtgtgcttttactttactatataaactatgagcaaaaaactgatatttgaagtagaatagaatggcgtaaatcttaatgaccagttattgaccaaagtgtactcagaagatgtaattatgtcccaatctaaggaatcctttaatttggggatgaactttacttacacatgccgtttcagcttcagttgcctcattctatgacatcattctggtcaagtctaagctttatcatgtctgacttcgtttaacactgaatctgtgatgtaaggcctgtataatgtgccatataaattttattcatcat

SEQ ID NO: 698465 - DNA, 259 bp, Homo sapiens
gaggcttgggaacaaatatgttgtgtagagttcaggagagagtgcgtcatatgttgttcctaggaagactggtgtgggaagggtcgttttggatgcacttgagcaggggtccccaacccctgagccatggagccgcaagggagccacacagcaggaggtgggaacatccagttgcaggaaaacaagcttaacacgcccactgattctacattatgggtctccctctgttgtccaaggctggggtgtagtagtgctatcg

SEQ ID NO: 698466 - DNA, 662 bp, Homo sapiens
gcgaattcggccattatggccgggcatagtggctcacgcctgtaattctagcactttgggacgccgaagcgggcggatcacaaggtcaggagattgagaccacggtgaaaccccgtctctactaaaaatacaaaaaattagctgggcgcggaggtgggcacctgtagtcccagctactcgccaggctgaggcagaagaatggcgtgaacccaggaggctgagcttgcagcgagccaagatcatgccactgcactccagcctaggcaacagagcaagactccatctcaaaaaagaaacactggaaaagagtaacgataccaattgcgtaaaaatgttggaattaattctttttcctttcataactctcttgacccggttgcgatgcctcatgtcttgactcccaacactttggtaggccgaggcggctgcatcacctgacggcagcagctcacgacaggcccgtatcacatgtcgaaactcccatcccttataaacataccccctattccgcacatgctcccagacgcctgccaccccagctccttcggcacacacggccgcctcactcgccggactcaggatcccactgctccacgcgtgccgctcctgccctatacatttcagcctgtgccatacggacttgctccgcccaccctacgccg

SEQ ID NO: 698467 - DNA, 782 bp, Homo sapiens
  misc_feature (6)..(6): n is a, c, g, or t
  misc_feature (212)..(212): n is a, c, g, or t
  misc_feature (214)..(214): n is a, c, g, or t
  misc_feature (218)..(218): n is a, c, g, or t
  misc_feature (257)..(257): n is a, c, g, or t
  misc_feature (269)..(270): n is a, c, g, or t
  misc_feature (313)..(313): n is a, c, g, or t
  misc_feature (439)..(439): n is a, c, g, or t
  misc_feature (450)..(450): n is a, c, g, or t
  misc_feature (457)..(457): n is a, c, g, or t
  misc_feature (491)..(491): n is a, c, g, or t
  misc_feature (519)..(519): n is a, c, g, or t
  misc_feature (536)..(536): n is a, c, g, or t
  misc_feature (556)..(556): n is a, c, g, or t
  misc_feature (564)..(564): n is a, c, g, or t
  misc_feature (745)..(745): n is a, c, g, or t
cggtancggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcccccggacacccgctcncnaaangatacctcccgttgccgagggcgcgcgcccgttgggaangcaaaagcgtgnngcttgaaaaacgggcccaagcgggcaccttcccggtgaatggngccccccgggacagccttcgatgacacgcccccgggagttatcgggcgggcctacaagaactaccaactgggccccagaaagaaggagaacccagcgcccgcgctgtctgcctcgcggggcgcggngagctggaganccccggnggggccgagaggcaggcccgcttgcccctttacnggcgctctcccccgctggcgctttcgtnggttgctcctggatctntcagacctggtacttcgctngggtcaancgccttttcagttggattccagttacaagcattcatttagcaaacgttctttctgaggggctttcttacgggtgttcacctttggctggcaccatcggactgggcttgtcccatgggtggtaacatgtctgggcccttacggtgcccccctccatctttccccgggcccaccctgggctgnctggggacacccagtagggccttgcgggcttcaaccg

SEQ ID NO: 698468 - DNA, 368 bp, Homo sapiens
ggacagaggtgtgttgtcactgagtgtggcatctgactgtcttggggtccacacacggcattatttgtactgtagagcttgtggtcgcagagtcagtggatcgtcattaacgaacattgctacacgatgcagccagcacaacatggagagatcatcaaacacttggcaacgccttacagaataaatccaggtgcccatggaccgagccagcatcctgtggctcatcggagagtactgtgagcatgtccccgggattgcacctgatgtcttaagaacaatggccaagtcattcacagcagaggaggatattgtcaagctgcaggtcatcaacctggcagccaagctctacctgaccaactctacacagg

SEQ ID NO: 698469 - DNA, 302 bp, Homo sapiens
gggatggtgagtgttatggggggtttgatctataagtgaagccgacgtgttgtaaggtgagacgtggagtgatgtgaggagatgcatggactatgaggatgaggtgcagaataccagggagcggcagcagaagggagagaatgagcttaaggagctggaacagaagcactcgcagctgaccgaggagaagaacctgctacatgtgatcatgctgctgtgcgagacagagctgtatgcagacggctgagtgagattgcggttgcggctggctgtgccaagaagcaggagctggaggagatact

SEQ ID NO: 698470 - DNA, 384 bp, Homo sapiens
ggaattaaaatggaaaacgttgccagtttgtaaacccaatccagatgctgtgttaagcatggtgcccaggtggaagccctgccttttgttcccacgtgctgccacaaaaatggccctggtggggtgaaatggacggagaaccccgttcccaaggataactcatggtgtgggctccagaagcccatttccctgaaatcctaagaggacccagtttcagttttcattaataaaaaatacatggggggattttagaacctaaaagtgttttgcaggaatttaaaaccgggaaaggagggtggcttgtttccctggtcgcgtgagctttttttttatctgtttcccccaaagttgtcagcggcaataaaacgagactgggagtcatca

SEQ ID NO: 698471 - DNA, 215 bp, Homo sapiens
tcttctggccacgcccctgaaaggcggctcaaagacgcgtcatgcagacggtccagaagctgatgctggcattgaggggtggaactgacggctgtcgaccgtattactgcgaccccccctaaaaaaacggctgccatctggtacagatgaagctgtatttgaaagtgcgcactggtcttagtagcgaacatcgacactctgtgaatgcgtaaggg

SEQ ID NO: 698472 - DNA, 285 bp, Homo sapiens
  misc_feature (46)..(46): n is a, c, g, or t
  misc_feature (48)..(48): n is a, c, g, or t
  misc_feature (62)..(62): n is a, c, g, or t
  misc_feature (90)..(90): n is a, c, g, or t
  misc_feature (118)..(119): n is a, c, g, or t
  misc_feature (155)..(155): n is a, c, g, or t
  misc_feature (229)..(229): n is a, c, g, or t
  misc_feature (245)..(245): n is a, c, g, or t
  misc_feature (247)..(247): n is a, c, g, or t
  misc_feature (249)..(249): n is a, c, g, or t
gatgtaacacgagaaagcacataccaaggccaccacacaccacctntncaaaaaggccttcnatacgggataatcctatttattactcanaagttttttttttcgcaggatttttttnnagcctttaccactccagcctagcccctaccccccantttaggagggcactggcccccaacaggcatcaccccgctaaatcccctagaaggcccactcctaaacacatccnattactcgcatcaggngnancaatcacctgagctcaccatagtctaatagaaaaca

SEQ ID NO: 698473 - DNA, 357 bp, Homo sapiens
ggagaaccaccggtctttattccacaagggccccttgatcaaggttaacaggaggcaacgctatgcttcaaacgccgtgtcagaggccctaatcctataggtggccaacaaagtcaaggtccccctgcaggatctcatggtccggaatgacaccccctgtggaaccaccattggacctatcttggcttctcggctggggctgctggtgctatatttatgcaacccccaactggccatgcactctatccgggagattgcctgcacctcaggagtccttcataccctcaccctcttcaagggcttttttgtgctgttcccttttctaaaccataatcttttagtggattgagccctctt

SEQ ID NO: 698474 - DNA, 905 bp, Homo sapiens
gtattccgcgtcctgatttcaccctagccactcctttgtgacaaattcttctctccctgtgaattctcagatcctttcctgatgggtctcgatgttatctagcaaatacctggatgatataaggtctagaaggaatttgtacaggtccaatcgcatgaacgaaccagcgggtacctagttatctctaaagtacactttccaattcccactggagcttatcatggaatgactttgtacagtgaagcaaccggcattctataatttctcctgattatggttatcattctgtaaagtgtacagtgaatagtgtcaacgtttgctaaataaactggctgagtattcacacaataatgttacacacaccatcttttaggcagagggcagttatgccaaatcatcacgcatgagcgtctggacatctgcaaccagtatgaccatacggtatactacaacagattattagataccacgtgctcactgtaacttgtgaggaatctcaaagagggcttgtaggcacctttcccacaatagagctttcttgatgttctattttcttcagagacagggttttgctctgttgcccaggctagagtgacagtcggcttacgatgatagttactgaagcctctaactcttgggctcagcagtcctccccgctcagcctcctgggtaaccaggatgcaggcacatgccatcattgcctggcttattttaacttttttttttgtagagacatataaatgagaagttattttgctcagactggtctttgaattcctggcctgaagcaatcctcccatcttcgaacctcccaagtagctaggactacagacacgtgccactgcgcctagccttccatatactttattacttaaaggattaccccgccggacgctcacattgcc

SEQ ID NO: 698475 - DNA, 984 bp, Homo sapiens
actggctgatgaactacaatgtggaacacgcacttgcactgcgtcagccaggctgcccttcaccctgctaatttgcgcactgcacggcccttgcccagaaacctaccacctggcaactaaacgcttcttctgcgtgcccctgcacagggcagcgtgctggcactggcagcgccttgctctactcccctcacagctaccaacacgacttcccctgcgttactgacttctgaacagcaacggaactttaactgcacgacagctacactcggcaagcacactcactggcgccacgaactgcttgccagacttacactgcgcctaccttacactggcaacgcaagcactgcaacgcactgccttacacagcacaacagctctctcctcaactacactaaacgaacaggcgctaagctccagcacactgactgcgagcgcagcactgctactacagcaacacgcctccatgcctgcctactacccgagcagcaactccacgtcctactgcaacacacgcaagccccaacgcaacagcagagcttacacacacacgacacgcagcgctggcacaccggctcacccaacaaactgctccccctgtgacctacacgcacacgcacagcgcactccgggctacgccatcacacacagcaacgggcacaacgccctttccccttccgagcaagtccatccagcgggagcccagcgggccctggcccttggacgcaaggctttaaagaccccccacgtccacactctctatcttaacttggagcttacacatgtctcccaagcgaattaattacggcactttcgacctttaacaagcccttttacgttggaaaccccacaggcccactcacacctcaccaccacctcagcgagcctacgccaccatccacgacgcccggggctccccggccgtccgccggcctgctcactccgagcagcacgaagcgccgcaacagttgccctccgcacacatat

SEQ ID NO: 698476 - DNA, 1052 bp, Homo sapiens
gggcgcctatcgcccagctcggtcagctctcccgcctggacctcacctccaaccgcctggccactgctggctcctgtgaccctgcttttctctcgtggtgctgtgatgcagatggcctctccctgcccccctggtgctgatgctttagctgggaaccccctgcacttgcaactgtgatgcttgctgtggctgctgtgcggcttggctgctgtgcctgtgactgacctttgtgaaactgttgctgctctcccctgccctgtgccttgtgcctgtgcctgctacgttccttgtgcgcatgttgcctctgatgtggctgatgttcctccttgtgatgcctgccctctacatattgccctgcctgacactgccaagctgccctcatagggattgctaggagagtgccatgctgtgggcgcatcagctagccagtgtgccagggtgaccctttggggttgaaccctctgctgccctaaccataggcaccattgtgggcttctgtgctcccattggacgggaccacggtggtctagcgtcttgcggcaacatcttcacagtacccctgatgcccctgtgggcctttttcccctcgaatcctgtgagaacccctctaccgagcgactccgcgtgtgtttgaccctgtggcctgcattgtggcgtgaaccaggcccttgggtcgtgtgcctaaccatctcgttggccattctggcacaacaccaaaatcacctgtagcctttgagttagagtgagcccaacaatggccccctgaccgttatggacactatggcgatgtaccttgctttggagcccattttgctccccattgggtctgggcgaaaccaaggccatggttggcaccaggagtcgtgtaggtcgccctagaacccaccgtggaggcccctcttgaagaacaattccggccagcggcccattaccggtcttctggcaatcttgtcttttgccctggaggggagcttgcaagcgtggtgaccccgccctctgcgcaagttcttagaacgcccaggacctgttagccaggggttgaacagcggacg

SEQ ID NO: 698477 - DNA, 965 bp, Homo sapiens
ttgcgcggcgttgggccgtttacatattttccgcgcctctgtctttctctccggtctgtttgggtcccaacatagagttccccgaggttccttcccgttccgggtcgcccgcccctttatagaccctgggcccgttcacgtgatgtgactccctcgctgcaattcgtgggacagccctcctttatgttggagcctgaccttaaacggggcaccccatgtcccggtcactgtttcgatcggggcgacctccgagcctggtcaagtggtcgccacccctgcgcggcggtaaggtgtgccccacacatgggccgggacccttcttcagggttccgccaccgccgaggtctcctcccctctagagggtgtgcttcccccccggaacagcctcgctgcgggattcttttaccgcaggcgttttgggtgctacagaccggcacccccccccctggttcattcctgataagcggtggtctctttcggggtaggaggaccccccggaggtgtcaccaagccgacgcaatggtgtgcgcacccgagtacctataaagaggccctctttttcccctcctcccacagggggcattgatgaacaattctccggtttctcccacgaaggtcttggtgggccccacagacacacaagggcttcgttataggggagactctccacaatcacatgaggggaggccccagcactcagacaacaatgtctcaatttcacccaaagggccactaaatatctctccttacagtcacctccccaaatgctctattagctggaccgtctgattccgttcacccattatacaaccccccgcatgctctcccatacaaccctgtgaacatacaccaccaagcagagttttattggttacttctttctcccctccacattctctcaagtttaacgttcaagagttattcttcacccccttttaaaacaaaaattttctttccacataaca

SEQ ID NO: 698478 - DNA, 225 bp, Homo sapiens
cagtgctctagagggcgtttccgggtctgggtacagtgagtccgcatctcagcctcctcagtagctgggattacaggtgcccaccaccacacccggctaatttttatatttttagtagaggcaggtgtttcaccatgttggtcaagctggtctcgaactcctgacctcaggtgatctgaccgcctcggactcccaaagtgctggaattacgggcatgagccacca

SEQ ID NO: 698479 - DNA, 208 bp, Homo sapiens
gactacatcacttaccgcggcgggattctagtacattagaggctgattcagtcataatcccacagattgtatctacgctcccattgtgctccatcaacctagcacatacaccaaatgtctgaacctgcggttcctctcgtactgagcaggattaccatggcaacaacacatcatcagtagggtaaaactaacctcggaagtatgtagt

SEQ ID NO: 698480 - DNA, 453 bp, Homo sapiens
  misc_feature (31)..(31): n is a, c, g, or t
  misc_feature (292)..(292): n is a, c, g, or t
  misc_feature (370)..(370): n is a, c, g, or t
  misc_feature (385)..(385): n is a, c, g, or t
  misc_feature (410)..(410): n is a, c, g, or t
  misc_feature (439)..(439): n is a, c, g, or t
caaagtgctgcgtctacgggcgcacgcttgncactgagcccaggttacttcttaaaacgtggccaggtgcggcggctcggccgtaatcccagcactttgggaggctgaggcagaaggattgcttgagtttgggagttcgggaccagcctggctaacatagcaagactccagctattgggatggctgaggtgagtagattgtttgagcctgggaggttgaggctgtagtgagccatgattgcaccactgcactccagcctgggtgcagagggagaccctgtctccaaaaaganaaaatgaaaaaaaaacacatacaaataaaaacaaacaaaagaaataaaaaatttcccagagttaacaaaggcaggganattaattaattcttnttattcccaaaaaacattggggtgnttcccttcagtttgggagagagggaggantccgtttaagttag

SEQ ID NO: 698481 - DNA, 269 bp, Homo sapiens
tttgtgctgctgaggcagaggttgtagtgggctgagactggcattgcactccagcctggtgtgaaagagcgaggctccatcgcaaaaaaaaaaaaaaaaaaaggggcccaaatttggtggttcacccttgttattcccagccattttgaagggccagggtggggggattggtttgaaccccaaattccaaaaacagcttgaacaacagggagagaccttaatctcttaaaaattgtttttttaattacgccgtgctttggttgccccac

SEQ ID NO: 698482 - DNA, 332 bp, Homo sapiens
  misc_feature (53)..(53): n is a, c, g, or t
  misc_feature (304)..(304): n is a, c, g, or t
tgatccagagactagacacgactgagcgactgaactgaactgtacgttagttngcagtctgggaaggccaggcaggcaagatgtgtctcggctttttacttaggtatttatttgtcaatgacattgttacaagaagatctgttgaagacttttaattgctgatgatggaagcaaatatgaaagaaaaagtcattctttggggccaatgctctcagtggtttgctattccaactcttcaaaaactgctctgatccttaaacaaaaaccgtatttaaaagaagcatcaagaagaaacatataggantctctggatcattcacgtaacctctagg

SEQ ID NO: 698483 - DNA, 159 bp, Homo sapiens
tgggttgggggtggccccgtgggggtagctcactccccctcctttttctatgcctgtgacccccgtggcccacacactggagttacctgccctgagcggggatgcagtgttgcacttattacttgaccagcccctcccccaataaacttgccttttgga

SEQ ID NO: 698484 - DNA, 170 bp, Homo sapiens
ctcatacacgatccctccttttggccacgcaggcggcatggatacaggagaatagctctgaacctgtgaagtggatgttgcagtgaggccagatcgcaccacagactgggagacaagattgaaatgccgtctcaaaaaatataagtcaaaagcggatgcaaaaagtgcca

SEQ ID NO: 698485 - DNA, 365 bp, Homo sapiens
gccaacttgaacttcgtttctacccctaatcctgatcctttccgtgacaatcctttcacacagccagaccaatcgacaccttctgcgtttgattctctcgaatctccagatcatactacagagaatacgagtagatcgtctactgcgctgagtaatgggcccctgaatggggatgtcgactactttggtcagcaatttgaccagatatataaccggactggccaacaggaagctcaggcaggcccatggccctttacaagctcacaaacccagccagcagtgagaacgtcaccctattgtgggaagccatgccaatggactgtacatatagaatggactacagcgacttgcgctctgaccgttct

SEQ ID NO: 698486 - DNA, 81 bp, Homo sapiens
aactggcttgtatgaaattttctttctgtatttctctaaatcattttgtattaaaagccaaatagatgcctttttccaaga

SEQ ID NO: 698487 - DNA, 155 bp, Homo sapiens
tgctaggattacaggcataagccaccgtgcccagctgagttacatactctcacatactttcatgttactaattagtgttcttgtatttcagcttgaagaactccctttagtatttctgaaaaggcaggtctagtgttgatgagcctcctcagctt

SEQ ID NO: 698488 - DNA, 243 bp, Homo sapiens
tgtgaatggatagcacgcaccttcacctctcccatcacattgctgcctcgcctcatctgagccatgtgtttacctgtggacactggcaaaccttcttttttagcctgtaggggtagaatacatcattcagggattcaagaggggtcaggttattacatgtaccattaaactgaggggccatccatctatttcaggtctagaaaatatttattactggaaaaggtgcgttgctgattcaattcc

SEQ ID NO: 698489 - DNA, 286 bp, Homo sapiens
ttcccctgtgtatcccaccccaacaacgtgcttccgtcttcgacaactgatgcagcagaagctggtggaccagaacatcttcacttctacctgagcaggacccagatgcgcagcctgggggtagagctgatgctagggtggcacagacttccaaagtattaaaagggttctctggtcctaccctgaattgtcacccgttaaggcctaacttggctggtccacctttcaccatggtggcaggttggccagcggtgcttgagccttgtgcatagggagggcttgtgat

SEQ ID NO: 698490 - DNA, 705 bp, Homo sapiens
agcggggggatgaggtcgcggccggtgggtcccgcgctgttgctgctgctgttcttcctcggatgcggccgagatcgcgtgcgtctgggcccaggctccgacgccgctacaccccagactggactcgagcctggattctcggccgctgcagagcctggttcgacgaagccaagtatacggggtgttcatccactggggcgtgttctcggtgcccgcctggagcagcgagtggttctggtggcactggcagggcgaggggcggccgcagtaccagcgcttcatgcgcgacaactacccgcccggcttcagctacgccaacttcggaccgcagttcactgactgcacttcttccacctcggaggagtgggccgacctcttccaggccgcgggcgccaagtatgtacgttttgacgacaaagcatcacgaaggcttcacaaacgtggccgagtcctgtgtcttggaactggaactccaaagacgtggggcctcatcgggattcgggtggggaattgggaaaacggtcactcgggagagagagaatatgcgatatggaatataccactcactcttagaggggttccatccagtctatctacttgataagaacaatggttcaaaacacagcattttgtcagtgcaaaaaacaatgccagagctgtacgaaccttggttaacagctattaacctgatctgatctggtctga

SEQ ID NO: 698491 - DNA, 926 bp, Homo sapiens
  misc_feature (178)..(178): n is a, c, g, or t
  misc_feature (250)..(250): n is a, c, g, or t
  misc_feature (378)..(378): n is a, c, g, or t
  misc_feature (405)..(405): n is a, c, g, or t
cggagagagcaaccttaaaattttcgggaattcccaattgggggttaaaaaaaggggtttagatttggggatccctctacatttttacttggttaaagtccatatttcaacctacatcaatgcatgaagcgtcatgatgttcatacaatgttttatcatgacgcaagatgtagctacngcatcgagtagtgcatatagtctagatctgataacttgactcatctgtatgagtacgtacctaccacttacncagattgtcatttataataagacatgtgcagtacactgagcaagtagagcttcatccatggctagcatgtgtatgtcaggcaagtaaagggtcaccccactggattcgatgactaagatatgcagatnccagatgcaagagtcacacgtatattntcctcaatggcaatgttacacagtagatggttaagaagaaaggtctgttggcttcaattctgcagctgatgttctacactttatggacttctcacttgaattttaaattctcctgaacaataatttcccatcaatttccatttctttgaatagccaccatgtgtaatttattgataacatctctgaagagctgaattaatgatatttcctagctgttgctccagatcatgtagggtagaggaggctgaagactgctacagagtaaggcatctctattgcctcaaaacgtcagacgagtacggatacttttcccagagtgaagcaggtcaaatccttcatttattttttcaaaaggtacaacatgggttattaacgcatccagtgacaacttcttagccatacaatcagccacaagttttgggataccttctttactcttatagccaccataagcagcctccttccaggtgcgtccagtcagtagcagcatagggtttattgagaggttctgagctcgtgcc

SEQ ID NO: 698492 - DNA, 885 bp, Homo sapiens
gacaacatcttaggatgctttgaggtctaaatgagttaacattttcaaagcacttagaatagtgtctgagacacaagagctatatgttagaggttatcatcattatttgtattttgtgaattacgctgcaaaaaaaaaaaatggtgggttacccaacattcattccccacctttctggctgccagggcctggattgggtggtcggtggttggttggtttccctacaagtggattaaggggcagatcctggattacactaaagtcaggtttggacaattggacagtccatcagacagatctgggcccattacccatttctggtatcctggcaagctaagaatggtttaatatttcctaaatggtggaacagattcaaagaattctggtggaccccttgaacactcatctgatatccaaattttcagcggtccataattaacagtttcggaaaccttgattacaaccaaaaaacacctatttatgttgtgaccgtgtggctgtcttggcattaaccccagcagagtggagtagtggtagcagacaccaaatgccctttgagcctaagatctagcattttacaaggtaagtttcgtgtgacttagaagggtggaaaatttaaaaggcaattgtagaaggtaaggctttaataaggtatttcatggtgtccagaattggtggcttaccaggcaatttggaggggggggggggaaaggccggatattaatgggggcataaattcataatggtgaggaagctggggttagaaagtattttttcaagaaagggtgttttaactggctaatgggccgtacttcgaacaggaatttttgagggaagttgcgtaacctttgaaatacctgtggcaaaaaaataaacaaacaaaac

SEQ ID NO: 698493 - DNA, 1094 bp, Homo sapiens
ccccgtgtgtttttatacgttctctggtaacctcccgttttgcccgtttcgccccgttttgtaccctcctggttttttctacggcataatttataacctccctcgtgtctgcgtcttgattagatccgcttcctctgcttccccgcggttgttattaccctcgtgggggtgaccttcttgttttcccactgagtcccctccctcggggtagtggtcgctgcggtttgtttcccctcttggtcggatggttacctcgtgtcttaactttctgtagtggcgcatcttttctctatatcgcgcacccctgtggtgtgggtgctatctctatctgtctgttgtgtatcttattatgggcggcccccctatgccgctttttcgtattagcctccttatgtgaagagttacaccatgggcaatgcactcccccgttccccgtggagttcaccctctgaatccccccggtccaaaagggaccagcatctaagcacgctagccatgcagcgtccatacgcttttgcctgagccccacaccccaccggggaaccagaccagtggattaaccctttagccatattatatcggaagtgttaactatatgctatactaacccccagggttggtcacaatttcgggcacaagccacaccgcggtcaacacacgagtttaaccccaggtccatatgaaagccgcgcgtataaggagctgttttaagagtccacacccctctccccaattatagcgttgaatacatccacctgacgttggctgaaaaacatcccaggttgacacaccacaaattagactaacgcaaagatggctttaacaatatatctggaccacacaccaattagcttagacacccaactgggattagatacccccctatgcttagcccttaacactccaaccagtttaatcccacctaaactgctctgcccagaaccctatcgagcccccagctttaaactccaaggacctggcggtgccttcatatccctttagaggagcactgttctgtaatcgataaaccccgatctaacctcaccccctcttggtccgcctatatacccccattttcagccaaaccctgatga

SEQ ID NO: 698494 - DNA, 427 bp, Homo sapiens
atctctggtcgtcatatcccttacaggtgaagggagactgacataggcttgactactagcagaggtatgtgcaaggaagaaaagcccagtgaagcttgccccacagagtgagccatcaaactcaagtctggccgggcgcagtggctcatgcctgtaatcccagcaatttgggaggccaaggcaggtggatcacaaggtcaggagttcaagaccagccttgccaacgatggtgaaaccctgtctctactaaaaatacaaacaaaattagtgaggcattatggcaagtgcctgtaatcccagctacttgggaggctgaggcaggagaatggcgcgaacccgggaggcagagcttgtacgtgagccgagattgcaccactgcactccagcctggtgagactctgtctcacataaaaacacaacaccaaaa

SEQ ID NO: 698495 - DNA, 445 bp, Homo sapiens
acacgtccattatgtactcgtcaaagtccttggactgctgagccttaaccagtcgggtcttgtacactatgtcctctcttgtttcagaggccttgtcgagccgttcttccagggtgaccttgtcatccgacttgtgtatgaagcaattctcctcagcacagttcatcacggcagagcttgtccgagcttaccatcctccttttccggatgttagaaccgggtacagctttcctccaggtggtaataggcgtagaccttgactgctccaggctgaataagctctacattaaatgtattggtgaactttgaaagctagacagtcatcctcagagtgtgagatcttgtccaggtagatgatgagggtgttcctatcggagaagggttggtccagctcatacttggagattgtatctgtcaacaccattggccagctgcttcaagggtc

SEQ ID NO: 698496 - DNA, 204 bp, Homo sapiens
  misc_feature (50)..(50): n is a, c, g, or t
  misc_feature (128)..(128): n is a, c, g, or t
gctgctcgggaggctgagacaggagaatggcgtgaaccccggaggcgganttgcagtgagcggagatcgcgccacttcactccagcctgggcaacagttcaagactctgtctcaaaaaaaagaaaaangagaaagaaaagcagttcccctgagtctccttgttgacaggagggaaatccttccctattgtgggagggtgagagt

SEQ ID NO: 698497 - DNA, 884 bp, Homo sapiens
ggctttgaggcagtaccggagagaaagatggcggctaccttactagctgctcgggagccgggccagcaccggttgggggggccggagggtcactccagactgagaaagccgagaagttcccactgggaccaactatcatgggccgtgcagtttgacgcgggcgtgttctggggggcggactccagaacaaccactgggtcttaacatcgccaaatcgggtgactgacaaggctgacaccttatttcacgaccgcatttcctgctgtcgctcaggctcagctgctgaatacccaggcagaaagttgaattgcgtgtaccctaacagctcggtatccacagcaattgactggattgagcctcatgtgttccaccacagcaagcagcctctttcagggacgatgtgtaaccgataccggaagacctgatggcgggaaaatcatcatcgcagggcctggcgaccctcaagaaggagggcaggtgtactcagtgcctatggggggtctggatggtaagggcaggccttttgccattggacgttcggaagctctaaatctatggatatgtgggatggtaactaccggggagggcatgcccaaggacagagtggtctgcaattcaactgcaagtgttcctcggttttggcgccatggaagcgggaatggcctccagtggagaagtgatcccgctggataccatggagagtcggtggaagagggcagacttgggagacaaatacaattcgcgtgcattacaccgcggatctggatcagttggcaaaatgccgacgggcattatacgttcctgaacacagagacgctgcagggcgagacaaaaaatgtgcgcggcacataaacggcggagaatgacgcaggcgtgtcaaaagg

SEQ ID NO: 698498 - DNA, 290 bp, Homo sapiens
  misc_feature (44)..(44): n is a, c, g, or t
  misc_feature (197)..(197): n is a, c, g, or t
  misc_feature (238)..(238): n is a, c, g, or t
  misc_feature (257)..(257): n is a, c, g, or t
attaacaggcatgtgcccacccatgcccggcctaagttttgtanttttagtagagatggggtttcgccttgttggcccaggctgctctcctgacctcaggtgatctgcccacctcagcctcacaaagtgcctaggattacagatgtgagccactgcgcccagccaaaatttttcctcttttgaaaactgttaccaanacagactttttattaaactaatattgttttgtgtatttgtnaaatgttacggaatgaatnaattaaggtttgcatattacctgtaggtagttt

SEQ ID NO: 698499 - DNA, 245 bp, Homo sapiens
gttcacagctctcgacttatcttgtccaatctccctggttgggccccaggagtgcaggctgctgacagcacagctgtctgcagacagtgactgcccaaggtgaagatgtgtcagaagccccatggtactggccctgcacagtttcatagacatctacacaggtctctttactgtggggaacaagctgctggtcagcctggacttgctattgtgcaatccagacatcatatcaaggctcggagaga

SEQ ID NO: 698500 - DNA, 1560 bp, Homo sapiens
atcccgccccgacgccctgcgaccatggaggagggacctctgacgggcgggctgaccagccccgaggatgcgatggtgacggagctcttaagccccgaagggtccagatcgcttcggagaacatcggactgaagagcaccccgatgaagtacgaggaggacgagattaccacgatataacaaaagaagacgtacactagggacccggcggaaccccacagcgaaccccgtccctgcaacggcgatacaaccgccgacgcatggagacgcccgcactggcaaggagaccagagatcaacggacgaaagcatacgaccggcggaggacgacaagcagaccgagcgaggagcagccatccatcgggaggaagcttagcgcacggaggaagtcccgagaagacatacagacgacgacatgcgaaggaagcagtcagagcggcatcacgatgcaagggacacacagcaaacacgcaccacgaacaatgcaaacgatgacaacttatgcctgggtccatcacacgagaataaccccccgacagacaacaacggaaaaaaccccgaaacgagcctgataagacacccacatgagagaagcaccatgagaagatcccatgagaaacgagcaggaaaacatcacacacaacccaggcgaccagaatcacagcaagtaagcaatccccaccaagcatagagcaaagcatccaagagggaaacacgcacgagataggaaacacaaaacaataaacagaaacggatacaactacaggttcccaggcagaacacgcaaagcggcaaagcagtaaagcgcacggaaaacatccagagtccaatggcacaatcacgagaagaaaatccaccaggctgtcaccacacggaatacacacacaaacacggaatccgactagcagacagagacgttaaagcagaggcatagcacgataaccgttgcacaataatgacaattccatttcaaagcgacacgaaggaacgttatgccgacatccacacacaaaagtagcatataagaaagagacgacgaccacttataagcccacattcagagaatataacaatcaaaacaaacaagaaataattgagcaatgactccgcaactagtacaagaagacaaatcgacacaatagatatcaacaaaggtcaaacgcacccaaatacgaacaatatatcaacatcagcaaagagataagtaggacatgcggccacacacacacgaatcgatgacgagtgagcatacagaaatgacagaggaccgaagaggaaaaccagtcgctcgccagcaacgatggagagataacagacgacctcaaggctagccccaaagcaagaccagaaggacacagacacgaaccgaagataggaggagagacaccaaaaaggaggcgcaaatacagcacacagaactagcaaggaggtaaatcactcacgaacgcatgcgagacaccgaaacacagacctggagcgcataacaacaagagaaagaaagcgagggcaacatgacgacaagcgacaatacgccgacccgacgcacgacgcgaccgaccgca

SEQ ID NO: 698501 - DNA, 882 bp, Homo sapiens
  misc_feature (710)..(710): n is a, c, g, or t
tttcagttatctgtaacctaacagctatgttctgaatagagacatttggactgattcccagtccaagtgtatacctgcttaggtgtttgctgtgcgtcctgatgctgatcttcttcactaattcttgatacgagctagttacggttcatgaggatgaatagaacaatatatttatgaaccagtgatcgggcctcatagaaaacgaattaggaattaggaaatctgagagtgaagatgatgaccggggatgtgcgtatagagatacagagtatgacattatgatatgtgagagtgggtgactgaccaaaagatacttaatgtgagctcgaaaagtggaggaattaccgaaggtggagatcttgaataatatggtgtgaactataaccaagatagatgggttatgatatatatttgtgttaaatttttgcttgatgggacattattgtaaagatgctatatgtactccaactgaggagcttaaaagtgtctgtttatcgttatgttcggtaaaatgcagccagaacggagggaagaggcgctattagtgtcagcgatggatggattagggaggagaaaggaggaactgaggattgcgacatgatggggaagtatccgcatggggaaagtgtggggatagaaaaaggaaagttcatgataatggtagtgggagaggaacggtttgtagtggaaagctggtagtggagggaacngtttgggggtcggggtggggggtgtaatcgaggacagtatggccgagagcgtatagaagatagaattgacggaagcggcgtgagcgaggtgcgggcggaggttatagagagggcgccaatcgggacgggtgatttcgcgagcattgcggaggaagagcgaggaagtgaggat

SEQ ID NO: 698502 - DNA, 874 bp, Homo sapiens
ggcctcgggttcccgccggacccatggacgcgctctagaagagaaagaagaaggaggttccggctgtgccagaaacccttaagggaaaagcgaaggcctctcgcagagctgaagatcaagcggccgtgagaaagacagtttgcccacaaagatgctttcgaaaaggcaaggaggccagcttaatctatgacacaagcaagagcactatcgacaagggaatattaaggacagagggtaacagaacctgaaaactctcgaatggccgcacgcgattggcagagaaaagcctggcatcttcatagtggtaccctgcagaagcccccacttggcgttttgtcatgcagaatccagaggttatcatactggagctgagccctataaggtgtcgacacacggtgtatgcagctttccttccgcctgtcgtcaaatcattcaagtgggtaccgtttagtcgcaagtctctaaccacagggggtgtcagactcaacaggcttagaggacttgatagagccatatatcgccatgggggtactccccatctgaagtctagtaaatgaactaattctacaagcgtggttatggcgcaaatctaattagcaagcgaattgctttgacagataacgcgtggattgctcgatctcttggtaaatacggcatcatcgtgcatggaggatttgattcatgagatcctaccctgaatggaatacgcttcaaagaggcaaataacttctctgtggcccctccatttgtattatgcacgaggtggaatgaagggaaagaccacccattatgtagaaggtggagatgactggcaacagggaggaccagatcatacaggcttattagaagtattacactcaagttctatccactt

SEQ ID NO: 698503 - DNA, 257 bp, Homo sapiens
aagtcatctgtatttctttgccctttccacccttctagctaaacgcttcctgtgcatccatgctgtgtttctgcctctgacgggaggtggacttggcgtccggcctaaacttctgctaaatcttctcggcttttcaattctcttctttcctgaatttttattgagacagagtctcactctgttgttcaggcaggagtgcagtggtgcgatctcagctcactgtaacctccacctcccaggttcaagtgattgcctcc

SEQ ID NO: 698504 - DNA, 363 bp, Homo sapiens
  misc_feature (363)..(363): n is a, c, g, or t
agaaaagagcaactaaagccgggcgcggtggctcacttctgtaatcccagcgctttgggaagccgaggcgggactatcctggccaacatggtgaaaccccgtctctactaaaaatacaaaaattagctgggcatggtggcgcgcctgtagtcccagctactcgggaggctgaggcagaatcgcttgaacccgggaggtggaggttgcagtgagccgagatcgcaccactgcattccagcctgggcgacagagtaagaccccgtctcggattcattacacagatttaaagataacaatgttatccggtcaggagagtagttttgaagacttaactttcattaacgcagtgtatttgagttggcn

SEQ ID NO: 698505 - DNA, 309 bp, Homo sapiens
agcaccaaaaaactaaagcagtttttaaaccgatatttacgtggagaaaatcataaaatccactgcgtctgcatactgtgttatgttacagtgcagtttggtgtgctttactacacgggttggttacagggcttctgtgcattgtaaacataaacaggatggaagaggttggatgcgtgtgttcagattgtaggatctagtccggactggctgtgtatgttgtgacgttaaatgaaagaggaacccccctttgtatgatagtcatgcggtcttatgtatgataaacagttgaataatttgtaaaaaaag

SEQ ID NO: 698506 - DNA, 240 bp, Homo sapiens
  misc_feature (130)..(130): n is a, c, g, or t
  misc_feature (195)..(195): n is a, c, g, or t
ggatggtggagcgcatcgatgaggtgtcttcattgtcgaggaaggagatgcactggtcaccagacctggtccctgggaatcagtttatggagagagagagtctcgatttcggaggagatgacaaattagnaccgagcctggacccttccgtccaagctagcagcagcaatcctgggtggtgtggaccagatccanataaaccgggggctaaggtctttacctggggctcctgggaccaag

SEQ ID NO: 698507 - DNA, 1341 bp, Homo sapiens
agcggggagtgggagtgcgtggggagaggtcgtgggctgggaccgcgaaggggcgtggagcggggcgggccggctcggattcctggaaggctgagactccagtgacccctggcgtgagtgagaggcaactttccctgtctgggcttgagttggggagaggagcaggggcggcctttgtaagggacccagtcccttgctcccttgaccatcacctgtcacctaggggtcaactgtgcatacggtgatggtcctggaaagagccatgaacctaccatggaagcgagatgaaggcccgattcgacctttaacgagggacccttggaaggcccaaaggtacccggcatggcccctttggattggagcgacactgaggacacattcaatgcccacaaaatacccctgggagaggtacccagccgtttgggcacttcgcctttccgcccggggaacccaagtggtcagtaaagagggcctatcccttggtaacggataagcttacttggtcccacggcatccttgggccagacaaaagttcgaactaacattgaaagtcggggtctgcgtccatgggccttttaacacaccccccctgtgatcttccccagctctgaattgactagactactcgaagcgtgcttatggtgctgaccccctatacacatttaattcacaacgtaatctctaaccatttccaaaccaaacacacttgttaccaaatgtcccaccccaaaatcattaatttccccttgacaacagcgcctgtgaccaacaacacaatcttactacctcccaatcccaatcttctatgcgtcagtgaaaacccacttgccaccacaacctctagtctgcaatataacccacattccatcatgatgactacacgtaaagctgagagccacatacggccgacagccacggcacttggagtatcttgcaaccccatattaggaggcccaaaaggtggagaaaactcctagttggagcaagtattcacacgatacagcccagagatctccccacatagaccggaccgagtttcaaagcccccgttaatatagataccagaactcacttattggtcgcctgaaacttcaaccccttttgcaacaaattacaaattaattgccatatcatcagatcaacaacaagttcccacttataacaaaccaccacaatatgtctactgtcaacactacatcacatctttctgtgccgcctaaatagaattctactcgacaaacaagagataaaccacaccacacactatgatactagtagtataccaacacagaaattatttacccccattcaacttcttcttttaccacaaacccagataaa

SEQ ID NO: 698508 - DNA, 541 bp, Homo sapiens
acatggtgttgcagggcatgtctttcccctgttttggtttcatttttccctcattttaatggtttcttggggaggccatttctaatgtttgcattaaactctctgattccatgattttacttttttggtagttacgatggactgaataaagagttaagtgcacagaagaacctaggactgccaaggctagacaacatctaattacttttgaaccaatagctagttgttgttgttgtcatgttgacttgacttttcaagtatgtaatgtttcgagatgtcttactgacagtgtattaaatggcaaaatttggtgtccatttatttttactgtacacactgttcatgttgtgcggtacaaagtcgcagtccaataactgtcctgtttttatacttgtggaactgttatttgtcttgttaaatccctgatttatcaaggatttgatcctgtttttgtctaatactatgatgtaactgcacctgttttggtaaacctgaagatgctaaaaggaaactaaaacatttatttttaccacaaaaaaaa

SEQ ID NO: 698509 - DNA, 837 bp, Homo sapiens
  misc_feature (144)..(144): n is a, c, g, or t
  misc_feature (251)..(251): n is a, c, g, or t
  misc_feature (341)..(341): n is a, c, g, or t
  misc_feature (405)..(405): n is a, c, g, or t
  misc_feature (411)..(411): n is a, c, g, or t
taagtatggcttttcagaatggttgttgtcattattcttgcctttaaaattttaactcatcaaagtgaagattagaaataaattttagaaaatgtagaatagtatgattctgtccctgtaatagaatctcagtggagttttttngcaaaactaatatggatttcatctgattttattatttcttaaattttagattttatgagtaccatttatatgatggtacaagcattcactctttagtagcatttttngtttttcagacaagctgaagtggtttattaagattgggtaatatttaaatagcaaccttctctgccttttttttttaaatatagaatttnggaccatttggacttttaaaatgccgggcattctttaccaaccaagtaaacgggaagatctgtnactggntagaaccaggttgaggagacagtacggaattggtaacaacagtcattggatttataatcaaccatacaaatactatgtgtaatctataaaaatcataaagaacacttttgtcagaactccaaaaatgtggtatatacttccaggccataagaagtgaggacttaatttaatggactctgaggattacggtcatttatgtatgaaaacaaggcgggaactatattagcaggctcgggtttccagaggaccttcttcagtgtccctttttacatggcacctattaaggcattcttagcaacttcgcaactaacgatatgaacatgcggtggctgtggcgacaaataaccttggtaacaaaacacaaaaatttggcgcccacaaaataaagggcgcccagagaagcatcaaaagtcagggtacaacggg

SEQ ID NO: 698510 - DNA, 1107 bp, Homo sapiens
tgaaggcccacattgggggagagaccgtgatcatgaggtatagcgttcacgcgcttgacgtaccaggtcttttcccccaatattgggaactgacccaggggaaacagctgctcaaatgtggttataaagtgctatattgggtcggaaggaacctggggtcttgtctttcgtaaagatgggtaccgggccgttaaatagtgtggtctggctttgcccgggcaacgagtagacgcatgaacaaattgcactggaaaatgcattcctacgtttgccgcaacggtccaatagggtccatccgatttctgcggaaattcttttccatctttaccaaaggatgagagtgcctttgtcatgaatagttacactcaggtaactgcgcagggctaccacctggtcagtgggatggctcgagcttactattccaatagaagacttgttgaaccttcaggttggaacatagcaactcatatgtggaatgtcagttctatttcagcgtactattcttgtgcgagacggaatgctatggtaaccccattctggtggaataacgcccagtcaaagacacttagtctgaatcagcgtgtgtctatcccatccgaggggatcccgaccaagacgtccgacggaattcagcatgcactagcatcgggccaccagagtcgaaagggagactaccataggttggagaaagcgtacctgggtccgagcggcacatgcaccatcgtacacacccacttacctttccggccaggaccagggttggctttggagaactttgttccgaacacacttcatttcatcaatcgctaggaaacactctgcaaccatcaactatgagggagggccaacgaagctcatattcgtaagctggctgagtgcatccgctggtcgtacgagggccgggattgtcactcaggcttggcaacatcgctcggttggaacttaactagtgcgtccccatgggagtacagacaggtgacaggatatgcgatggcgtccagttcggagctgggatacaggtatcctgtagccgacacccctacaggagaagctctgggatctggggcagcaagcaaggcagcccatgccacacaccgtctctcgaga

SEQ ID NO: 698511 - DNA, 183 bp, Homo sapiens
cagcctgggcgacagagagactgtctaaaaaaaaacatacatacacacacacacacacacattatgtatctggacatgtggtatattatgatgggctactttaattacatatgttttcaaggtttatacatattgtaatgtgtaaggtacacaataccttttaatgaataatattgcattgta

SEQ ID NO: 698512 - DNA, 180 bp, Homo sapiens
tcaaaagtatcccaacataacctcaagaaagattcgtaagcataaaagcaatgtgcagcatgcagctcgcttttcgcctgatactgtggctaagtcactaaaccatactagggcggttaattttttggcgtatgccgaagcgactcttgagcagcaggagtctgagttcggcgcctattg

SEQ ID NO: 698513 - DNA, 448 bp, Homo sapiens
acacgtaacgcttcacgagcactggaccatacctttccctgcacctcatcttctttcaactgagacttaaacatatgacagatgagacgtccattgaaactagaacagccatggaattacacatagtggggaaacgggtcccacagagataaagtgcctggaaccatgatctccttattatcaatacccttttttcctctagacccaagatcttaaaatgagcaaattagaaacagacacaagcgggtctaactgtatttgatggctgagggaagagcaggcgaaaatcttaaaaaatactatctcctgattgcttatggcccactccctccaacccagtctgcaggtgggtcatagtccaaagaccctatttccaaccctgaggtcccactgcaggcagtactatggcctcacgggaaggaagatgtatccagaagaaggcgttacg

SEQ ID NO: 698514 - DNA, 193 bp, Homo sapiens
gatccccggcgtcatggggtctgtaggattgtggccagaggagaggaaaggtgcggcgctggaaaggtagcacggccaggggagaggagaggcacggcgctggcggggaagcaccggccagcccagcagagagcagaggcacaggcctatgggggctgcaaggagcctacagagcccatgcgcgcggctgccg

SEQ ID NO: 698515 - DNA, 1903 bp, Homo sapiens
  misc_feature (375)..(375): n is a, c, g, or t
gcaaagacgcgagcgtccatcacttagctagccaggacagagccgttcagcctcaacagccagttctatcgcacaaagtagaatgatataagtgcgagtagatacatccgcgaaccgtgggcagcaattgagatatacgatacgccggaaatgcgggaaagcatggaaagagattcatgaagcactagaagccagtacatttatcatggcatagggcagctaagccacgcgtcattaacgcgtgtaccttgccagtagaattgcaattgtcaagctcagaatacatcaaactatatgagcgcacagagacagcagcacaaaaagcgtagaagaacccccacagtacagaccttaggacggggagcctcacgcttntacacgaaacccagttcttaagacaagcatgcccacgaccttcggttcctttaattgtggagacgcacaagaagattccacgctcgtgcggcggacaagccattctttcattggaaagggttccactgccaacggtgcggtgaacggtataggactcccttaaaacgacggggaatacgcaccttaaggggtgaagcaatgcaatgccggtggggggattttaccggtcccaccttataaaagggcaatccatgcgaaaatccttctttcaagggtatagcgaaagagcgctattcgtccacacataatttctttgtggtctgccaccttaatcccaacgttaataaacccccgccctttccatttaaaaggtatttacagccgacccccgtttccttgggattttaatcaacgacttcattccttgtagaaggcggtatggcctatatcaaatgcctacgcccctgaggaagagatggcgaagtggggcaaacgaacgctgagaggacgggtgccgatactgctgcgggcggataaatccaaaccatcaaaaggttgtggattaaatcactgaacaaaaaacgccatttcttctcgcgcttttaacggtaaaggccaaacggcagacggttgccacagaaacaccaaccacgattggttattcgagaagatccgcaaatgtccgcacaaaaattcaaaaggggtcaaaaagagagggcatccttttggatagaaaagaaaggccagaagaaggagcaccaatcagccacaaaaaattgtatagaaggaggagaaaagacagaccggcagtggttattccacacaaaggggggcgtttctcaaaaaaaggcgacacacccaccgaaaacagattggagctgccctttaacacatagaagagcatgtgtcttccgcccaagagaaagctacaagattaaatttaacaaggctgttgggaaacaagcctttcgggcgtttgccaaaccaatagcggcgtcgaagattctcttgggggaaaccaccaagagagggtccataaatttccgaagccacacatttaaatttaaggcaaaaaaggaacaccgcgttaaaaacgtgagattcacaaggaatcaatgttaaatgggtttaacaacacacagttgggcaatacgacaaagccaacatttttgtcgctttagacaacatcatcagggtgtgacaagtattcaaaaggggcccccttgtgggcggagaaataccacacggcaaaccttcttgacagcagaaagacagcaaggcagttgaggaacaagccgtatcgcgacacccaacacagtgatgtacgaaacgaaagggtgccgccacacacactgattaaacatcgtttaggcgaaaacatccaccaaacgcgcaaaaaaccgaacaaaggcgcatcccacactatttattttttgaaagagccgcgggttctccacactatggtgggtcgaataaacacccccctatatagtgaaaccaaggagcactacaatcgatgccgttcgca

SEQ ID NO: 698516 - DNA, 1288 bp, Homo sapiens
cctctccctcaacaagggagagacctcatcaggatgaacccgaggacgcttcgtgaactgctgctacattaagttccgtttctcaatcaccacgcacgtccatgagacacgcccaaggactgcgagtatgttggactcttcaagtggcgtttttaagattgtatttccatggacatccatcttctagcttcagagcagagaccagaggtgcaacactaccattcgattatccaggcagggcattgggccagctatggcgcaacgattgcaccaacattaagccaagcattatatccatcaccatttggtggttcctgcatcattagcacggcacacatcagtggggcatcagtcaaggcagcaggcaacacagtcacagggctgccacaggttgtccccaccgaaaccctcccaggcaccttaacaccgagggcacagcacagcagttaccattcatgccacgatggtggcgcacaagcccagggccagggggtgttctatcatggtttcacaagcaacggcgaaaccattttccacgttcgcaacgtgttcacagaatcacaaagggggtccgtcacgtgtgtgggggagaaacaattttacacggttttgcgaggattttatcaatttgtccatttgttatccagtcgcagtcagagggggtatagtcaagtttcacctggttcacatttctagtatgagtagagagtagtgtataacgttagtataaacagagtttataccaagggggatttacccattggtttggccatcggaaaactgttgctttgtcaaaggggcttataagggtataaccacactaaggaggcatcaataattaacttaagtagggccccagtggcacttggggcaacatgttcatgtttcactaatgaagtagtttaaacaagaccgggttcaacaatatatttggcagccaacaaacatcaaaattaaagacacacaccaccagccaacacggcgcacaccgcgtggcccagcacacctatacaccaccgggcggcaacggacgcatgcatccaccaacaacacagacaggcaccgggggttctacactcacacacgcacagctcaacgaacacgcacaaactagacggacaatcgaccgatgcgcgaaccaaacgcggggccactaccaccagcgtgatgcgacgacacataaccaagacacaaacatctactcagacgcagacaagcacacaccaacggcatctcgtgctgacacaccacacacactacgggacacggggctcacaaacagtgacat

SEQ ID NO: 698517 - DNA, 1323 bp, Homo sapiens
gaacaatatgatatttgacttctggtcataagcatgactataggtaggtaatttaatcttcatatagttcgttttctcatttttagcattctaagattgaactagatcacattaaacagatgttgccccacatccctaaactgggaaaagaataaggttttatttataaaaaagttcaaaccatagacagaaaggcaattaaaccctggaatgcggaatccacaaatatcgcgtcttggttgctttaacactggagtaaaataaccttcttagaaacaaagaacacttaacttacagggaccattcttttgaacgcaatagggggacattgaccaagtggccagttccttagtccaattgtccacttttcttcccacaattttactggttttcaccttaatttctccattacagggaaaaggttggcacaacggttgcccttagaggcctctgcgcaccgaacacaaacgaacaggccacacgtttaggcgcttactgcttgggggtacacaacttagcacgaagcgttcaccgggtttctcaccaaagtacaggaaaaaccaaggattggccttgtcttaccaaaccccatgcacatagcaggggatcgcacgacgaatgcttaagcaattggccgctttgtggacttcaacccttacttacaaccctttttatcggaaccgcaccttcattgaccagggaaacggaacatacttaccaattttgccgctttgggccaacagattacccgcaagacacacagtgtaaagcacgaatcttccatctgtcccaaacaaaaagggtcggcaactattaccgaacatgggcaggagaaacactcttgtcaagaagcttcactttttaaacagaccagccctttaccgttagcaaccgtccttattggcttaaccaaacaaacaagtgtctgtgaaccccccttaaggaaggcaagcaagaccctcggcgacaaccggtgaaccagacccgcgacgcgcgagagaccgtttttcccccttgattacttagccgttccgaccaaagtcaagttaatgcaaaacgacgtgaccccacctcgccgcgctcttatcttgcaaagaagagtccttgctgtacaagtttatagttcgcacacgagcggccagccggcatcactggacatggcacatctgctgtcagcgtgcgcccacccccactggcctgtcacagcgtccttacacaccagcacacatttaatggccgtccgcaactgcggcacgagctgtcgctaacttcccccgaacacacgattcctccaagtgctaccggttacgaccacagctatat

SEQ ID NO: 698518 - DNA, 402 bp, Homo sapiens
ctcacctgatgaatggattaaattcaactgtgggctctccaaacagtggaatatgatttagccataaaaaggaacgaagcagctgggcgcagtggctcacgcctgtggtcccagcactttgggaggccgaggccagtggatcacgaggtcggaagatcgagaccgtcctggctaacacggtgaaaccctgactctaaaaaaattagcccaggcacgttggcacatgcctgcagacccagctacttgggaggctaacgcaggagaattgcttgaacctgggatgcggaggttgcaatgagccgagatcgttccactgcactccaagcctgggagatagagtgagactccgtctcaaaacaaaacaaaacaaaacaaaaaaaacgaagcaccaatacatactac

SEQ ID NO: 698519 - DNA, 122 bp, Homo sapiens
caagtagctgggattacaggcatgtaccaccacacctggctaatttttatatatttttatttgttattttttgagttggagttttgcactctagcctgggttaacagagtgagactctatca

SEQ ID NO: 698520 - DNA, 253 bp, Homo sapiens
  misc_feature (101)..(101): n is a, c, g, or t
  misc_feature (216)..(216): n is a, c, g, or t
aaaatgtcaggccagtaacaagacacagatgaactggggaggaagagagttttgacttctgcaactggttacaggggaaacggcgctggaagattatcacncagaccaactcaaagattggaagagttttcccggaagctaagtgtacctatctagagctatagtgtgtagtgtggaacgtgtgcgattcactctaacatacataatgtgattaanctgcttttaatactataagctaacgtcgtgagtcctg

SEQ ID NO: 698521 - DNA, 981 bp, Homo sapiens
ggccgccctttgtcgcttattctgtttttctaattattctgtccttttcttttctatctgtttgttctatttttgtactctttgcttgttctaattttctttccttgttgaggagccgcgaggcggaggtcgcggggggctgggggcgagccccaggtcggccccggagctcggggccccgcgccgttcggggaggcgggggctctccgctctgcgcggtcccctctgtcgacgcggctcgtggggctggctgcatgaggcctggcccgtccgggttgtgggctgcgagctctccccaggacgacttcacactgtaaggagccagaaggaggtggagagaagcctgtcttggagattttcctggggcaaatccctgacggtcagttgcatggagtgagagtgtaccgcggcgttgtatgtggctcagagtaaccacagtgctgtgcagtggctagagcaattccagccatggctggttcccaatggcgagctttatcggagaaacttttggacacctacatggatgacggatggtgagtggtggatagccaaacaaggagggaccagggccatcacagacaatgacatgcagagtatcggaccttcgtagtatacttacgaagtcaggtgtctccaccagctctagtatggagtatatgaccctgcgatgtcgagctggaaacgaactgaagaatcctgggctgaaccctgctgagcgaagatgaacgtggcaatatagactaccaacaaccgggccgacgttgtgcgccctaggcaagaaataggcccgaggttgcgtcacacccggcgacgagcgggagccaaaaccaataaccaccatggacgcaatgtgctaagggtcagcccagaacttctccatcgttgtagaacatcggcccactggacaatcgcaatgacaacaacaccaggggctgagcacacacgcacaagcacccagctgcgaccccagaacaaacaaca

SEQ ID NO: 698522 - DNA, 542 bp, Homo sapiens
cagccgctgatcaactgtattgaagcccagctggccgatgtgcgagctgatatgagcggcagaatcaggattaacagcagttcatggcctcaagtcgcggctgaagcaggagatctccacctaccgcagcctgcttgagggccagaaagatcactacaacaacctgtccgcctccaaggtcctctgaggcagcaggctaaggggcttctactgtcctttggagggtgtctcctgggtagggggatgggaaggaagggacccttaccccctgctcttcccctgatgtgccaataaaattttatggtccaaggggaaaaaaaaaaaaaaaaaaaaaatatatatatatatatatatatatatatatatatatatatatatatatatatatatgtgtgtgtgtgtgtgtgtgtgtgtgtatatatacgtgtgtgtgtatatatatatatatgaaaaacaatacatgctcgttgtagaaatgtggaaaacatggcgaactaatcagaaattcataaatatcacccgtgactttaccacccagaaaa

SEQ ID NO: 698523 - DNA, 260 bp, Homo sapiens
ctccgcctcccgggttcacgccattctcctgccttagcctcccaagtagctgggaccacaggcgcccgccaccacgcccggctaattttttgtatttttagtagagacggggtttcaccgagttagccgggatggtctcgatctcctgacctcgtgatccgcccgcctcggcctctcaaagtgctgggattacaggcgtgagccaccgcgcccggcccactactggtttttaacaggatgattcaaagtgcagtccgttc

SEQ ID NO: 698524 - DNA, 938 bp, Homo sapiens
  misc_feature (226)..(226): n is a, c, g, or t
  misc_feature (228)..(228): n is a, c, g, or t
  misc_feature (230)..(230): n is a, c, g, or t
  misc_feature (234)..(234): n is a, c, g, or t
  misc_feature (816)..(816): n is a, c, g, or t
  misc_feature (832)..(832): n is a, c, g, or t
  misc_feature (879)..(879): n is a, c, g, or t
ggcaggttcgcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccntngngggnagggatgagtgacttccttcaacactcttcttcagtgagacgggggctgggcaagcatgtgccccgggccaggcggttgtatgacattgggaaccagactagtcgatgagtggtaagttacgtcgatctggcgaggcgtactcgggctacgtgtcttcgctccgctgagcaactttatcgacagtgcaaagaagatgctgcctaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgccaactatatacttancgcgttattggcagantgtgtctccatcactgttcctgagattgatgggcctgatgtgcctgngattccgaccactgtgcctacccggtcattctcttggcatgcccgtttttgtggaagcc

SEQ ID NO: 698525 - DNA, 128 bp, Homo sapiens
caggagtgtggctgcaagagataaagggtctggaggaagatccggaggttcatgtgtgttccctctgctgagtattgatgcccttatcacctgtgcctttcacccctactgaaccccacttcagataa

SEQ ID NO: 698526 - DNA, 629 bp, Homo sapiens
aattgacctccggaaaactgctcctcctttgacgtgtacgtgttcccaaaatccatcctccattccacaacaagcccagcgtccaaccagtttggggttgttccccccctgcctccaagtttgcaaccacctaccaccctcccctgtgttccctgtgagacctgcccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 698527 - DNA, 1117 bp, Homo sapiens
  misc_feature (20)..(20): n is a, c, g, or t
  misc_feature (93)..(93): n is a, c, g, or t
  misc_feature (104)..(104): n is a, c, g, or t
  misc_feature (110)..(110): n is a, c, g, or t
  misc_feature (301)..(302): n is a, c, g, or t
gcatcatggctgcccccttncagcacgggcattcatgcgggcgggttgggtgtggcattcttgtttgccaggcagcagggtgcaggacagcanaggcagcaggnatactnattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 698528 - DNA, 197 bp, Homo sapiens
  misc_feature (5)..(5): n is a, c, g, or t
tgaanacctggcgatccccaagtcaataaatcctcacatatactttttttgtttttccaacttttccctctttgaaagataagatgtgtgcgccaacggaacctcttcctggcgggctgcgtctcattagtggctccccacttggaatacaagtgaatcaagttccccaatgtgtgcccgagtggaacctactcctg

SEQ ID NO: 698529 - DNA, 101 bp, Homo sapiens
tcaagcttctaacgatgtacggggacatgaatgctttgttacagacccaagctgtccatttctgtgatgggttttgaataaagtattccctgttttaaatg

SEQ ID NO: 698530 - DNA, 431 bp, Homo sapiens
cacacatattctccaggccagagcacatcttacacagacctcaaatctttattctggacacgtacacacagcctgtggcagacacaatttttatatacactgtgccaatcaccaagtgcgtctctcagcaaggtacacggacctttacacaacatatccaacttttcttgtgctatattttggatctacacgggcaacctctatattgcgtttggctcagacatcttcaacccccattacaggataccacttcccaagcacaagcgtcagagtctgaggtcgtgctgcgacacagtaagccacactttcagagagaataattcctggtggaacacagcatagcatgattgcgaccacaggatggctgaaatggaacttgggaagcgccacacccacatcttgttcctttcgggctatttctacagtgcgcg

SEQ ID NO: 698531 - DNA, 2472 bp, Homo sapiens
  misc_feature (1656)..(1657): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 698532 - DNA, 2591 bp, Homo sapiens
  misc_feature (1775)..(1776): n is a, c, g, or t
agctggttggttataacatggtagacacttagtcatcttctatagctgagatgttggcacaggaggacagatcacaggctataaagatgaataaggtgtctaccatgattattattctaagctggtggtaataaacagtacctgcctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 698533 - DNA, 247 bp, Homo sapiens
tctagaggatgccctcttctccttgacacatactacaaaagttaagtcaggtcaagagaggtggctcgacatcctataatcccagcacgtggggagggctggggcaggaggatcactggagcccaggagtacaagaccagcctcggcaaaaatagcaaaatagtgaggccttatctctacaaaagacaaaagttagctgaacatggtggcaacacatactgcagtcccagctacctagggggggagg

SEQ ID NO: 698534 - DNA, 1679 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 698535 - DNA, 200 bp, Homo sapiens
ctcacatttcctttctccctgtcatattttcttcactgattctcctgcatcctctttatatttttaagaactcctttgactatattgcccccctcaataatccaggataatctccccatttcaagatccttaatcacatctgcaatgtatcttttgccatataaggtaacatattcacaggttctagggggtggtatagt

SEQ ID NO: 698536 - DNA, 2511 bp, Homo sapiens
  misc_feature (1695)..(1696): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgtgaaaacaatctaaccagaaagctttaacgtctgtcagtttaaagctttctggttagattgttttcacttggtgatcatgtcttttccatgtgtacctgtaatatttttccatcatatctcaaagtaaagtcattaacatccaaaaaaaaaaaaataannaaaaaaaaaaaaaaaaaaaaacaaacaaaaaaaaaaaaaaaaagaaacaaaaaaaaaaaacaaaaaaacaaaaaaaaaaacaaaaaaaaagaaaagcaaaaaacaacagaacaaaaaaaggagaagagaggggggggcggggcccgctaaaacattcctccgcgccgggggcgggcgcaccaacaccgcccccgcacgccggctctgatggacaggagaggcgccgcccccatacgaatgatgagagacataatatcaaacacgaccaggcgggcgcggcgcatgccacaaaccacaaacaccgctggagaggaacaaaaccaaacaaggaggagtgacactctcagctggaacgacgaccaccacccactttgtgtggcgggacgccaaacacggcgacacaccacccccacaacaaaatacccagcggcgcggagaaacaacaaaccgcacggcgagctagaggatgcaacaacaccaacacgttatctgtgcggagcgacagaaaatagcgacaagaggagacgagagaaaaaaaataatcgacgggcggcttgatgaaataaaccacgcgcagcgacagccagagcaacgacacgagaacgcccacgaccacagcccacgcccacccaccccaacgccacggaacaccgaaacgagaagaagcagacagacaccgcagcaccaccagaaccgaacaccgccgacacgacagcagcagagtacacccgccacacgaacaagcacgccaacgcagaacgaccgacagacaccaccgagcacggaacgaccggcaccacaagcaggagacaacc

SEQ ID NO: 698537 - DNA, 1710 bp, Homo sapiens
  misc_feature (1680)..(1680): n is a, c, g, or t
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatgnaaaaatataaaaactggagactagttctcc

SEQ ID NO: 698538 - DNA, 1679 bp, Homo sapiens
ggtaccgcgaacggtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccggggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctcccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctactccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgttttaaatg

SEQ ID NO: 698539 - DNA, 458 bp, Homo sapiens
ttttacctgttttagagtttcccacgtctgcggcgcggggtgttccctggactgcacctgctctgaagaggcgctgtgaactctgcatgctttctgacggcctggccagcacgaggtatcctcatgcgcagcccggagtccagccgtggccagtgtgggtgagaaccttgtcatgggcatcctatgatcagacaggtgggtcgcattttcatgctcctctcctctctgtggcagctggatgaaggacagatgtcttcctgaaatgcctcctggccccagtcatccctcgtggtgtatcctgcaggcccaggataggaaagaaagaaccagagctctcttaatctgctcccaggctgacttcagttcaccacaaggtctctgattgctggctcagtgccaggcctgtgctgggtgccagggactcagatatgagtcagactgaccaggcccccacgttc

SEQ ID NO: 698540 - DNA, 241 bp, Homo sapiens
gagtggctggggctacaggcacacagcaccatgcccagctagtttcggtatttttactacagatggagtttagccatgttgcccgggcttgcattcttattttgaagtaagtctttgaaatccagtgtgtattttagacttaatagcacatctcatttaggactaagccacatttccaatgctcagtagccaaaaggggatattagctaccatattagacaatgcatctctaaggggtgag

SEQ ID NO: 698541 - DNA, 723 bp, Homo sapiens
gcgtagagccgcgcgggaagcggccaggagtaccgcgcgggaagtcgggacgaggagtcgctactggcgtgcgctatctgctagctctggtctcaagttctgactcatcatctatttcatcgtgtattgcgacctgatgtgtctggcctgagttgtggtcctgtgggtcatgtatgcggaggtttgatgcggcagattagtatcaggacccttgtataagtgcctttgctgggtgccattccatggattctagatcctcctggtcgtcctcctgtgcatggtctcgttcatggtgcttgtcgttgagtggtgtgtgcggtgagaaccttgctgatgattaattccagtaatttatgtaaatatttgtgatcattgctcgatcatgtggctcattgtgtgagcgtgagtgggtgttgatggttgcggaagcaagtatccagttggacctatgatgatagataaccatgtacgagggagggaattgaagaaatactatgatagatcagtatgtatgaataataggatctatggactttgttcaggaactataggtccaagtgctaggggcgaggtgagtgaagtaggaagattggtagccgaagaatcggtgacaagaattgttatgacgcatggaagtgtggctggaggggtggcctgatgggtgggtgcataaggtaacaggataaagatgtgacgacatgtgtggctacagatgtgattaaa

SEQ ID NO: 698542 - DNA, 1055 bp, Homo sapiens
cttggtcgcttccctgcgccaaagtgagcagtagccaagcatgatcagtggctggcgagtcatattacaaaaccgagggcgatgaagaagcagagtgaagaacaagaacgagaaccttgcaagcaagctggcagaactataaatattcacggcacagacgatagctttgactttttatctgcgtctgatgccatccaaggacatatgattatgacatcatcacgagcatgaacgactgacgcttgaacaccattattgaacactgcagcaataccaagattggtaataccaacaacgatgctagctacaatcaagggtcacagaatccagtaacagccaggttgaactccgaggaaatcctcctttgagacctgcctgagaattggcttcccgttacattgagcattaaccccggaagggaaaataaggaaccgaagacaaacttctccaagactgaagaacttataataaaaagcagacctaagttatgtaaccggcttcattataaacaaagggggaaggcgccttggcgccaaccttaaaacttccgccaacgtcgaattggaccaaagaaaagcctagcaaaacatttccccttacggaaaggccctttgttggaagccccgaacggcattctgataacaaacgtggccgtgcccaaaggacaaaagggagggtgataaacctcgatacacaacgacagaaccgggcattgcgacgaccaccccagaagggcaaacccaacctttgcacattggggacgaccccccccaagccgggaagcggaactttcccctttggcaaacccatttaaacaccaattcccgaaaccggtttcgccaagcgcgcttgggcaaaaagcgcatttgtccacttgggaggaatggcagctgcatattcccttttgtgcttagggagcgccaacaacagcccccattttcccattactagccacacgacagattagggcaaacctatggacgcattaccccccaaaagaaacagtctgtaatcccatacaacgcggcgaaacattgggaaaagaggaatttccg

SEQ ID NO: 698543 - DNA, 298 bp, Homo sapiens
cgaggatgagttgctacctacgggcagtcttatgccatcgtagactggactgtgctcgcttgctgagcctggctgggcagtgcgtgtggactgcatgctgaccacctcgcgtcttcagatgactcgcccgccggtgaccacgactacgctctgccggtgggaaagcagaagcaggacctgctggaagaggacgactcgtgcgggcggagtctgtctccatgtggacaaggagtcaggtgtcggtggagttctgctcggcgtgcgcccggaaggcgtcgtcttctcttaaaatgtaggg

SEQ ID NO: 698544 - DNA, 1319 bp, Homo sapiens
gactagttctaatcacctgtgggctccacctgcctgcacctttagtcagcacctttagccagcacctgcgccagaccccagcaatggcgaaccatgcgcccttcgaaacggatatcagcaccctgacccgcttcgtcatggagcagggcaggaaggctcagggcacgggggagttgacccagctgctgaattcgctctgcaccgcgatcaaagccatctcgtctgcggtgcgccaggcgggcatcgcacagctctatggtatcgctggctcaaccaatgtgactggggatcaagtaagaagctggacatactttccaatgacctggtgatcaatatgctgaagtcgtcctacgctacctgtgttcttgtgtctgaagaaaacacaaatgccatcataatcgaacctgagaagaggggcaaatatgttgtctgtttcgatccccttgatggctcatccaacattgactgccttgtgtccatcggaaccatttttggcatttacagaaagaaaagtactgatgagccttctgagaaggatgctctgcagcccggccgggacctggtggcagccgggtatgcgctctatggcagtgccaccatgttggtccttgccatggattgtggtgtcaactgcttcatgctggacccgtccattggagaattcattatggtggacagggacgtgaagatgaagaagaaaggtaacatctacagccttaatgagggttatgccaaggatttgaccctgccatcaatgagtatctccagaggaaaaagttccctccggatggttcagccccctatggtgcccggtatgtggggtccatggtggctgatattcaccgcactctggtatatggagggatctttttataccccgccaacaagaaaagcccaagtggaaagctgcggctgctgtatgagtgcaaccccatagcttatgtcatggagaaggccggtgggctcgccaccacgggggacaaagatatattagacatcgttcccaccgagatccaccagaaggcaccagtcgtcatggggtcctctgaagatgtgcaggagttcctggagatctacaggaagcacaaagccaagtgaaggccggccttgcccctgccccagagcagagctcaagtgacgctactccattctgcatgttgtacattcctagaaacaaacctaacagcgtggatagtttcacagcttaatgctttgcaatgctcaaggtcacttcatcctcatgctataatgccactgtatcaggtaatatatattttgagtaggtgaaggagaaataaacacatctttcctttataaat

SEQ ID NO: 698545 - DNA, 340 bp, Homo sapiens
cctcacttcgcaaaccaaacgtcaacggaactgcgtttatgaaatacagctggatcgcacttgtcttactgctttgtgcctgcacgagcggccccaaccaccaggagcaactggtagagaagcgcttatgggaatatcagttgctcactcacctcaaccacttcaagtcctaccctgaagacgctcgcctgcaaaggctgaccggcatggtcagagtggcctttgtcgtcgacgccaaaggcaacctgatacgccacaaaatcgtcagccacacaggctcggatctttcgtcggggcagtgggtcgacgcggccggaatttagtagtagtaggcggccgc

SEQ ID NO: 698546 - DNA, 592 bp, Homo sapiens
  misc_feature (91)..(91): n is a, c, g, or t
  misc_feature (104)..(104): n is a, c, g, or t
  misc_feature (128)..(128): n is a, c, g, or t
  misc_feature (201)..(201): n is a, c, g, or t
  misc_feature (361)..(361): n is a, c, g, or t
  misc_feature (377)..(377): n is a, c, g, or t
  misc_feature (423)..(423): n is a, c, g, or t
  misc_feature (440)..(440): n is a, c, g, or t
  misc_feature (479)..(479): n is a, c, g, or t
  misc_feature (558)..(558): n is a, c, g, or t
  misc_feature (579)..(579): n is a, c, g, or t
aatttcgcggccgcgttcgaacaacggctgcgagaaagacgacaaaaaggggcttttcttcgccaaggcgtccttcgttggaaattgacantcgtcttttaaanccctgcgttggcaaatcccttgancgcaaccgcccgttgaatgccccaagggaaagaacagggcgaacctggaaattccaactaacttccttaaagnatcatccaactaattggatgattatccgaaaatgtttcattgtgggaagcagaacaatgtgggctccaagcagatgcagcagattccgcatgttccctttcgcgggaaaggctgtggtgctgatgggcaagaacaccatgatgcgcaaggccatcccganggcactggaaaacaanccagctctggagaaactgctgcttcaatccgggggaaatgtgggcnttgtgttcaccaaggangacttcactgagatcagggacatgttgctgggccataangtgccaactgctgcccgtgctggtgccattgccccatgtgaagtcaatgtgccagcccagatggtcttcggggcccgangaacttccttttttccaggcnttaagtattccct

SEQ ID NO: 698547 - DNA, 248 bp, Homo sapiens
gcaggattccacacgtaacgcattcacccactcccaggtaacaaaagccttcactacatctcaagttgggggacaaaaaacgggggaagggagtgtgcacgaaggctcatcattcaaaataaaacacaatacaaaagtattaaggcgaagattaaaacaattttgcattacataatttacacgaaagcaatgctatcacctcccctgtgtgaacttgggagaggactgggccattctccttagaggaa

SEQ ID NO: 698548 - DNA, 160 bp, Homo sapiens
  misc_feature (71)..(71): n is a, c, g, or t
ccaaggtgggaggatcacttgaggtcaggagtttcagactggcctgggcaacgtaaaaaattaaaaaaatngccaggcatggacatggtagtgcatacctgtggtgttagccactcaagaggctgagacaggatgattgcttgagcccaggaggatgagg

SEQ ID NO: 698549 - DNA, 492 bp, Homo sapiens
gtacactttcatctttcaatgtgagaatcagagtggttggtattctatagtagtcattttacccaagtttactacttaaaattagcccaggaagatcagttgagcctcagaggtcatggctgcagtgagctatgattgtgccactgcactccagtctgggtgacagagtgagaccttatctaaaacataataataaaagtagcctctaggccacatgcagtgtctcatacctgtaatcctagctctttgggaggttgaggtggtggattgtttgaggccaggagtttgagaccagtctgggcaatatagcaataccccatctctacaaaaaataaatttgctgggcatggtggtgtgcacctgtagtcccagaaacttgggaggctgagatgggggagatcacttgagtctaggagtttgaggctgcagtgagctctgattgtgccactacactccagccagggtgacagagtgagacccaatctccactaa

SEQ ID NO: 698550 - DNA, 829 bp, Homo sapiens
gggaaaaggtcccgcgagagctgagcagtgcaagatgtgtgacttcacactgataaaccagaccgcagtagattcaacggagagccttccacgctgtttgaccgagaccagggtgatggacaagaatcctgttaacagaccaagtgtgggagactgtgactgaagggccctgtggtccaagaatccactagccaaacgctcgatgatgctcatatggctcctggggaaaccctcgaagagtgatagacgcattgaacttcgtgaacacggttagctgggacatttgcagtcacgtgtatccctgaccacaattggctgtccagcaacatggttgggctcaaagtaaacaggaaggcatcgccagggtccatcccttaattgacgtgcacttgacattggttcggcataggggaagctgtccgagtggtggtatttggctcgcacagggaaaacgcgtaaaactttgggtcaacactgttaccatttgtgagttgacttgtgaaacattcccggggcactttgttttcgtgatggttcagactaccttgcaggttggacgcaacagacttgagccacgcagtgacaacggaacacgctcagtaggaaattgcctgggttgggcgcaagggggccgcccttgtaagggaaaccaaggcagaatgaggggtaggtaacttcgagacggtaattgcaaacgaaggccgtccggtcccagaaacttggacttgactgtacaaacttgggccaatggtagcagaacccatctacaccctagtggttcatccaccgcgtgaacaaggtttcaagaatgtgacccttattcccccat

SEQ ID NO: 698551 - DNA, 260 bp, Homo sapiens
  misc_feature (66)..(66): n is a, c, g, or t
cgctctcgaggtcgtcctggttggcaaggatggatacaacaggattgagtatgagccgggcacgcnggtatgggccgtcttttccatatatccacctggagacatgtgacggagccagtcgtctcagtacaaggcaacagtggagctaggaaaccagccacataagggataaggctgcgacccgagacaacctactcaaagaagtccctccaccggctctgttgtgcggctcggcactgcgagctgctgcaatcccgagt

SEQ ID NO: 698552 - DNA, 309 bp, Homo sapiens
  misc_feature (1)..(1): n is a, c, g, or t
ngataaatccaatccaacaactataggctgggaaataaaaggtcattccttatatttaagggaaatcccttctaaaaaaaccccctaatcagaactgtgatgctctaattagaaacaactcattgggccaactatttgctgctcaaagtttcttatttcttaaatgaaaaaaactcatcagttatattcatgtgatcgcggctaaaaagccagtaccttttgttcaaatgtggcttcatttgaaatttctcagattttccatgggactaattatgaatacccaattataaattaaaaactcttaaagag

SEQ ID NO: 698553 - DNA, 308 bp, Homo sapiens
  misc_feature (3)..(3): n is a, c, g, or t
  misc_feature (63)..(63): n is a, c, g, or t
  misc_feature (139)..(139): n is a, c, g, or t
  misc_feature (142)..(142): n is a, c, g, or t
  misc_feature (145)..(145): n is a, c, g, or t
  misc_feature (147)..(147): n is a, c, g, or t
  misc_feature (162)..(162): n is a, c, g, or t
  misc_feature (164)..(164): n is a, c, g, or t
  misc_feature (167)..(167): n is a, c, g, or t
  misc_feature (169)..(169): n is a, c, g, or t
  misc_feature (185)..(185): n is a, c, g, or t
  misc_feature (189)..(189): n is a, c, g, or t
  misc_feature (194)..(194): n is a, c, g, or t
  misc_feature (197)..(197): n is a, c, g, or t
  misc_feature (207)..(207): n is a, c, g, or t
  misc_feature (209)..(209): n is a, c, g, or t
  misc_feature (216)..(216): n is a, c, g, or t
  misc_feature (220)..(220): n is a, c, g, or t
  misc_feature (233)..(235): n is a, c, g, or t
  misc_feature (237)..(237): n is a, c, g, or t
  misc_feature (308)..(308): n is a, c, g, or t
agnaaccagatgtaacctaacccaacagcatctgaattggcagaggttcagtgggctggagtnttgtgctcctcccccacaccaagtttttataatacgaaatgccacaagaaaaagaacttcggtactgtttcctcancanatnanaaaaactgaacctantnatnanaacaaccacacaacanaatnaaaanctncactaactantncagaatntaantaaagaagaagcnnntntgaataactcgttttttctagagcccttataaataaaatcccccagtcagtgtttgcattatcagctagan

SEQ ID NO: 698554 - DNA, 122 bp, Homo sapiens
cggcacgaggacagagtctggccctgtcacccaggctgcagtctcagaaataaataaataaataaataaaaagacaatgagtattgtgttctgggagggtcacaagaataaaaataatgata

SEQ ID NO: 698555 - DNA, 315 bp, Homo sapiens
cgggagaacttgggggcctgggaacaagagcttgtttctaccaatgtgtctaaatcccaaaaccaacctgcaaccaagtctcaacttttaaaaatcggattttgaccaacaaagcaacatcttaagatgtacaagcataagtggtttaccatacactaaacatagctttaattgctggctactgctgtactgctcagatccaactccaagaacaaaaatgaaaactacccaaataatgcaagtggtagtactgtctttaggtttcacaggtattcttctgtacttatctacaaagtcaaaaagtataaacaccta

SEQ ID NO: 698556 - DNA, 107 bp, Homo sapiens
gtataaggttccccagcttagtaaggcaaggtttttatgcattttttagcctctagtgcaaccacctgttgtttgtacagtattttcaaattgtaggtttccaaacc

SEQ ID NO: 698557 - DNA, 112 bp, Homo sapiens
  misc_feature (93)..(93): n is a, c, g, or t
ggtcccccagctggaaaacaggtgggtcatactggagacagccaagagctgagtatataaaggagagggaatgtgcaggaacagaggcgtctncctgggatggggctatcaa

SEQ ID NO: 698558 - DNA, 332 bp, Homo sapiens
tcggcacccttcaacatctcatttcttcttcttgagtacaacagattcttcatcagtgccaacgtgaagtcccactctgattcaacttggcaggagacttagatagactcaaagcagatttaaaactgaagttagatcctgttgttgactcatcaaagcggaaaagattttttctcacagggctacttgccaatggagaagcatgtactgagctactactgacactatcatccaaagcatcttcccttaggtcatagttatcccattctaatgtgggcccagtgttttcagcattgggttttattgttgtgtctgaggcaccggcccacatt

SEQ ID NO: 698559 - DNA, 383 bp, Homo sapiens
aggtgcagacaggaagtagaatacattggtgagtataaagaggggggcagacataggaagccctcatgagtgcagggccgccacttgtccagagtggccacgactggggatattcttgaccccacaggcatcagggatgagccgcttttcagccaccatgtcttcaaattcatcagcatagaacttggtgaagccccactactttgagatgtggatcttctggcgggcaggaaacttgaacttgggcctgggccagggcctcaatcacatagctccttgttctgcagcttggtgcggatggacatgataacttggcccaaatgtgaaccctggccacagtgccctggggctttccaaaggcacctcgcatgcctgtttggagg

SEQ ID NO: 698560 - DNA, 188 bp, Homo sapiens
cttttccccggggcaaaaaaaaaaaaaaaaaaccaaaagggagataaatcccctctgtgagtttgttttattggcccctttttccccacctgtcttccaagtattatttttcctgttaaaaaattttttaaaaatgtgaaatgtaatgtttttccacccccaatatgaaatattttttttaaggaata

SEQ ID NO: 698561 - DNA, 185 bp, Homo sapiens
gagcctggacaggctttccagatggctgcggcggtcggtcggtgaggctttcccggctgtggtttggctgcgggcggattgggtcgtccgcggttttctcaggtagaagaagaaaggtgccacttttttttgaagacagactcgcttagtcgccagccacttaagctgagtgcattgtgatttcc

SEQ ID NO: 698562 - DNA, 398 bp, Homo sapiens
tcgagactcactttgcctgccgtgatatggtcacttgtggagtcagtggagttcctatcattttggcactgatgctgttttctcttgtctgcatttgaaacagtcactggtaataatatggttgttgaaaatgtgatcacctttatctaaagtgggagaagatacatacacagtatggcaaatggataaaatcattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatcgttaaaatctaaaggatagaatgcttacctataacagaacatta

SEQ ID NO: 698563 - DNA, 215 bp, Homo sapiens
ttgatctagagtatcccgaagcgcaggatgggttcagaggatccgtgggtatggagttggggtcgaaggccaggggatgtggttgcgatagtggtccagccactcacgccccgaagcaggtgtcatagggcgagatggggtgtggttggtgctcggcacgggtgctgtgcttggacttggggatctcacgaggctgtcgacgtcaggtaacggtc

SEQ ID NO: 698564 - DNA, 356 bp, Homo sapiens
  misc_feature (98)..(98): n is a, c, g, or t
  misc_feature (100)..(100): n is a, c, g, or t
acagataaatgaaagattaagagaattcgttactagccagaaacacctttaatagaaataataaaggaaattcttggctgcatgttgtggcttacgcncntgtatcccaacactttggaggctgaggcgggcagatcacggaggtcaggagttcaagaccagcctggccaacatggtgaaaccccgtctctacctaaaatacaaaaattagctgagcatggtgccacacgcctgtaatcccagctactcaggaggctgaggcaggagaattgcttgaacccgggaggcggagattgccgtgagccgagatcgcgccactgtgctccagcctgggcaacagagcaagacttcatctc

SEQ ID NO: 698565 - DNA, 214 bp, Homo sapiens
caactcctatactagcacgaaaacgggatcaaacaaacaccataggaaatcactcccatatccgataaaatcaccttccaccctatactacacaatcaaagacgccctcggatatacttctcttccttctctccttcatgacattaacactattctcacaagaactcctaggagaaccagacaattataccctagccaaacccttaaacacccc

SEQ ID NO: 698566 - DNA, 384 bp, Homo sapiens
aaaagaaaaaagatggatgcatgatcacacatgacacgtccagctccatgtcacatgtcactccccagcctcagacctatcctttgcatcctctctccacccttcttctgaccccttgtcctgcttggctccctgctaatgtgcccatgcctcgccttctcttcctacctccccctcctgccccatccccctgttccttgtctctcctgagtctgggagttggaactacccaggtcacagcaaggcttgtaggaagaagagtaccatggggatcccaggaggctaaggcccagccaagctctgtgctttggacatggagactagcggttgtctttctgggtttgcaaactttgtgaaatgagcatcgtctgctctgtatccttc

SEQ ID NO: 698567 - DNA, 182 bp, Homo sapiens
gggacgtatctgatcgtatgattcgggtggcatgtggttaacatctggactgggacgtgattcctacgggcgtagtacggcgtccggtttcgtgcacgactaggacgtggagtggagctagggctgcggtcatgcaggggactcatgaagtagatcgagtaggagtcgtgtgagcggtggga

SEQ ID NO: 698568 - DNA, 125 bp, Homo sapiens
gtaatcccagctacttgggaggttgaggtaggagaattgctttagccccggaggcagaagttgcagttagtcgagatctcgccacttaacttcagcctgggtgagaacaaaactctgtctcaaaa

SEQ ID NO: 698569 - DNA, 440 bp, Homo sapiens
  misc_feature (5)..(5): n is a, c, g, or t
  misc_feature (27)..(27): n is a, c, g, or t
  misc_feature (73)..(73): n is a, c, g, or t
aaatnggcaacgaagaaggcctgctgnaaggggctaccctggcccaggaaaagaatttgccaaaacggcaagnaagcaacttaccgcccaatgaaaggtcctcccaagcggaaactgcgctgccctacctgaaagctgcggaactggcaagtggtggcggctcttcacccaaggtgcgtgctaagaagggcctcctgagtagctgggactacgggtgcacaccaccatacatacctggctaattgtttgtatattttgtagaggtgtggtctcaccatgtcgcccaggttggtcacaaactcttgggctccagcaatcctcctacctcagcctcccaaagtgctggaattacaggcatgagccactgtgcccggccctttttgatttttagtagagacaaggtctcactatcttgcccaggctgaccttcctggccttta

SEQ ID NO: 698570 - DNA, 245 bp, Homo sapiens
acatcccttgaatacttttgaaatgaaaaaatagccataaattccaaaatgcccctagggcgagaaacacttcttccgtgagtatcctcagcagtcccaaataccctcagccaagctgcccagacttgttttcctttcctcacagtgatgacccagtccttgggagttcttcaagttctgggaattgttaagcaccatgtgaccatcaccatgtttcagaccagtgaggatgtcgagaaagggag

SEQ ID NO: 698571 - DNA, 282 bp, Homo sapiens
tcctgttccatctgtctctagtggtgtttacccgctagtggcactacacattcatcctaattgcagacggtgcaatgcaccgccgacttggcgtgatggacggcacacctatactctgcctttttactgctagactacaattgcgggtgtgcactttaaccttagactccggcaagttgccaccgtgcttgtgtgccatgttctttatccaccccgattatagcgcatcgttactgcctgactgggctaacctgtacgcttcatcaaaaagttgtgtcatca

SEQ ID NO: 698572 - DNA, 349 bp, Homo sapiens
tattctgtggaccctgaatgtgtgatatatagccaaacaactggtttgttttgtttcattttgagacagggtctcgctttgtcgccgagattggagtgcagtagtgcgaacacagctcaccacagccttgacttcctgtgctcaaatgattctcctgcctcatcccctcatcctgtgtaactgggatcacaggaggatgccaccatgcctagctaatttttttgattttttggtagagacacgatttcactttgttgcccgggccggtctcgaatttctgggctcatgcaatcctgccttggcctcccaaggtgctgggattacaggcatgagtcactgtgcctgacca

SEQ ID NO: 698573 - DNA, 1793 bp, Homo sapiens
  misc_feature (804)..(804): n is a, c, g, or t
  misc_feature (1068)..(1068): n is a, c, g, or t
  misc_feature (1350)..(1350): n is a, c, g, or t
ttgtgtgatggtgcctgagtttgcagtggtgtgtgttatgcgcgttgtgtctaatgcgtaaaggtggggttgctgcgatacactgcggatcgggtgttgctcactgtgttgtggtgttcgtaacgctcgtgtgtgggctttcgcctcgcctgggggggcgctggtgtgtttgtgtaacgtgcggttgcgtttgcgtcgggcaaattgtggtcgttatcgtttttaaccgtttcgtttggctaggtatgtcgccgcgccctgttcgtttatgacttaccaggcagctactgtgattttttttgtctgcctcgcgtggttatcaaacaattatcaacgtgagtatgtttaaaataggaagaggggtttttaaaaaaaaattacaaaagggggcgtctcggcgcgctcgattttttttgctcgccccccccccttggtgttgtcccacccgatagcttatcactctctgtttgtgtcttttctcccgccgcctttttttgggggctcccctcgtcctgtgtgcccccgccgtgcgaaacaagacacatggttgttgacgtcgtcgtctccgccgcgtggtgttgtcatcctgtgtagcccgtgttggacccaacaatggggttggtgcgcatcaaaatctgccacgactgttggtgtccgctttgatattatgggagaacgcccctctgtttattgacatatgggcggtctccccaacacacgagcggggggttttcaccacgaccgtggtggttgtcttgtgtgacgagtctgtgtgtggggcggcccgacgcgttggtaagatgngtgtgggagcctccctcgtctcctcccgtcttgtaataggagtgcgtcgcggcgtgggcaactgtattacaccccacgcgcctcagtgtttgcgtctgtgtgtgaggagtcgccctccttctcttgtgggggcccgtctcttttaaaacagggtttatgtgttaaatttgcgtcccctcctcccgctggttgtcccttctatcacggcagtgctccccccacaccggggggttcttcttttgtagcttccttcccccatcatcncctcctgcgtccgctcttgtatgaagaagattcttctctcgtgttttgtggagcgcgagcacacaccctcgtgtggtgcgcacgatgtagtccccctccatccctctctctcgtgggcgcacgatgaataacacacgcgctattatagggcgctttcgcggccaccgcgtctcacaaatgggcgcgatatcttctctctcatttatgtgtcccacactgtggagtgcccacactatacactctgtgtcccctcacctgcgcgtaccacacacgtgtatcacnccctctcggggagttatacacaccgctgcgcctcacttctcgctcatcttttctgtagaggatggcccacacattggcacaccacacataagggggtgttaccgagccctcgcgcagattttgtgagatccacggagacactcccccgcgattggggccacccccccttcttataaaggcttctgctcttgtgttccaccgcgtttaaagtgcctcacacgctgatttctgaggttctcacgccccgcgtggtaatcccgcgtctgggtttcttaatttaccttcacaattctccttcccctgttatcgacaatggaccacacaaggaaaatatatgcgcccatccttctcccacagccgcccttctccccctacaaatgagatattcatttctccacttatgtatatataccccccccccccccagaacacgggttttttta

SEQ ID NO: 698574 - DNA, 390 bp, Homo sapiens
gtgcaaacaattaatttccctcgggggccccggggaaaaaagttccttgggattgccccccccccttcccaaaaaccccaaataatgaactccttccttgaaaatttgctagtcccatggaaacaagtggggggggaactaaaccctctttcctcaggtgagggcaacttttgcagggggcccccgcctttttaaattataagtaaaaaaaaaaagtcctttttttcagggttgaacaagttgggttttgctcaggcctgggcaagcccccaatttttttctttaaccccgggccctttttaaatccaaagggttttcaaaggtgtttttaaatgtgaattaagttaaattaaattttaatctaaagtaaaaaaatagttctggaaatta

SEQ ID NO: 698575 - DNA, 797 bp, Homo sapiens
cttgcacctcaataggatgtgtttgcaccccacgccctctaaaaaacacatgtgatgcttgttagaaaccaaccacacaccacacaaccagccgtcttgttattacaaaacaaccaatgggcgtaccacttcctctttagtgaaatttcctcaacatacaaattattcctctgctatgaaggttttcatatgattgacagtccacgctccctcttttgtttttcataaaaaataccacacgccttcctctcaatggtggtgttttccaaacccaagaaaacccccagcctttattggattccgaccacctcgctttgagtaagaaatccccctctttttgttcccaacaaacttctgtttgatccaaataaagcccgaagttccccctctcgtccctattcctctctcgctaaggaaaatcaatactcactccctctgttctatcagccctagtccctccccccctctacgttccaatattgcacccctacccaaggaaccaaatcttttgtatgtgcgagggcgggtgatcaatacaaaaaaaagacaaccacgatattcttttgattatttatgcccgcaataatgcgagaatctccctccttcccatcaccctcctccacccacaatctcttttacgtcgggttcgctcctcctcccccctccttcctatcctcctcccctcccgagtgaattttcatcgtcagacagtgaggatccaccctccagagagaagaacaatacaagagatcgctccctctcccttgtggtcacaaaacaagaataaatagaactca

SEQ ID NO: 698576 - DNA, 329 bp, Homo sapiens
tttttttgaaaaacccccccctttaggttaacccacccgctcaaaggggttttaaaaggttttttttttccgccccatggatgtaaaataatatgttattacaccttcccaccctgaaacacccccggttgggggggtttgttttttgttttggtcaccagggtctaaaggagcttttaaaacccacaatttcttcttttaaaaatttttttaatgggggggggataaaaaaattccgcttaattcccccacctttttttggggggggaaaattttttccccaaatttggaagggggggttttccccccaaaaaaatggattccgggga

SEQ ID NO: 698577 - DNA, 120 bp, Homo sapiens
acaactccaggaatttgaactcggcaagccaccacagcttggatagccgtgtagccgattacctctctagatcgtcctctctgggcaggcatctctgaaaaaaggcagcagttccagtca

SEQ ID NO: 698578 - DNA, 594 bp, Homo sapiens
  misc_feature (522)..(522): n is a, c, g, or t
tgagctcggtaccgaatccggctctctgggaggctgaggtaggtggacattcaagcccaggagtttgagaccaacctgggcaacatggtgatatcctatctctacaaaaagatagaaaaattagctgggcgtggctgaggtgtgaggattgcttgggcctgggaagtgaaggctgcagtgagctgagagcatgccactgcactccagcctaggtgacccagtgagaccttgtctcaaaaaaaaaaaaaaaaatggtacggtataaagcaagtgtagttgccagaatatcgtcctattctctggatctatagagaaatttttataaacatttatactgggggtaaacttctctaacatagaaaatggtcacaaacacactttatggtagtttaaatggagtccataagaaagaggctgtgctgaagagtcagggaacgggcttagggaaaactcaaaaatgttgagttcagagttgactggtgatggagatatggacaatgatttagggaagagaagaactgntcttacagctgaggaatagcatgaggagagactgtaattgggatttagctggaccagaaagccggagggatc

SEQ ID NO: 698579 - DNA, 774 bp, Homo sapiens
  misc_feature (536)..(536): n is a, c, g, or t
ctttaccaaggtccaaagaaagatgcccataggagatcacacccttgcccccgttgatccccgctgaataacaagtctactccagatctaacctggtgtgccacgacatttgtgcgattgtagcactcttgattgttatatatttacctcaagttcttgaatggacgcacgaaaagagggactcctctctccactccgtgctataggtctctatgttatgtgctagttttacttctatttctctgtgtccagtcagccacagggtccggctccctgcaggaatacggggtacaacgtaaggtgttgtgtggcaagaaagcaactgactgatgaggggtaagatggaaccaggtatagccactccgggcagttgtcacccattcagaacttctttccgcagctgacagaaatgttcaggtatacctgtatgacgcttgttcatgcagagcctgtaggaagtggggctaaagtggcattcagtgatcctgtgctgtagacttttctttcttttcttaagccagaatcctcaggatgtncccgaatagctagccactggtatttagtggtggtttaataatatgatcgaaagtaacgatgcgagaagaaataacgcgaagaggaacccagatgcctgttatcttcagttttagaaatagcactttgagtaatttctgcgtaatccataaggaacttttgatgccggcaggaactgtgttagaactctggctgaacatttcatctcctgtgagtcagaagggctttatttctcccctg

SEQ ID NO: 698580 - DNA, 244 bp, Homo sapiens
tttttttttttgggggggggggggggccccaacagggggtttttttttgatttttgtttttgggggttttttggaagaattttacccagaaggggggtgtttggttttgggttcccttccgcccccgggggtttcccctttaaccccggggtttgtggcttggggtgggattttgggccccccctttttggttcccctctttttggtacccggggaatttttggggttttcccctttttagaga

SEQ ID NO: 698581 - DNA, 780 bp, Homo sapiens
  misc_feature (8)..(8): n is a, c, g, or t
  misc_feature (85)..(85): n is a, c, g, or t
  misc_feature (109)..(109): n is a, c, g, or t
  misc_feature (112)..(113): n is a, c, g, or t
  misc_feature (116)..(116): n is a, c, g, or t
  misc_feature (119)..(119): n is a, c, g, or t
  misc_feature (142)..(142): n is a, c, g, or t
  misc_feature (148)..(148): n is a, c, g, or t
  misc_feature (200)..(200): n is a, c, g, or t
  misc_feature (202)..(202): n is a, c, g, or t
  misc_feature (217)..(217): n is a, c, g, or t
  misc_feature (248)..(248): n is a, c, g, or t
  misc_feature (267)..(267): n is a, c, g, or t
  misc_feature (278)..(278): n is a, c, g, or t
  misc_feature (281)..(282): n is a, c, g, or t
  misc_feature (312)..(312): n is a, c, g, or t
  misc_feature (329)..(329): n is a, c, g, or t
  misc_feature (340)..(340): n is a, c, g, or t
  misc_feature (353)..(353): n is a, c, g, or t
  misc_feature (367)..(368): n is a, c, g, or t
  misc_feature (385)..(387): n is a, c, g, or t
  misc_feature (399)..(401): n is a, c, g, or t
  misc_feature (412)..(412): n is a, c, g, or t
  misc_feature (434)..(434): n is a, c, g, or t
  misc_feature (453)..(455): n is a, c, g, or t
  misc_feature (459)..(460): n is a, c, g, or t
  misc_feature (475)..(475): n is a, c, g, or t
  misc_feature (481)..(481): n is a, c, g, or t
  misc_feature (502)..(502): n is a, c, g, or t
  misc_feature (510)..(510): n is a, c, g, or t
  misc_feature (532)..(532): n is a, c, g, or t
  misc_feature (536)..(537): n is a, c, g, or t
  misc_feature (557)..(557): n is a, c, g, or t
  misc_feature (682)..(682): n is a, c, g, or t
gagggagnggctctttcacaactttacaaattatagaaaaatgatttttcctcttctttacagaaatgtcactcccaaatcggancgggccctattatggctaaaaccnggnnggnagnagggagcagagaatacagcaagnagggcnccggctctctgggtggcaagaaggcttttcctacacattaaagcccaggctnantctcaaagacctgtnacccctctgaaggaggctccatccacatggntctgtggcacactggggcnggcctctgtcntgnnggccagttggccacagaagacctgaaagcntggcactcgtggttgcnggccacagtcnaggcagctttgtnagactgagaacagnnggcgagcctatagctcnnntccctttctctnnnacagccagganagaggctgtggacactggccanacagtgcactaggtttagnnntttnnccttttactcagcanagactnttttgttaaacagctattaanaattaatnagaaaacaaacatttggttccntttnngctgttatcagcagttggtnatttttggttaaagagcagttttctcatcttgagttgctcattaagtctgttttttttatcaggcccctgactcctttctttctcatccatggttttttggggaggggggcaagtacagctatangagaaggctgtttgttgatttgagaaaactgttaaaatgttttgcactcacatacaaaggctgatggaattcaaaaatgatcccactgatttttatga

SEQ ID NO: 698582 - DNA, 1045 bp, Homo sapiens
ggacctcccagccccgggccgggcttcccacacagtgccgtgacccgccctactgctgccctgaccctgcacctctcgcaccctgacagccccccaaatgcttggagccacacatcccacccctgaggagcccatgtgatactggatgtgatgctggatgcaattactgccctgacaccttacaagcaactgccgcatcaatgctgggcttcactgcagtggtgattgtgggcctggccatgggcaagctctacgtgcaacgacttcagccagacgaccatttccctgcttcgaggccctacaacctgagcttcaagaacatgtgcaaactcaagcccctcctggagaagtggctcaacgatgcagagactatgtctagtggactcacagccttgcccagccccaaccagctgagcagccccagcctgggtttcgacggcctgcccgtgccggagacgcacgacgaggaccagcatcgagacaaacgtccgcttcgccttacagcaacgagttcttctagcgaaccagaagcctacctcagaggagatcctgctgatcgccgagcacgctgcacctgcccacggaagtcgatccgcgtctaggtctgcaaccggcgccagacggacaaccccctccaccctgcagaggcggcccatgcagccaggccacggaagccggccagctacagccccatatgcgccaccccaaggagcgatgcgtgcgaccttaccgagttcccaagactcacaccagtcttgaccacaccgtacctaccgtatctctcagctcgtggtcatgctctaccagcagcacactcatgaggtataattcagtgtgctgtctcctcaccacatgctctacacgccgacctggcgagctacaggacccaaccgaccgcgggaagccgcaaggatgataccgcccgcgtcacgactcggtatagctccgctcatacctgccccgtcatctcacaccacgcgatttaccccttgggcctccgcgtcagcatcgcgcctcaccctgtttggtaccctgagcaccaccg

SEQ ID NO: 698583 - DNA, 215 bp, Homo sapiens
gtgatctagaggatcccgttaggggtggggtagaaaactaccagttaggaaactatatctgttccctttatttatttagacggaatctcattctgtcgcccaggctggagtgcagtggcgccatctcagctcactgaagcctccaccgcccgggttcaagtgattctcctgcctcagcctccggagtagttaggactacaggcatgcaccacctg

SEQ ID NO: 698584 - DNA, 209 bp, Homo sapiens
tgccgcgttctagaggatccctcaagtacttaagcaataaagggtattataggttcacataactgaaaagtccaggggatattctagcttcaggcacggttggatccagggcacaaacgctgtcatcaggattcaagtctctccatattgtggctctgctttcccctgcactggcttcattctctacatggtaggccctgttactttga

SEQ ID NO: 698585 - DNA, 209 bp, Homo sapiens
  misc_feature (5)..(5): n is a, c, g, or t
  misc_feature (150)..(150): n is a, c, g, or t
ggtcnaccacgcgtccgcggacgcgtgggtgggtgtgtggtacatgtgtgtacatatatgtataatatatatctccagtatatattatatatatctatatcatatttctgtggagggttgccatggcaatcaactgcagtacatatgtanttctttccatcaccctaacctctcctgcgcattcacacaagagtttcttgtaagccatc

SEQ ID NO: 698586 - DNA, 329 bp, Homo sapiens
gtgcaggaaatgctgggctgaggtggggaggccaggctgggaggccatcactagtggcaggcctcgggccagagctctgagcctggggtcctccagagcttaggtgcctatgagaagaggcagccgggaagcagagcagtgggcagctgtgcagccatgggggcctgttgggtctgcgaaggaggaaggggcgtgaggaagcagggccacgttgggagcagggtgaggcctggatggtgctgggaccaggtgatgaggggtgttgggacctcagcgggactgcttggggtgtcgtcggattggaggtgccagggggcatgtgggaagtg

SEQ ID NO: 698587 - DNA, 528 bp, Homo sapiens
gtccgtgctggtggaggggttcctttatgctctgacactcaccttctagaagcctgcattttgaattggtttttctgtctactgcagaatatggacagatctattttccaagcctctgaatatctcaaaacatctttagttgtctacacattcaagagtaatttgatagatataaaattcttggaaccaactgttcgctcaaaatcctgtaaaaggtacagcactaccttcaagaatgtagtgttacaggctgggtgcagtggctcactcctgtaatcccagcactttgggaggctgaggcaggtggatcacctgaggtcaggagtttgggactagcctgggcaacatggtgaaaccccgtctctgctagaaatgcaaaacttagtcgggtgtggtggtgcatgcccgtagtcacagctactccggaggctgaggtgggaggatcgcttggacctgagaggcagaggctgcagcgagctgaggtctcaccactgcactccagctgggtgacagagcgagactgtctca

SEQ ID NO: 698588 - DNA, 160 bp, Homo sapiens
gatggctcacgggaacatagtcaccctcatatgtggaacagtttggatataagctcctaagtgcaatagtcatctcccggtggtttgaaccgaggtgtccatcttccatcctatactgtcttctttctctcagggatttcttgtagcctctggtctccat

SEQ ID NO: 698589 - DNA, 432 bp, Homo sapiens
  misc_feature (292)..(292): n is a, c, g, or t
  misc_feature (305)..(305): n is a, c, g, or t
ttgtgggggttaggaggaagacagataataagttcctttcccaataaattctcactttgggaggatgaggcaggtggatcgcttgagcccaggagattgatactagcttgggtaacacaatgataccccatctctgcaaaaaataaaaaattagctgggcatggtgatgcacacctatagtcccagctactcgggaggctaaggcaggcggatcacttgaacacagacgttgaggctgcagtgagccatgccactgcactccagccttggtgatacaaccatactctgtctnaaaaacaaaacanaacaaaacaaaagaacaacaacaaaaaaacaacactctcaacttaggtgttagcttaacagaacttgtttggtggttatagttcaaattgtgaattattcctcaattgcttcatcaaatatcctctg

SEQ ID NO: 698590 - DNA, 920 bp, Homo sapiens
  misc_feature (1)..(1): n is a, c, g, or t
nacccgcctccagcaaaacagaagtagaaaaaagaaggaaggaggggaaatacacactcccaccgtcccgaggtacaccgttccttggccaaacacatgcgaagcacattcggaagacaggtgacaaacaaaggggtccgcccaaagattgtttcccgcgcccaatgcgcccgcccctctcgaagggatacggcccccgcgccggaaaaggtacccgctgtaaaagggtgactactccggagtagggtaacaaagagcttttaacagcgaaccgtcttcaagacccgcacggcgcttggtaattgtcccccaccgaccggaggcaatttttttcttgtaggcgagatatctatttccctccaagtggtgccgcccccgcgtcccccgcggagaggaaaaaatatatttgctttgtatggctgctcgccgatacaacagacaaaatctcccaagaggccgttgagtgtcttgtacgaaacaaacatcttggaaagccacaggcgagcaacaaacacaccgggggaaataggttgagataacttcgacgcaagcacccagagctattttgagttcgccgtcttcaaaataacaagatatggggtggggccccgcccccctgccgaggcattagtggcgtctcctaatgggggccacgcatcggcactttctataccgggtcttacaagccccactccccaatctaggttagaagtttctggcggacccatctattaatgatgcagaaagtctcagcaactattgccgattacatgatggccacacacacaagaaccataaatgtgctccccgggcgaggcaaaacaagggctggccccccttgttgtaactagccacaacaaacaaggtttcaccaaaccccaaggtcacaccccaaaaaacaccttccacaaccccacatc

SEQ ID NO: 698591 - DNA, 141 bp, Homo sapiens
catactgtatcctgtatcaatcaatacaatttatgatacttctccattttccagatcatgggtggcgctggacaagatcaaaaactcttcataggaaagaacatccttatgaaccatgaaattcaagcttgtattatttga

SEQ ID NO: 698592 - DNA, 326 bp, Homo sapiens
  misc_feature (11)..(11): n is a, c, g, or t
  misc_feature (50)..(50): n is a, c, g, or t
  misc_feature (170)..(170): n is a, c, g, or t
  misc_feature (181)..(181): n is a, c, g, or t
  misc_feature (258)..(258): n is a, c, g, or t
  misc_feature (294)..(294): n is a, c, g, or t
aaaaattaganacaggatgatcagatgttgccgcagttgcatttgtgggnacctacaaaaaagaagccaggagtggaagacagatttgtgtacacccatattcatagcagcattattcacaagagccaaaatgtggaagcaacccaagggttcgtggacagatgaatganaaagcacactncagttccttcatacaatggaagactattcagccttcaaaaggcaggcacttctggccggtgcggtggctcacgcctntaatcgcagcgtcttgggaagaccgaggttggcggntcaccttgaggtcagggaatttcaagaccagc

SEQ ID NO: 698593 - DNA, 188 bp, Homo sapiens
ctggggatttagcgaggtgatgcctgttgggggccagatgccctcctaatttggggggtatgtggctagctggcagtggtttataaggctcacataaaatcctgccgaagaaaaaaacttctgagcctaataaagtaggattatcccgctatcgaaggcctcttttgccagtaatactcccacgtatg

SEQ ID NO: 698594 - DNA, 786 bp, Homo sapiens
atagtcattatgatgcttttaacctgtacttgcatttcaaagcgtatcaagatataaatggagattctaaagtagaaatagatatgtattccatgtgttgtccaaagtactcacttgtctactgtgtgtttcacagacagttgaatatattaaagttagttccatattttctgtttcagagacaaattttggtcaatggaagactgttcttaaaatcaccttttgtcccgaatccaatttttagagtggctagtagtttcttcattgagaagtttgtaagcactccggtcagtaagaatgcccactccaagttttgctgactagtgttcatcagtcaaagccttgaaagcatgctagcaaatgctcgtttgtttgtgtaggtatttgtcgcatagcatgcagttgactccttatctaagtttttcatgggagacttccttcatcacatcttatgtgtgaaatcactttctgtaggtcaaagtatagccaagaagccaattttatcggtgccacagctaaatgtgtaaagctactggtgagtgaccacaaccattatacatgctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaacttttttgtgctaaaaatactttttaaaatcaattttgttgattgtagtaatttctatttgcactgtgcctttcaaa

SEQ ID NO: 698595 - DNA, 266 bp, Homo sapiens
tatttccacaggacctcactgttgacatctttgccagctgcatggccttgacgtacatggcactagcatacgtgctatactctattcggtgctgatcgcgtttccgctgggccccatacgagtgatttcgactcctgggacacagctcaacccacctcctggtttccaccctccttagcgctctgctctttgtaactcttcttggaatgcgctttgaactccatcctctcctctgttcactagcttgcttccatgtgtttcagagt

SEQ ID NO: 698596 - DNA, 398 bp, Homo sapiens
  misc_feature (8)..(10): n is a, c, g, or t
  misc_feature (95)..(95): n is a, c, g, or t
  misc_feature (150)..(150): n is a, c, g, or t
  misc_feature (167)..(167): n is a, c, g, or t
  misc_feature (178)..(178): n is a, c, g, or t
  misc_feature (181)..(181): n is a, c, g, or t
  misc_feature (192)..(193): n is a, c, g, or t
  misc_feature (195)..(195): n is a, c, g, or t
  misc_feature (203)..(203): n is a, c, g, or t
  misc_feature (214)..(214): n is a, c, g, or t
  misc_feature (220)..(220): n is a, c, g, or t
  misc_feature (248)..(248): n is a, c, g, or t
  misc_feature (253)..(253): n is a, c, g, or t
  misc_feature (256)..(256): n is a, c, g, or t
  misc_feature (259)..(259): n is a, c, g, or t
  misc_feature (274)..(276): n is a, c, g, or t
  misc_feature (280)..(280): n is a, c, g, or t
  misc_feature (321)..(321): n is a, c, g, or t
  misc_feature (352)..(352): n is a, c, g, or t
  misc_feature (364)..(364): n is a, c, g, or t
  misc_feature (377)..(377): n is a, c, g, or t
tggatccnnngggctgcaggaattcggcacgaggcggcccggcccagcggcctccacatgggccatggagccttcctgcagcacgtggtgctggncggcctgacgccctcctctgcattctcagcattatgctgctgccggagaccaagngcaagctcctgccccgnaggtgcctccnggnacggggagctnntnctcgccgngccttccctgntgcggnagccaccccctacccgctgtgaccacgncccgntgnttnccacccccaaccctnnncctntgagcgggctttgagtaccctggggggaggctggcccacanagaaaggtggcaagaagatcgggaagacttnagtaggggaggnaggggctgcccanaagtctcagaggcacctcacg

SEQ ID NO: 698597 - DNA, 181 bp, Homo sapiens
ggtatctagaggatccctctatctatcagggacagctagctaaggtgaggtagaacagagaggaaaaggggggtcgaagtatagataagataggaaaagaaagacaagaaagggacgtgaacggataaaagaaaagagaaacaaaaaagggaagaaaaagattttaagttcagtagtcagg

SEQ ID NO: 698598 - DNA, 563 bp, Homo sapiens
  misc_feature (67)..(67): n is a, c, g, or t
  misc_feature (126)..(126): n is a, c, g, or t
  misc_feature (171)..(171): n is a, c, g, or t
  misc_feature (370)..(370): n is a, c, g, or t
  misc_feature (429)..(429): n is a, c, g, or t
  misc_feature (486)..(486): n is a, c, g, or t
  misc_feature (546)..(546): n is a, c, g, or t
  misc_feature (561)..(561): n is a, c, g, or t
acgaactctcgctctgtcaccagtctggagtgcagtggtgcaatctcggctcactgcaacctctgcntcctgggttcaagtgattctcctgcctcagcctcccaagtagcagggactacaggcgcncgccaccacgcccagctaatttttgtgttttttgtagagacggantttcaccgtgttggccaggaaggtctcgatctcttgacctcgtgatccgcccacctcggcctcccaaagtgctgggattacaggcgtgacaactggcgcccggcctgaaggacaaattttcaagtgtgttcccaatttctttctttcttagggagagaaggcagaaatgggaagacaacacaaaacacaaagacgtttntatttaagcaggcgttttcattggaagcattggatgtggtttcagttagggcttcagantctcaaaaagggaaggataatttcagtgagaagtttggagaacacatttatttcctngtacaagggcacaccaaaaaaatttttattcaattactggaacatttaattttctttaantggggaatccttttntt

SEQ ID NO: 698599 - DNA, 121 bp, Homo sapiens
tactatatgactgacagagtagatgatactcttagttttgaaattcgaggataacgtttctggatttaattcatttggcaactggatgtccattgaaggttttagagcaaggggaggaacg

SEQ ID NO: 698600 - DNA, 419 bp, Homo sapiens
  misc_feature (103)..(103): n is a, c, g, or t
  misc_feature (207)..(207): n is a, c, g, or t
  misc_feature (272)..(272): n is a, c, g, or t
ctgcggagtgcatgtctactgaactgctgacatgtactgctgacctgagaaagcagccagactgagcagcagttgacaggacattcaagcgtgtgctggtccngtcactgagctcatcaggctgctgagccatgaagggaacagaatgtgtagacccagaggacccacagtcattgctgagaatgagctcctgggagctgcagccgncattgaggctgcagccaaaaagctagatcagctgaagccccgggccaaacccaaggaggcagatnagtccttcaactttgaggagcagatactagaagctgccaagtccattgcagcagccaccagtgcactggtaaaggctgcgtcggctggccagagagaactagtgggccaagggaaggtgggtgccattccagccattgcactccggg

SEQ ID NO: 698601 - DNA, 216 bp, Homo sapiens
gcgttgcgtcgcttggacgcgatcgcgatgtgatttgtattgatgaatgcgtaatgcatcctgaccaggtcgttgtacgcggggaagaaggccctgacaggtctggtcggaggcgttacggtgaccagttgcagcttgccgagcagcacccctgtcgccgtgagcgtggggtcggtcgcggacttgggggcgtaatgctcggcgctcaaacggaat

SEQ ID NO: 698602 - DNA, 134 bp, Homo sapiens
caagtgtgatatgtcagagtatctaatgaggaatattccaatgctatgcgtatcaacaattgttccctagtcagttagacgtaagagagaaaagggattttctgacaatccccctcaaacaaaaattaacccac

SEQ ID NO: 698603 - DNA, 426 bp, Homo sapiens
tctaagatgcagacaccctgttgggggctcctgacgtcgctctcacttgttccagaataatcaccttatcgcttttaagattggccaggagaatgagcagaatccggtttctcactgttccccgtacaactggcatgatacaggactatcgtgacaggacacggtaatttggtttcgcgggatctttaccgccccgtgatgcagtacggactgagactggtgcgggactacatatactccatgaggctgtagacatgccattgtataaagcgcagtacaaacttgcaatgtctaaagcagggttgactagcactaaaccatatctggtgtaagcatttaggacggataaatacgctcgttagttcgtctgttgatactatcggtatgactcgatcagtctctgttggcactggcgcagattttgcc

SEQ ID NO: 698604 - DNA, 128 bp, Homo sapiens
gttgaaagacagagaagcgaagacagagacgtggaaaggcagggagagagacacggagagagacgcagaaggacaaaaacgtgagagagacgcagagagacaagagacgttggagagcaccaaagaga

SEQ ID NO: 698605 - DNA, 596 bp, Homo sapiens
gatgtggccaagtgtggtggctcacacctgtaatcccagcatttgggaggctgaggcgggaggatcacctaagtgtaggagttgagggtccagtgagctaagatcatgccactgcactcatgcctgggcaacagagcaagactctcttaattaaaaaaaaaaaaaaaaagctgggccacaggggtttatgcctgtaatcccagcacttggggaggccaaggcgggcagatcacctgaggtcaggagtttcgggacaagcctggccaacatgggcaaaccccggtatgtactggtactaaaattttaaaaatattagccaggcgtgattgggtgcgggctggtagtcccagctactggggaggctggagtcacgagaatagctggaacccatgaggcggaggttgtggtgagccctaaatttaccagccatgggcattccagcctgggacggacagaagcaagaactcttaatctcaaaaagaaagaaagaaattcccaaatatgttgggggagcagtggttggggggcacagaatttgggggcggagaagttacagtggttgaaaaaatttcgagcattggggggggaacacagtg

SEQ ID NO: 698606 - DNA, 326 bp, Homo sapiens
  misc_feature (139)..(139): n is a, c, g, or t
atccctttatgccaacccccggcctggtggggaacccccgtaatcccaacttatggggaccctgaggaaggaagatggcttgaaccctggaattcaaggctgcagagagctctgattggaccactacactctagcctgngcaacagggcaggacccatctcaaaaaaaaggaggaagaagcataaaaagaagtaagcaggccaggcacggtggctcacgcctgtaatcccagtactctgggaggccaaggcgggtggatcgcttgaggtcaggagttcgagaccagcctggccaacatggcgaaacgctgtctttactaaaaatac

SEQ ID NO: 698607 - DNA, 82 bp, Homo sapiens
cactctacatcgactctgctgctcatgggaagaacagaattgctcctgcatgcaataattcaataaaactgtcttgtgagct

SEQ ID NO: 698608 - DNA, 256 bp, Homo sapiens
gggtctccagtggcccaaaaagaagcgggggggtcccgacaattttgagaagcaccaaatccaaggtaccggggggaggggctcggggcggcacgggacaaaggagggcgcgggaaaaggggcgtggggcttcgccaaacgggggacaaagagactcgcgggaatagcgccccccccggcggtggaaccggcccgggaaccccggggcggccacagggaggccgaacacggagaggggggaggccatccaagaggg

SEQ ID NO: 698609 - DNA, 273 bp, Homo sapiens
tgagtgcagacacgagacaccttcaactccatcatgaagtgtgactgtggacatccgccaagacctgtacgccaacacggtgcttgtcggtgcggcaccaccatgtatccgggcattgctagactggatgcagaaggagatcacctgccctggcgcccagcaacatgaagatcaagatcatcgcacccccagagcgcaagtactcggtgtggatcggtggctccatcctggcctcactgtccacctaccagcagatgtagattaacaggcagg

SEQ ID NO: 698610 - DNA, 177 bp, Homo sapiens
  misc_feature (75)..(75): n is a, c, g, or t
  misc_feature (100)..(100): n is a, c, g, or t
  misc_feature (114)..(114): n is a, c, g, or t
  misc_feature (154)..(154): n is a, c, g, or t
aaaacaaggcaggagaaaaggaataaaggaacaaaaaggatgagactttttttttttaaaaggcaaacctaaatntagtcacatggatacttatattaantgttaacactccantgaaaaggcagattgtcagactatataagaaaagcaaggnccaagtaatgctctctaccaaag

SEQ ID NO: 698611 - DNA, 311 bp, Homo sapiens
gtatccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatcctccatggtgctgagg

SEQ ID NO: 698612 - DNA, 614 bp, Homo sapiens
taagtctgtggcctatagggtactgtgtcgactctactaagcctttaatggggtcgtgcattggttatgtcttactctttgtttacccaggtttgttacattgctaggcttctagttagttccactttcgaattattgtcgctctaaaagtctcttaccaatgttttgaaacttggacacataataaatgtactgaaatatgcataggcatatctccagctacaatatggcccttagaaactgatagcgatcgtgtggatcagccatgtgagcatgaatggagcagagagccttgggtgaaatggcttgccacttgccatgtgggcataatggccactagggaaagtaagttgcactcagtgtatagtatcttcactatataaaaggaggccttgctcgcatttcaagtttgcataagtaccctgtgtactgtgagacaatatgtgtggagacctactgtacagtagtgtttgcccctcttcaatctggggcacattcatcttaaatcttatagtatttatccacccctaaccccagactgagatactgctcccaggggcctaggtagctgccagtccgtgattttaattattaactccttgagggttaacaag

SEQ ID NO: 698613 - DNA, 120 bp, Homo sapiens
gagaagctcatcaagcgccacgcaggcatttgcacaagctctgcagcaacctggccatgcagcaggttctctgccctggcataaggctgacttacattgcgagttactggcagtgctcag

SEQ ID NO: 698614 - DNA, 595 bp, Homo sapiens
agtggcctcatcggcgggtggctccctggcagcccaggggcaggtgaagtttctggaccctcaaacccccggaactggcctctcccctacttctccaggtatggcggtctccccccttcacagccagttttccccaaaaagtcacctctacggtccatctggtctcccgccccccacgggctcctcagcctgggggcagacttcctctctccatacccaaatggaaactggctcccaccagggtcaccggcggcctccagggccttcctccccagggatgctgggccagcactcctggctgacctcagcgggcattgggtttcttggctccttcttccgtgaaaggctcctccccaaagctttaggacaacacttacgggttttcccctcctttctcagatgggcacctatttcaacccggccgccccagcctcccaaataggggacctttgcagggcggtgtcttcagcctccttcccctcggtgcctcaccattcccaagccaccatcacactccacactcaccgtctcctttcctgacccagatggggacatgtaacaggccctgcccagtgtgcatccctccagaaatccg

SEQ ID NO: 698615 - DNA, 650 bp, Homo sapiens
tcataaaggttggaaggggtcttccccacccacttgtagactttcggcccccccactggggggggaccaccaaaaagaacccccccccgtgtttaaaatttttgagaggggttgtgggagagacacacacagagagttctctggggagacacttctttggtggggcccacacagtggtgtatataagagaagagacacacatgtccccccccacaacctgtgcgcacggggcccccacaggagaagaagcctttttaaaagcgccctgagaggtctcttcggagaaggtgtggagaggaagcgccaaaccccccctgcggtggccccactggtcggggccggtccacccccgagaggcccggccaccaacgcccgtattttcggagatcccttttttttttttttaaatttttataactttggtgtttcaccttcaatgctctgaatactgaataaccactgagatgacctgaatagtttagtccacgaatttttaccacgaggaatacactctaatttttatcacttaatttggggtttgaaaaatttttttttacaccttctaatttctttatttctcacaagcagataatttttctgtgtgaaaaagttttctttttttaatttaaggtttaaaattccttttccca

SEQ ID NO: 698616 - DNA, 254 bp, Homo sapiens
tacgtaaaaaggggccattaatcatgcctaccacaaatgtatatcatttaactgcatgtcattacaatgattatatacataaaagataaatgaggtccttataactacagagtctactatacttcacactcttcctcatgccctctcccactttcttatatgttactgaaagtgagtttcttacatcaagtgtaaatccattgcacagttaattctaaggcctttagatgtccctaattcctcttctttcggag

SEQ ID NO: 698617 - DNA, 130 bp, Homo sapiens
gcacagtaccaaaggatagtgcagaccagtgtgagagacaactgtatgtaattatcgaaatccactttagacactggcatgatttataccaacaaagactgctacacaccgacattacactgagaccact

SEQ ID NO: 698618 - DNA, 118 bp, Homo sapiens
taccggcccgcatagcagtgggccaaatgcatcagctattctctgtgctgctaggtgtaatagattaaacttcaatgcacctgggctcttttcatgggctttgcctgtcacctttaca

SEQ ID NO: 698619 - DNA, 376 bp, Homo sapiens
ctggggactcctccttagagaggcaggcatacctattcaaattccctcccgagtgtctggtggcctcccctccaggcccagaggtcctgaggacaggaaccagtttctcatctctgaatccagcacccagctgggggcccgggcatgggactcaggactgtttgctgactgaatgaatgactggacgggccaggccccaagtgaatgcacagagtggcagcggccggactgaacatctctgggaccagggccaggaggagtgagggccagacctgggggggccttggcaccattgggagtggacccctctgccgatggggaggagatggagagcccgaggggcggaggtttgttcaaaagtccccgcaagcgagtg

SEQ ID NO: 698620 - DNA, 199 bp, Homo sapiens
ccagactgagctggagctggaatctgtcttcctattgactctacttgtttaaaagcggctgcccattacattcctcagctgtccttgcaggtaggtgtacatgtgactgagtgttgaccagggagatgaagccacctcagaggaaggcagcatgcgtcctttatcatccctgcatcttgctgctgagactgtggatata

SEQ ID NO: 698621 - DNA, 698 bp, Homo sapiens
  misc_feature (105)..(105): n is a, c, g, or t
  misc_feature (125)..(125): n is a, c, g, or t
  misc_feature (471)..(471): n is a, c, g, or t
  misc_feature (698)..(698): n is a, c, g, or t
agcaagcatgtctgaatttcttggaatcttgaagatggggaagtagaacagcaaagaacatatagtagtgggcacaatcgtctggatttccatagtgataccggnttacctctccggccacaagnaaatgggaagtagattgtggaagaatcaaaagggatcctggaatgggctaagcacaaaaaacccattacaccaacattggaagagagttttctggatggttccatggaagggaaagaaaagcaaggtggatgaaaactctgggaaatcttccatggtcatggaaggcactggggtttaattggctgaacaaatcaaaatgaaattcactggcctggtatgtgctggtttggtatgaacaaattatgtgaacacgataaattaaagaaagaaatttatggttcgaaacctctcctggctctcaatctagatcaggcatggcatgtaactttaacttctctattagancactatatggttccataggaattaaggctggttaaccaagagctccgcgggaaatggcaggcaaacaatttacacaacagggggggaattctcggcttccccctgtgcaaacggaaggaaattaactggaaggacacacaaatgggggacacggccaatgggatttcagtggaaatttaacttccaaaggagggccttggggccggttgtggtctccggggggtttn

SEQ ID NO: 698622 - DNA, 234 bp, Homo sapiens
agggaacctatgtaaaactgactgataagcctcaagttcccaaaatttgttttgttatatttattttatttattttttgagacagaaacttgctctgtcgcccaggctggagtgcagtggcatgatctcagatcactgcaacctcgcctccctggggcaggagagtcacttgaacccaggaggcctcggaggctgcagtgagccaagatcacgccactccactctagcctgggc

SEQ ID NO: 698623 - DNA, 252 bp, Homo sapiens
gtgtccctatactcatttagtgacacagagattgtacaattaccttcttaatgacttcattgactcactggatcacacatgatgcatagttgtcacaatttacctgtacttatagtatccaaaattcctcttgttattggtctctagttctattccattgtggtcgcttgctgctgcctgatggtattcaacttttttaatgttttaagacttgtgacctaacatatggtctatccttggcggtaaaagctt

SEQ ID NO: 698624 - DNA, 428 bp, Homo sapiens
  misc_feature (137)..(137): n is a, c, g, or t
gaatcgatcaccatgaaaaatcaagtgcaagtgcatggcgagcacgcccaactggcggtggatgcactgttaatcgcttccggtcgtcaaaccgctaccgcttcgatcataccagaaaatgccggtatcgcagtaancgagcgcggggcaaatatcgttgacaagcgattacataccaccgcagacaatatttgagcgatgggagatgttaccggcgggatgcaaattacttacatatcactggatgaataccgcatagtacgtgatgagatactgggagaaggcaaacgtagtactgatgatcggaaaaatgtgccttattccgtatttatgacaccgcccctgtacagggttggtatgacagaagaacaagccagagagagtggtgctgatattcaggtggtgacattgcctgtagctgcaattcc

SEQ ID NO: 698625 - DNA, 345 bp, Homo sapiens
tgagtactgctaacattctccaagtgttttcattggtctgagcgccgctcccatgtttcctatctctcagctgtccctcgtgccctgtgtgagattgttcatcgctaagagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccatccattcccgatacaccttacttactgtgtgttggcccttatcgag

SEQ ID NO: 698626 - DNA, 103 bp, Homo sapiens
caagctctttggggagcaaggaacagatctgttctacatagaatctccaatcagagctgacggtggctcaggagacaggctacaggatggcgatcagagagaa

SEQ ID NO: 698627 - DNA, 821 bp, Homo sapiens
  misc_feature (148)..(148): n is a, c, g, or t
  misc_feature (342)..(343): n is a, c, g, or t
gcggcacgaggctcagtttctctaccttgtttggagggtagtcagaggcctttatgtcactcatattcctgtggatgctctttgggagggaggggcccatccagctgggctgtgtgtgtgtgtgtgtgtgtgtgtgtgtgtgtgtgtnatatcacgcagtgtattataatgtggggaagatcaactagtgattgtagaagctgtaggtcatactgcagtggagaggaagactatctattactattactaaactattgctgagagtctccgctggagagggagttgttattagacacgctcctctaccagaggggggctggaagctccagttatcaccaagtnnaccaatgttattatttccgttgctccgtaggattatgtatgttatatcatcagtatgtatgtatctatcatgataccgaggtgtggccatcagcagtctacttgtgtggcaagtgggaccacacaatctagcatactatattatataacggcgtctgatgctagttggtatgtacaccgtcgacaaagacgttgcgtctatctctattactatcgtggcgtggaggcccctgttgaaagtgacacgccgttgtagtgctgtgcagtgaatcagacccgtgtaataggagtgaatctccactgcacttaacagtgaagagatacaaagagaatctagagagagatctatatttgaatgagataaaagctggcatagaaacagtgatttagatgttatgaggttggtggcagagattccacagataagagcacctaaaaatgagatagagaaggggaggaggcccccctgtagaccatag

SEQ ID NO: 698628 - DNA, 706 bp, Homo sapiens
gggactaaaaatcctaaaaaaaaaatttataaaaaaaaaaaaaaataaaaaaaaaaaaaagaaaaaaaaaaaaaaaaaaaaaaaaaaaaaaaaaaaaaaaaaaaaaaaaaggaaaaaaaaaaaaaaaaaaaaaaaaagaagggaaataaaaaaaaaaataaaaaaaaaaaaaaatcttgtggcccccagggtccaatggaatttagactccagaaatttttttgaatccgccagaatttgagtcctattggcgaatatcccctattagggggtggaatgaaattagacggcccgtggttaaaaaatctttgaacggggaaaaccctggtggttcccaatttaattcttttatacccaaaaccctttttgccaagtggggaaataggtgtagggggccaccccgtttccattttcaaaagttgggccatgtcgaatggccacttggaactggaacggataaatttttgtacaaatccgggaaactttgataaaacctgcctttttaaaccctggccaaaagggaaaaccctctttaatgaaaaaaatccccgcgaaggggtacaatgtcctcctgtgggacaaagggtctccttataagcaaggtggtccaaacttaaaggggacaaacacccttttaaggctaaggccccttaatgggcattttccctataagttttttgggtccaggggcgccttattattgccc

SEQ ID NO: 698629 - DNA, 341 bp, Homo sapiens
  misc_feature (2)..(2): n is a, c, g, or t
  misc_feature (145)..(146): n is a, c, g, or t
  misc_feature (161)..(163): n is a, c, g, or t
gngtccgataaatactagtcacaataagggtattttttttgggggtggagtaagggggagactgatgctagtccttgttgtattttgttgggctgtccttgtgtattttcaccccagcctgtagtcctcctcacttcaaggggannaaaaaagggagcaannnacccaaggagagggggttggggctgggctctggaggctcctccccttctttctcttccttccgcctcccccgtgcccccagcatgctcttgtcactgtctctgaatgggtatttgcctggctttgttgcttctctatctgtatttagctgcagtgatcctttagcatggttggctcag

SEQ ID NO: 698630 - DNA, 514 bp, Homo sapiens
ttctagaggatcctatcagtttacacaaaaaactagctgggcgtggtggcgggtgccgtgtagtccctagctacttggtgaagctaaggcaggtagaatgcttgaactcgtgcgaggtggaggatgcagtgagccgagattgccccactgcactccagcctgggcgacacagcaagactccatctcaaagaaaaaaaaaaagaaatcctgttctttttcttttaaacagctgtgttctagaaaacaaaataccctccaatacttgaagcatttatgtccccagctaatactacatgcagactactagaccgttagaacaaaaacacaccttacctaatagggctctctgactcaaagggtactgtaataaatactgctgtatataagctgtgctttaccgataagtgggatgctataagagtggaagcctttagttgactattatcttgtccatcgtcagaatcaatacctctaatggtatctgtagacaggtgtgatgctaatactcccagat

SEQ ID NO: 698631 - DNA, 257 bp, Homo sapiens
  misc_feature (105)..(105): n is a, c, g, or t
  misc_feature (107)..(107): n is a, c, g, or t
  misc_feature (131)..(131): n is a, c, g, or t
  misc_feature (150)..(150): n is a, c, g, or t
  misc_feature (208)..(208): n is a, c, g, or t
  misc_feature (235)..(235): n is a, c, g, or t
tgcacatggcctcccgtggggccagtgggaagctcaaaccacgcaggtcccacctgcacacatgagctcttctctcaccctatgacctatccccaagaaatcccngnttacccacctccatcctcacacangccactcaagacttttctngaccagcctgcgtgctggagtgctgcacccagaagcactcataatgggtaacaggtgnatgcatgccctcctggggtgtgtcacntcatccatctcaacatgcgcac

SEQ ID NO: 698632 - DNA, 330 bp, Homo sapiens
tcatgccccaacaaaggcaattgaatgctaagtctggatagacttcagcagtggtattgttaaaaccactggattgactgggcttactacagggccaatgtggccaagctggttggtgatattttgaaaaaagtataatgcctaaattctggctaggataatccaccctggtggaccaggaggaaaggaggatgtaaagctgttagtttgtgttggatcagtcaggatccaggtataaacagtggagaataggaacataattcctttgaccaataccattatacttgaatgagtctcccaaaaccagcggcaaaaagaccgtcggccccc

SEQ ID NO: 698633 - DNA, 289 bp, Homo sapiens
tcggcccactgcaggttgtctcctttttcttaaattagagatgaaaaaggagacattacaactgataccatagaaattcaaaagattagtggctactataagcaatatatgccaataagttggaaaatctagaagaaatggacatttctagacacatacaacctaccaagattgaaccatgaagaaatccaaaatctgagcagaccagtaacaaacaacaagattaaagccgtaataaaaagtctcccaataaagaaaagcccaggacctgagtacaacctgccggtgg

SEQ ID NO: 698634 - DNA, 213 bp, Homo sapiens
tgttgctggagagtctggaggaacgttgtgtacagtctcacgcacgtggacccacgatgacggtgacggggcgcgtggcgctggtggacttggggagggtggatcacggcctgggctgtgagtgctgtgtctggctcccgaggctggccgagtagaaaggaacatcttgggaggctgtgtcttgatgcatcgtgggtcagactgttgccgtgg

SEQ ID NO: 698635 - DNA, 3873 bp, Homo sapiens
gcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttccgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcattcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagggctgaagggccaagcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaactttaaaaa

SEQ ID NO: 698636 - DNA, 2907 bp, Homo sapiens
gcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttccgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcattcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagggctgaagggccaagcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagcaatttgggttaatgattttctgcagctgctcaaaacagttggtactaacgtcatcg

SEQ ID NO: 698637 - DNA, 268 bp, Homo sapiens
gctttattattatgggttgtttgaaggggaaaaaagtttttgtagattggggacccccatgtaagaggtattaggctcccccccttcccctccaattattactcctctaaatgaatactccttaaaagtgatggggcttctgtttgttttttgaattgctaatccaaataaatatttgcctatacctttttatcctcattttaattttaccctgaaaggtccttaaattatgctgataacctttgaataaattgtgatcccaaagcta

SEQ ID NO: 698638 - DNA, 136 bp, Homo sapiens
gggagaggttgctcgagaacaccgggcagagtgaacggatcacgaagcggttgccggattcgagcgtcatgaaatccacgccgcgatcgagcgggcgcagccagcgattgagcaggtcgcgcggctcgacgcgctg

SEQ ID NO: 698639 - DNA, 243 bp, Homo sapiens
  misc_feature (19)..(19): n is a, c, g, or t
  misc_feature (46)..(46): n is a, c, g, or t
  misc_feature (131)..(131): n is a, c, g, or t
gaactcctgacctcaactnatccgtccacctcaggctcccaaaatnttgggattacaggctggcctgtagtcaccgagtctggccccccaccacccctgtttgtttttttaagacagagtctggctctgtnactcaggctggagtgcagtggcacaatctcacctcacagcaacctctgcctcctgggttcaagcaactctcctgcctctggcctcccaaagtgctgggattacaggcgttag

SEQ ID NO: 698640 - DNA, 661 bp, Homo sapiens
taaatgtttggccacacagagagaaagagggctagggggtgggaaaggacagatctcacagacgtgagcaggacaggaagggacttcagaaggggagctgaaaagagggtagggagagacaggctcaggagaggggaggggtggggattgtggaaagccatttcttagagtttcaggcagtgttctgggtcagcctcaggttcctctttctttaccctcgtccgtgccgggcactttctccttatcagggtgtgtggttctcattcttacagcttctcatatgtgttctcttcttctcagcttgtggcggtgcctcctccccagatcctcgcgagtgggacggcggtgggccgtgggtggccttgtggccagccacgcactctcctctgtggcacgacacggggcgtgtgtggtgcgcaccgccacgacacgcccaggtgtgaacaggccagcccgggcgcaccactctcgcgccgtggtgttagagagcggccctctctctctcttggtgcgcgtggggcgcccttcttctcgagcccctctggggggaggggccaccgggcgagagctttttactcgaggggggggaaaggccccttttaggggtggggccctttttgctggggctctctccagccgtgttcgccgcggcgcccttctt

SEQ ID NO: 698641 - DNA, 115 bp, Homo sapiens
tgcaggatatgcacgcgtacagcacaccgacacctaccattgtaacgtagactaataatagcagccttctgttcttctgagtacgtgctaacgtgcctatgtgtacttatgtgac

SEQ ID NO: 698642 - DNA, 370 bp, Homo sapiens
gcgcgaatccaggtagcaagtcatgagggtgacggagttcgcagttacatggaaggttgagttcagtgcggctaccgttcatactgagttgcgaatagacatatgctgtaccctgttaggggagcctggtgtcagctccagcgaagcaagaattgaggtggtacttcaatttggtccacagtcgggatcaggaggggcatcaggcggcgttgattggtgaagtagactggatacaaactctgctccccatcctcgagatatctgatagagcatttacaaagaggttttcggccaggaagcagggtcagggatgttcacggaagtggctgtgcttggaagatccaggtactgtggctcatctccctcctca

SEQ ID NO: 698643 - DNA, 144 bp, Homo sapiens
tcctactcagcatcccaaacagctggaactacaagctagcactaccacgcctggctaatttttctgtttttagtagagatgggattgcttgagcccaagagttcaagagtagcctgggcaatatagcgaatctcgtctctacta

SEQ ID NO: 698644 - DNA, 289 bp, Homo sapiens
cggatctatgtgctcagaggagcatctgacatcatctagaggcccgtgacaactggtacacacacctaccaatggtgcccctcccacatggagctgtgtgcctgcctgctctccaagagccctcagccaacaagcccctctcccctcgttttcctccttgcctctgtccaccgttttctccgcccgagttcttgcaggctccgtggtgacttggtgcccacgtgactactactgaacaggacaaatcctggtcctatgcttggcatggtaaaatccttgtcccatcttc

SEQ ID NO: 698645 - DNA, 395 bp, Homo sapiens
cacgaggcggcagcatcgactgctgcgcgcgcgattcgacctggaacacgccgatggtgtcggccttgcacagcatctcgtaggtgtcctcgtcgtcctgcggaatgtcctccatgcggcaaggcagttgcggatgcgcgggattcgggttcgggatcatcgccagcgcgcggcggatcgcggtcagcatgccgagtgccagcacatcgaccttcagcaggcccagcgattcgagatcgtccttgtcccactggatcacgctgcgcttctccatcgccgcgttctcgatcggcaccagccgcgacagcttgtcccgcgcgatcacgaagccgccgacatgctgcgacagatggcgcggaaagccgcgcagctgcgtcaccaggctggcccactgg

SEQ ID NO: 698646 - DNA, 114 bp, Homo sapiens
cacagtaggaggtacaaccagaagtactgtagaggagaggccgagttctcaggaagcagcaggcacgtgccaaggtggaagccagctgcaggcaggggaagaaggaggccctta

SEQ ID NO: 698647 - DNA, 134 bp, Homo sapiens
ggcttgctgtaatgtcccaggaacccttttaaaaggggttctgtaatagcatattgtaaatgccctttgcagcagttggaaaaaaaagtgttgtgtgatttgattgaaataaaactaaatgggttgtcctccta

SEQ ID NO: 698648 - DNA, 284 bp, Homo sapiens
ttccacccatttcccctccaaaaggttaataaaggtttgttcctcagcacccccccgcccaacccggggtttccatacggtttgttcacaggccctttttaggccggtggtgaatgctcacttacattgaccgctgcgagggaattgttcggcgagggctgcccattttcaaatcaatgcctgctcagaacaacaaaaagggcctcaaatgtattggtttccccaaaaccattgttagggttttgtgaagcatttttgaacctaataaaaaatgtcaaaagtca

SEQ ID NO: 698649 - DNA, 340 bp, Homo sapiens
accaactatgctgaactccaggttggagtacaatcgcacaatcgcggtcaccgacactctgaagctattctcctgcctcagcctcccaagtagctgggattacaggcatgcgcaccatgcccggtaattgtatttttagtagagacagggtttctccatgttggtcaggcaaatctcaaactcctgacctcaggtaatctgcccgcctaggcctcccaaagtgcttggattacaggcgtttgccaccgtgcccagcctttttatttctttgagacagtcttgctctgtcacccacactggagtgcagtggcacaatctcggctcactgcaacctctgcct

SEQ ID NO: 698650 - DNA, 844 bp, Homo sapiens
  misc_feature (15)..(15): n is a, c, g, or t
  misc_feature (188)..(188): n is a, c, g, or t
  misc_feature (233)..(233): n is a, c, g, or t
  misc_feature (248)..(248): n is a, c, g, or t
  misc_feature (298)..(298): n is a, c, g, or t
  misc_feature (309)..(309): n is a, c, g, or t
  misc_feature (345)..(345): n is a, c, g, or t
  misc_feature (357)..(357): n is a, c, g, or t
  misc_feature (484)..(484): n is a, c, g, or t
  misc_feature (526)..(526): n is a, c, g, or t
  misc_feature (531)..(531): n is a, c, g, or t
  misc_feature (541)..(541): n is a, c, g, or t
  misc_feature (543)..(543): n is a, c, g, or t
  misc_feature (553)..(553): n is a, c, g, or t
  misc_feature (557)..(557): n is a, c, g, or t
  misc_feature (563)..(563): n is a, c, g, or t
  misc_feature (571)..(571): n is a, c, g, or t
  misc_feature (583)..(583): n is a, c, g, or t
  misc_feature (608)..(608): n is a, c, g, or t
  misc_feature (651)..(651): n is a, c, g, or t
  misc_feature (691)..(691): n is a, c, g, or t
  misc_feature (698)..(699): n is a, c, g, or t
  misc_feature (720)..(720): n is a, c, g, or t
  misc_feature (733)..(733): n is a, c, g, or t
  misc_feature (742)..(742): n is a, c, g, or t
  misc_feature (774)..(774): n is a, c, g, or t
  misc_feature (830)..(830): n is a, c, g, or t
ttcgtggtgggtgcnttctgggttttaccacatattttaatgttaaaagttaaattattctttacatgcaagtagtgtgaataattttctccacatgggaacactaattataaaaagatgacatcccacatgggttaagtgtctttttaattgaaaagctaactgtccagttacatttctcccaaaanaccacaaactgggtagtaactgagtctctaggcaatatatttaanactaagaggattaanaataaagaaaaagaaaacaagtcctcagatgcaatgaagggggccctgcnacatacaggcnaatcaatacagtggtactccttgactgcagggggcngggggacatccnagtggctcccctcagaacatttacttcaagaagcctttttccagtttccaactcatgaataaagataatattttgttaattctattccagaaaacttttttgcaagttgttttaaatacaatgccancttttaaaaggtcactaaagttaacggggcaataaacgaggngggcnttgcgttacnanaagggggggngggnattttnggtattgnggggcttgcggntctccgcgggagggttccccttggncatattggcaacagtcttgcatgtaacatcaagcaaacctttnatgtctaagtagtttgcagccagaatgagttcaaaaagtnttccttnntcaactttcaggaattcttgntcccaaacagggntatcatctnttcgcttttctttgttctcatcatcttcaggngggggggggtcatccttgtggtgggtgcacactgaatgaccttttttaatattgcngcattcacatttgg

SEQ ID NO: 698651 - DNA, 156 bp, Homo sapiens
tgcgctcacaggatcagtggaatgggctgaggatccgctttttcctgcagtagatcaaggccactagagcagcaacaatggctgctacagcggtcgcaatgaccacagccacaatgatccccattggtgaagaccagcacgacgaattccacgacg

SEQ ID NO: 698652 - DNA, 923 bp, Homo sapiens
ggtctactacggtcaatgctctgaaatctgtgagagcaatccacagttgcatgcccatcgtcctagaatgaattcccctaaaaatctttgtaatatgccccgtatttaccctatagcactcctctatcccctctagagtcaatatagaattagataatacacatataaagtgttttggggaggggttgtggacctaagtggataattttttgagaccacgtttatttggggacgcgacgactcggtgaggttatacatcattgacttgaggttccaccaatagagtacatctgcggagaacttaggtaggtgtgttaggtcagtcttaacaagaaataaaacgcccatgggaataacgccttgccgtggaagaaaactctgacaataatgatatggagtggatttagaaggggagaagtagctaggggagttcatgatgggacagtcctataaaaaggcccgcacggggggtttctaattaattttaaaccttttcctcagtgctccatgatacttttttttgagactccatatcattgcttattttaacctttttccaattttagagggatttgttactagtcgatcaattagaatgaacctatgcacatttttatgtacacatattcagttatatattgcttcctagttgcattatatgccaatgccattgtacctgggcttgacctaatacttggtcactgactttttaacgcacataggcttgataacaggtggcagtactctactacccgagtgcttccatttcagcactcgaggctgctttgctcatccatgtgcttaaaacggcatagctttgttcgtagaaagattgcacggtgccccacgttaagaagcttcgctccaaacaccctttgaacacgaggtataattttcaccaatatgtcccagccaactttttt

SEQ ID NO: 698653 - DNA, 234 bp, Homo sapiens
ggggggggggggcccccaaaaaaccgaaaaacccccccccccacccccttgttttttttttggggggggtttttcccccgaaaaaaaagggggggttttcttaaaagggggttttaaagccccctttttgggccccccctttttggaaagagggccccgccttttaaaaagccacgtaacaaaaatgttttttgttttttttttccggaaccaaaaaaaaaaattttgggggga

SEQ ID NO: 698654 - DNA, 472 bp, Homo sapiens
taaatacccaaaggaaactactttgatacaggaggacatagaattacatattttactgacaatacattcctgaatatctttacataatagcaatcttaacttgcttttatttgaatagaaaagcctttcgtgcagagtttttttttttttttaacatcaggaaacccttatgaggctaacaatagacttcaagattctgtgaacttcctgaaattttatgcagagtactgtgtgtacgtgcatgtgtacatttttcttgggtgagtggttgtgttttccatcaggaattcatgactcattcgttgagcaaatagttattgggtacctactatatgccaggcgttactctagataatggggttatatacatcaacaaagtagacaacaatccttgccttcatgggatagacgtgtagatggtataaaggtagatatctgttgatagaagatgaatggtagaaaataagtaaaa

SEQ ID NO: 698655 - DNA, 621 bp, Homo sapiens
  misc_feature (26)..(26): n is a, c, g, or t
aaggtcgctgttcaatcccaggttgnagtgcagtggtgtgattatagctcactgcagcctcaacctcccaagctcaaatgatcctcctgcttcaggctcccaagtagcagggactacaggtgtgtgccaccagagctaatttttaaattttttatagagagatgaggtctcgctgtgttgcccagactggtcttgaactcccaatatcaagtgatcctcctgcctcaacctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatatgtgaccattggcaaacatagaccatggtttggagtggagagaggaagggaggcagccatggagaagtttactatagtaccaccttttccctgcttcttggtttcatgtttacaaatgtaattttttggggacatgtaatta

SEQ ID NO: 698656 - DNA, 127 bp, Homo sapiens
actcaactgggcactgagtgagacaacgatctcccaagcaaacagcaacaagccacaactaattacacagacgctatccatcatacaatactatgtcgaacaccgtatgagttcgaccctagaattt

SEQ ID NO: 698657 - DNA, 194 bp, Homo sapiens
gccagactggtcttgaactcctgggctcaagtgatctgcccaccttagcctcccaaagttctgagattacaggtgtaagccaccgcgcccagccaagggataactgatactctattctaaaccattgtcaccagaataaaacagagggctctgcgttccacatcttaaaatatttcctaagaagctgacaatct

SEQ ID NO: 698658 - DNA, 959 bp, Homo sapiens
  misc_feature (48)..(48): n is a, c, g, or t
  misc_feature (63)..(63): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (100)..(100): n is a, c, g, or t
  misc_feature (148)..(148): n is a, c, g, or t
  misc_feature (218)..(218): n is a, c, g, or t
  misc_feature (345)..(345): n is a, c, g, or t
  misc_feature (422)..(422): n is a, c, g, or t
  misc_feature (458)..(458): n is a, c, g, or t
  misc_feature (571)..(571): n is a, c, g, or t
  misc_feature (596)..(596): n is a, c, g, or t
  misc_feature (608)..(608): n is a, c, g, or t
  misc_feature (892)..(892): n is a, c, g, or t
catcagaggagttacattactcgttcagaaccatttaacaagtgcaanaatggctttgattgnactggtgtnantcatcctnttctaaagcaattgctgnacatttctcaacatgagggtgggcttggtttatctggtgcaaaggccnactaccgtggaggtgaaatccgagaacagaatggagacagtcttgtccatgctgcttttgtagcagaaangtgtgtcgcgggaagtgcagaggcaaatgcatttagtgttcttcagcatgtcctcggtgctgggccacatgtcaagaggggcagcaacaccaccagccatctgcaccaggctgttgccaaggcaacncagcagccatttgatgtttctgcatttaatgccagtcactcagattctggactctttgggatttatactatctcccnaggccacagctgctggagatgttatcaaggcccccnataatcaagtaaaaacaatagctcaaggaaagcctttccaacacagatgtccaagctgccaagaacaagctgaaagctggatacctaatgtcagtggagtcttctgagtgttncctggaagaagtcgggtcccaggcnctagttgctggntcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtantattcccagctgacctaaagtcaataaacattctgtttaagtgttttcttacgttttctcaatgagt

SEQ ID NO: 698659 - DNA, 272 bp, Homo sapiens
  misc_feature (28)..(28): n is a, c, g, or t
atccctgagaatccaaaattccccgggnccacctatcacaccccatcctacaaaaaaaaaaaaaaaaaaaaaaaaaaaaccgttgtggcgggccgcccgtgggcccctgcgaaaagagcttttcaaaaccattgcggttggggcgcgcgcggggccccccagaagggtatcaagtggaaccaggtggctcctagtcggcgtgtgtctcccaagagagagacactcgcgggcccgagtgaaccacgagggccgtgggattctcccacaccaaa

SEQ ID NO: 698660 - DNA, 958 bp, Homo sapiens
  misc_feature (48)..(48): n is a, c, g, or t
  misc_feature (63)..(63): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (100)..(100): n is a, c, g, or t
  misc_feature (148)..(148): n is a, c, g, or t
  misc_feature (218)..(218): n is a, c, g, or t
  misc_feature (345)..(345): n is a, c, g, or t
  misc_feature (423)..(424): n is a, c, g, or t
  misc_feature (427)..(427): n is a, c, g, or t
  misc_feature (436)..(437): n is a, c, g, or t
  misc_feature (445)..(445): n is a, c, g, or t
  misc_feature (457)..(457): n is a, c, g, or t
  misc_feature (570)..(570): n is a, c, g, or t
  misc_feature (595)..(595): n is a, c, g, or t
  misc_feature (607)..(607): n is a, c, g, or t
  misc_feature (891)..(891): n is a, c, g, or t
catcagaggagttacattactcgttcagaaccatttaacaagtgcaanaatggctttgattgnactggtgtnantcatcctnttctaaagcaattgctgnacatttctcaacatgagggtgggcttggtttatctggtgcaaaggccnactaccgtggaggtgaaatccgagaacagaatggagacagtcttgtccatgctgcttttgtagcagaaangtgtgtcgcgggaagtgcagaggcaaatgcatttagtgttcttcagcatgtcctcggtgctgggccacatgtcaagaggggcagcaacaccaccagccatctgcaccaggctgttgccaaggcaacncagcagccatttgacgcccccgcacccaaccccagccacccagaccccggaccccttggcatccacacccccccccannccnccccccccnnagaccccnccaaggcccccnataatcaagtaaaaacaatagctcaaggaaagcctttccaacacagatgtccaagctgccaagaacaagctgaaagctggatacctaatgtcagtggagtcttctgagtgttncctggaagaagtcgggtcccaggcnctagttgctggntcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtantattcccagctgacctaaagtcaataaacattctgtttaagtgttttcttacgttttctcaatgagt

SEQ ID NO: 698661 - DNA, 523 bp, Homo sapiens
  misc_feature (363)..(363): n is a, c, g, or t
tgaacattggcgttactctctgctatttgagaatcaggggctttaaaatatatcttaatatcttcttcctctttattcaataatttcgggcgtgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttcctttgcagatttgacaaatgttggcaatatttntttaaaagttaaatcatattgctttcatgaataaattaaaatataaagtcatggatgcaaacagatgttacatatacacattctgtctctccagatgaagagaacatgcaaaaccatttaataaccaaaatatcaagtaaaattagttcccaaacgggca

SEQ ID NO: 698662 - DNA, 432 bp, Homo sapiens
  misc_feature (393)..(393): n is a, c, g, or t
  misc_feature (429)..(429): n is a, c, g, or t
cttagttatagattaaaagaagttaatcacttatgtctttagatgaatgcacacctacacatagacatagagcttagaaggtatataagctctggaaaactttataatttttaattggcctggtgataatttccaggccttctccctgtaactggttacagaaataaaaactctcttcctccccagttcatctgcatctcgttactgggcctcaagaaatagcagcccaaccttcagtttgacctggggaacaaaacgtgggcaagccagccagggagagaccgggatgggtgctgtgttcagcccaccagtggctttgcggatgagtacagtctttcagggaggggtcccaaggcagctgccccgtgcagatttttcccggggggaccctcnccgagggtctctcccgtgttgcaaaactgtcacgtncct

SEQ ID NO: 698663 - DNA, 279 bp, Homo sapiens
gatctagaggatcccggctacacttgcacaggtctaacctaccagaccggcattaaaattggggggggggtgccgtcggagcagcacccaccctccgagcagtacatgctcagacttcaccagtcaaagcgaactactatactcaatggatccaataactggagcaagggaacaagtcaccccaggaataccagcgcaatcctattctagcgtccatctcaacaatagggttaccgccctcgaggtgggatcaggacatcccgagggtgcagccgctat

SEQ ID NO: 698664 - DNA, 804 bp, Homo sapiens
acagtatatttaccttgtacttactttaatatagccattttaatgaatgagctcgcttgttcatctcagactcttacagtttcgtttctgttttaattctaacagctctgtcaggattgccacaattccagcctggtgggcactattaatggaaacagtacattcacaaagagagtcgctggaatgggagtgaaacatgcggtcggaattcgtttccctggaagatcctcagtatccaaggaccaacagttctttgctatacagaggatcataaaatacatttggtagatgtaggcccgtaacgcagaacccaggtgtccgagatgaggttggttataccacatttgcataagttagcgcttggtgataaccaacgttagcagatggtggattctaaaagactggtactttgctacgcatctttatttgaagcctacagatgcactttcctgtgtgtttcatttcagaggatttagtggtctaatcactttatacctggtctcagatgtgtacggactgacatgtgaacgaatctctctccagagcatgacggttattttaagttccatgataaaatgaatgttcaacatagcgttgatcacaagacgtccaggagcctctaggctccattgtcgagtgtgcgtgcaagcttagtgagtgaagattgtggaccaaagttttgagcaaaagatggggcagttggaggaacatcaggtgccatgtggggcatgtatttcagagaaagaagtaaagcgggaaagaagcccgcagtaacactaagagggacctccagcgcatggttct

SEQ ID NO: 698665 - DNA, 377 bp, Homo sapiens
caatgcctggggccgtttgcccgtggacctggctgaggagctgggccattccgatgtcgcccgggacctgggggcggctgcggggggccccagaggcagtaaccatgcccgcataaatgccccggaaggtccctcagacatccccgatttaaagaaccaaagagggttttagaaaacctccggaaacttagatcatcagtccccgaaggtcctacagggccccaactgccccccccccaaccccccccgcttttgtagtttttatttaaaaaataaagcttttaaaaatgtcctgccttttaacgtaaatatatgccttccccccctaccggaaatggccctttatatcattttttatatatttttataaaaatgta

SEQ ID NO: 698666 - DNA, 192 bp, Homo sapiens
acatgggactggcattgatattctattatattaatactgagatagcttttcccagattttgaatagctcaatctcaacttttttcttaatagtattttcatgctctgcctagtgtcgattaatcaattagtgatcaaaccagtaatcagcccagtcctgcctttagacgacgccttgctatgatagccaggt

SEQ ID NO: 698667 - DNA, 178 bp, Homo sapiens
  misc_feature (88)..(88): n is a, c, g, or t
tcgttccacttcatggttggtgtttctctaaaataaattcccactgcaaaaggcaatatcaacatagttcagactcttacattttaangagtttctcctcctaccctaacagctgtctggcaaggccctcactgagcctcgttctggagcctctaccctcatagaagtttttcccctc

SEQ ID NO: 698668 - DNA, 336 bp, Homo sapiens
gctcttcacagcccagattaacacaggcaggggagagggatggcaggaaaaaggattatccccttcctgcaggctgggagtcatgaggagttgttcattctcattccataggatctcttggaaagattgccacatagacagctatttccttatgtaaagttgggagatgtgtcaatagagagaggttattcggccagtcaaaacacactcagcccactcgtcctctaaatatttaaccatctagaatggcaaacactgctttatagcatgtaataaattatgtactgagatgtggagctgctttatgatggtgtgagactccatctcaaaaaaaaa

SEQ ID NO: 698669 - DNA, 110 bp, Homo sapiens
tagaggcatcaaaaaagagtatatttatgatgcggacgcttgagttctcctccggtgagtcagacgcaccgcacccccccccccggcgtagggggaagcctacaccgtaa

SEQ ID NO: 698670 - DNA, 838 bp, Homo sapiens
ccaatacactcacaagcactattacaaaaaaaaaaaagaaagttggggctactttgccaaccgttaagggtacaaacgcatgaacatggctcacagctgcctcaacctcttaagctccagcgatcctccctcagcctcctgagtagctgggaccacaaggatgcgccaccacccctggctagttctgttcatcttttgtagggacaaggcctcactatgttgaccatgactcaagcaaaccttctgcctcagcctaccaaagggctttttttacaggcgtaagaggcacacagccaggacacgatcttggttcataatgccattatccaacaaagggaacggggcacctcttgacacaacagcctgaaaacacggccccggtctcgacatatgaaatatgaccccgtcgcattttaccgaccccccaaagataaaaccccaacatacactccccaccgaccaacacacagtagcccaaccgtactctcgaattcaacctcacccccccgcacaagatacttaacggagacagctgcgactccccgacaacctcaccccccaaactccaacccctctaccccctagatccacacacggtattccgcctaccccaccactaaaacccttcataaagctcaagcccgcgactagaacacaagccacccactcaattaccacaaagcacacctcccacccctcatccgagctcaatatcaggcagacgagcacaccaaacaagagaaagataccgataacaaaaaactaacccaaaaagatctctccaaaaccctcgatatatctgctcgacatcgattatccacaattttatcatccacaa

SEQ ID NO: 698671 - DNA, 940 bp, Homo sapiens
ggggtgtgaggctcggtatcgcgcggggttccagttgggttggcgtctggcggtgtgctgggtctgtgacttgtgggtttgctgcttgggtggggcactcatttggtgtgtgcgagccgctcttgtcccgcgtcaagtgttgttgctccgcgtccatagttggtggtgcgctggcccccggggggctaggatttggcttggttgcttctgtacccccggagtttcttttttctctcgtccggatagggcgcgcccgttggccgcgtgtctgcaactcggttcctgtgggttgtgtgtggtagcgtcggcagccttggcgttgttgtggtgcgcccttcgtcctagttgcttttcatgagggcgtgtttcgtccatcctgattgggtggtgctatctctgatggtggccccgcttgtttcggggggacaccacttggtgagtcgccactcttgttgcctggtgcctgtggccgctttgaattttcgcctgcggcggcgtgtggactgtttgcgtgtcgccgaagccggattttcggtgggcattaattggtgggttcggcccccgtcgctttgttgttgaggtctgccccgggcgtgctgattcgcccctgttggattcgttctggggggctccttttgccccgccggcgtacacattttttactcctggcccttttggactcaccatgttgcgttcctggcgttaaacgcccttggctattgggggatggataaccggtcagctcacccctcacacgacgggcgaggatacacacacgagcgatccaagtacgattctagtacatcaccgcacgtccagcaactagcgcgcggctacgctccgctctccagccgcaccagccgcgggagccgagcacgacgtccttgcacgaggagcggccgcacaacatcggactacagacattatcacgaagatcatc

SEQ ID NO: 698672 - DNA, 325 bp, Homo sapiens
tgggaacggtattccaatgattatgataccacatagaagagacaggacttcaaccctgcttcaatctcagattagaaactctactttggctgtgagcagtggctcatgcctggaatcccatcactttaggaagccgaggcaggtggatcacctgcggtcaggtgtttgcgaccagcctggccaacatggtgaaatcccatctctacaaaaataactattaaaaattagctgggtgtggtggcggaaacctgtaatcccagccagatactggggaggctgaggcaggagaatcacttgaacctgggaggcagagattgcagtgagc

SEQ ID NO: 698673 - DNA, 396 bp, Homo sapiens
gggaaccacgccccgggggggggggggtgggccccctccctattattccccctttttttttccaaaggggggggggcttttttccccttttttaggaagcccctttggtttcggggggtttaactttggcccccccccccaaatttttttttgttttttctttttcccaaagggttagggggttgccccccctatttaagggggggggaaaattttttttctttcccccgggggggtttttttttgggggcggggtttattttttttcgcccatcctttttttggggaaaagggttggggaagggggatttttatccccggggggcaaaatttaaagggggttttttagggggccctttttttgcctgaaaataaaaagattttttggtggggccc

SEQ ID NO: 698674 - DNA, 91 bp, Homo sapiens
cttcaagtgactgctggactctgctgcagcggggtctggcacgcagggcgtgcgtgacagcgtcctttgagccccatcactctgtctgcat

SEQ ID NO: 698675 - DNA, 252 bp, Homo sapiens
gtttttttgaataaaaaacatttgtccattcctgatacgggggccaagacccagggcccaggggacggttttcaatttaaatcccgggggctttttttctacttttttgttaaaatcgggattttggggcttgccccccccaaatgagaagttaacccccctttttggggagggggaaaaaatttgggtccaaagtaaaaaagtatccaattatgggcccccctttgggtaataaaaatttgtttaaagtta

SEQ ID NO: 698676 - DNA, 499 bp, Homo sapiens
  misc_feature (270)..(270): n is a, c, g, or t
tccggattaaccaggacgaagaagaggaggaagccgaggatttaatttcctttatctggaaaattttgtatgagttcttgaataaaccttgggaacccaaatggtggtttatccttgtatctctgcagtgtggattgaacagaaaattggaaatcatagtccaagggcttcccttggttcgcccctcatttatttggaacctgacttctttttttttcggcttaaaaatttcaattctcgtggtaataccagagtagaaggagagggtgnctttccccaacttccaccccttggggaggcaaattcgggtgtggaggtgtgggctaaaggtagtgcctgttttattttaaaaagtgggcctgtcagttggatctgttgcttttttcaatgattcagggaaacaaatgggcttttttccttccttaaaaaaaaacccgccctctttttaaaattttttgtgggaaaatgcctgtcaataaaatgcgggtttttgggccca

SEQ ID NO: 698677 - DNA, 105 bp, Homo sapiens
acgtcgtcgacccggtcagtgtttacgtagaatgtgccactgaagtccactgacccaaactcgtcaaaacccggatgcaacgccattaaggtttcgttagaaaca

SEQ ID NO: 698678 - DNA, 101 bp, Homo sapiens
caaactgacaataacaagggcctcatctctgggctccagaatacatcctgaagaccccaggcagaaatactaggaaaaccaccctatggaactgatgctac

SEQ ID NO: 698679 - DNA, 910 bp, Homo sapiens
  misc_feature (910)..(910): n is a, c, g, or t
gatggagggcaagccaccaccacctcccatcaagtacacttgcattcaagagcccaacgaaagtgatctgccttatcatgagatggagaccctctagtctcgtgagacttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctctttcatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggcttgctgcattccctaagataattacaggaaacaagaaaatgtaaaagtgctaacaaggctggcagtatggagaagtatggttagtcttcatatgaaattctgtgcttattttcatggaggaacagcatacttgcccaggaaccacatttcatcctcttcatggtttctacatgtcagccaagatctggcaatggacagtgaaaggtccagagaaaataggcaaaacagtagctagaagataaaaatcctggctaatttagcaaggtctggtgcccgggtgcaccaagggcaatgttagaagggtaccaccattatacgtcttaagggaccggacgggtggaaaaagacacggaagcacattgaggagaaacctctggactgcctcgcgtcgcgtatgtctcccgn

SEQ ID NO: 698680 - DNA, 172 bp, Homo sapiens
ctactactcactctcactgcccgataactatcaaactcctaagccaactacttaatatgactggcttacacttatagctgttctagtacagatacctcttgtacggactccacttataacgcccttgaagcccatggtcgaagcccccgctcgctgggtcaagtagtccttg

SEQ ID NO: 698681 - DNA, 105 bp, Homo sapiens
gggggacaacacgacggtggcggtcacgcgaaggacctggggtaggtgtctccacaggcccagtgccctactgtacaacagcctcagccaccctgccacaacctg

SEQ ID NO: 698682 - DNA, 115 bp, Homo sapiens
gccgcctagcaacttcagagagaaaatacaaaacaagaaacagatttggttcaaatgcataaccaggggcgggggttttgcattactgataacattgttacagaaggaagttgct

SEQ ID NO: 698683 - DNA, 252 bp, Homo sapiens
gtgctccgaggattccagcactcgctgatgaggcatggcggattatgggaatatgaatttgctggagtgggaggcgtgtgagagaagaggagcaagaagtctcacagggaatgctttatgtagttgcagttgcatcttgaccttttggcttgggactgttcttttgacgctattattcagaagaactttcattttgaagtaacagtttctacactttaccatttaacaggaaatgcctcatcagcgatggct

SEQ ID NO: 698684 - DNA, 116 bp, Homo sapiens
gtaatacggccaaagcttccatgaatggctatgcctggcatcttccatttccatgctgtggcaactttggggatgtgggtggacgtaggtcgtaggatgaccttgctgcccactca

SEQ ID NO: 698685 - DNA, 1041 bp, Homo sapiens
gacgggggtttcaccatgttggctatgattggtctggaactcctgacctcaggtgatgttgactccttgtgcctcccaaagtgctaggattacaggcgtaatccaccgtgcccggcctgttacttgtcctcttaagatgtcttgagagcctcatgcgtccactgtttggtgacaggctatctggctactctggaagataagccgggactgcccaccagcagccaccctttctccctagtggggcactgggagactgtcccctgctgagtcctcacctctccctgctctcagcacaggatccatgtgtgcttttcctccctgcatgcactggcttccgggacgttcagatgacgaacacactgatgtgctgcgcatgccttcccctgtctcccctcacataaccactggggtcccgagatgcgacggggccttgtcacttcctgggtcccctgctggtttacggcgctgcttcttctgtagtcgcctgctgatccccacttggttttcaccttgtgaacggcttgcacgtgctcacacacttatgtgtcccacttattgaacactatttctccggtgacgatgcccaacgcggttgctatagtcacttgctatcccaccactgtggccccctttgcttgatatggccccctatgacttctagcgcgcttgggttgcctgccttcctttcatcacccgtggagccacactctaactcccctcagtgatcacgcccgtagttatcttcacacctcttttcgttattcactttcccttacatatgacttgcccgtacccattctgtccccaatccaccgtgtaacatacttcgcacccaacaacgccagcgctctccgctcatggcgttccccaatgggcattccccatcaacattgtacacatcttgaggaacagcgaagcccagtgtagcttatttcccacgaacgtctgtcgtgtccatattccgctctggctctgtcgcgcctcagaggtactcccacgatgttctactctctcgaatacagcatatgtcaccaccctcac

SEQ ID NO: 698686 - DNA, 125 bp, Homo sapiens
catcaacctatagtccttcctatatgatataactcacaacctagtcataaaattcaatatcatctcactgcccagaatataaaattctgagcaacaattaatatgatagttacacaataatttat

SEQ ID NO: 698687 - DNA, 592 bp, Homo sapiens
tcatcccgggctgtaggaatttggtacgagctctctctgtgcctgtattgtaacgtgcggaagaagcacgcgcacttttaggaggaggaggagaagatttatgtttgtttcatttttctttctctattcttttttctctcttttttttttcttttttaattcttttttgttttttctttttcttttttattgtctcttttttcattgcatttttttttttttttagcttttttattttctctttcatcttttctcttctttttttttatcttttttttactttttttatttatcactttttcttctttactatatccttttatacttttttttattttcttttttcctcattttatttttatttttttttctttatttttttttttctttttcattttttatcctcatttttattcttttctttctttcttttctcttttttttgttatttcttttttttttcttttttttattttatcttttttttctcctttattctcttttttcatttttttttacttttcatatttttctttatttttttttttctttttatttctattctcctttttttcctcttttttttttttct

SEQ ID NO: 698688 - DNA, 124 bp, Homo sapiens
agcgaagaaatggtcacccgatttttaataatgcccagggcacggacaggggattcggcatgccatggctgttcccagttcttcccgaagaattgagtgcggccttcctgtgctacgtcgagtg

SEQ ID NO: 698689 - DNA, 324 bp, Homo sapiens
gagaaaggtcacctctattgccaggctgccaagctggagtaccgtgatggcactaagatcactacaagctccaactcccaggtacatgccatactgccgcctaagcctcccaaagagctgggattacaggtgtgagccaccgtgcccgggcttagatgtcgaattttcccaaaagagaattctttgagttctgtatcagttatttttgagtaagaaaagtgtcatgtacctacataggtataatttgcatttgctgtacaactcttgtttcgactatacacatagatatgaggagtatagctttagtagagggttaattgcggg

SEQ ID NO: 698690 - DNA, 125 bp, Homo sapiens
cacgaggaggacctcctgcagacagactcctgcaacacctctctgcttctacttcacgtgtgccacgcctttctaatttggagtccagacaccacctggatgtgttagacctccagcacccaatc

SEQ ID NO: 698691 - DNA, 663 bp, Homo sapiens
tgtatgattattttatttataacccaggtcagcagctcattccataatacatatcagcatgttaagaaagaatgtggcccttaggtctcagactgctctgtgttcaaatcgctctccataaaattcatttctttattgcatcaaatgtacatattttcggtgtacatgtgattcaattgcataccattccatttcgtcatcgacacattctgcattaatggttaattcccacaagcatcgaacatcacaggtcaatcggggagggttaagcccatcgcctctcaacagtcatcttcgttattcatcactaagggcaaccaatttctgaatctgcatctgtctattcttacttaggtctcatctcctggtcacaagtaacgcacccgaaattaagcactctcactctgcgttcaccacgctcacttacagttccaaacacacctaacctgggaatttccctttgtgtccaaaccgaaccagccatccaggcaattccctttctaactctttcccttattctttaaaccttacccacacatgagcggtttcacttaacttgatcaacttaaagcaccaccaaaattgtcacagttccacaaacctttttaccttgggttctcactttatggacattcgttctgttcacagattagaccttaaacc

SEQ ID NO: 698692 - DNA, 364 bp, Homo sapiens
cacgagggaattttcctaccaaagccagagcaataacaaaaacagctgtgagctcagaacttataaccgaagtgggagagaatcacaagtatttcaagggaactttatgattacaacctggagattcagccctcttcatcaatggacttcacatggatttagacacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctgtaggttgatagcagata

SEQ ID NO: 698693 - DNA, 403 bp, Homo sapiens
catggttaaactaaaaatacgaaaaattactccggcgtggtggcacacacctatagtcgcattgtgtctgtaattggcaggttcttggtctacactgacttcaaaaacgaagctgcagaccctcgcagtgaatgttacagttcttaaaggcagcgtgtctggaatttgttccttgtgatgttcggatgtgctgggagttttttccttctggtgggttcgtgatctcactggctcaggaatgaagctgccagacctcgcggtgagtgttacagttcttaaggcggcgtatccggagttgttcgttcctccccgtgggtttgtggtctcgctggcttcaaaagtgaagctgtagacctttacagcgagtatcacagctcacaaaagcaatgtggaaccaaacagc

SEQ ID NO: 698694 - DNA, 91 bp, Homo sapiens
gtttccttggcatcaccatcacctcaccacctccacacacttacaaggtgcccgtgtggtcgacgcggccgcgaatttagtagtagtaggc

SEQ ID NO: 698695 - DNA, 206 bp, Homo sapiens
tcatgggcgtgctctgtcctgtgggtctgatgacattacccgagcgctgacagccgctcaagggcgcaaatgcattcgatcgtttgcgagggcaacaacctgaaaacagccgtttgaatcaccggccaatgctgaataggaggccaaaacagccggcagttcaacccaactgcccgatgaccacccgatcaaacggtgggagcagc

SEQ ID NO: 698696 - DNA, 152 bp, Homo sapiens
catattcaaaaaatgtttccatattaagcccagagctacatttatatgaggattaaaaaaataggatttaactgataggtagcacaagatgaaagtggagaatttagattggttccatgcctctacaatgaggaggcatttaggatggtcaa

SEQ ID NO: 698697 - DNA, 121 bp, Homo sapiens
caatcttccttctcgacactatgaaaatgtcaacagtcagtttcaatttgtcgagggaattatcaattttggtcacagtctttttgatacgcagtgctgtgagtcttgcggatgcttaagc

SEQ ID NO: 698698 - DNA, 643 bp, Homo sapiens
tttacggatattttaaactctgttagagacttgcctcagtgtatccctattagggttctgctttttgatctcatctctacctcttacagggctactctttgctggcacaaacgatagcatatccaagacatttaaagcttacctgaatacctgcgccttccatgacgtgcagaccctgaagcagatctatctatagcagtatactagcacatagcgtacctagttgagtctctactgtgttcttctgttaacttagaggttgcaaatcagacaaacattcacctaacaccccgatggacaataaccacatcatatctcacatgatacaggtcgatacaaaggctctcatttacaccatttactctggcgtcttgcacgggcgaccttgcggcgacgctctgagcgagccgacgctacacgaccaattgaacttacaactcacgtctatcaagcactggcatcacgaccaccacctggttgcaaccacttcctgggcccgttcctacacccagttggaaccaccacttaacacatgctctgccaccgctgtaaccactgggacccacagcaacacacagaccacacaaacgaaacggcgaccgggaccccgcaccccagtagaccagcgctcaatcccacccca

SEQ ID NO: 698699 - DNA, 349 bp, Homo sapiens
gaaaaaacatattgacttgaatggagggcatagaatgctacctctgggtacctgcttggctagggttttggcctgtgagtacgaaaaactggtagcctaagttctcaagttacgacaacccttcttctgcatgacataccttatctctcttatacatgttggtatagcctgctactagtatgtatcggtttagggaaccagtcatcataaagtactcgtaaggattctacaaatgctacatgatttctgggaatgtggtccttgagatactttcagcatacttctgtgaccacatgttatcaacatgtggaagttcctcatagcttcatgaataacctctgcgcttgtt

SEQ ID NO: 698700 - DNA, 223 bp, Homo sapiens
tgcttacaactctgaaccaacgtcccccagtgcgagaaagtgggtcatctggatgtatcacgaaaggtgctcactggaagagtgcagccttcatagagaagtgcatccggcttccttaacagtgagtctaaccgtgctcctacacacgaaatgaagcccaaatcgtacatcacacggtcatgtatttcaatctggcatgaccagccgctcctcgtttcgagag

SEQ ID NO: 698701 - DNA, 1040 bp, Homo sapiens
gtgttggtgtgtgcctgtagtcccagctactagggaggctgagatgggaggatcgcttgaacctagcaagtcaaggcggcagtaaatggagatctgtactccagcctgggcaacggagcgagaccctatgtcagaaaaaaagaaaaagccacccagcaggctgagcgtggtggctcacgcctgtagtccctgcacttgggaagccaaagcaggtgaatcacttgaggtcaggagttcgaggccagcctggccaatatggtgaaaccctgtctctaccaaaaatacaaaaattggccgggcatggtggcgcttgtctgtggtccagctacagctactccagatctgggctgaggtgggagaatcatttgaacccgggaggtggaggtgcaggagctgaaatacacgatgtactcctacctgggtgacatgggtgagaccctaatctcacgaacaaacaaacgacaaacacccagcaagcaaacgattgcgtgacaaagtccacaggacccccaagtactgacaaaatgccagacagtgtatggaacgggcacctggaggagaggaatgacccacacaagggacacaggcagcgcacatacacagcaaaagggcacatgggaagaacaccaagcgaacaagggcacacagacagggtacatgaggccactgaaagagcacacaacaactaacaaggagcaaaacgaacgacaggggagactggaagaagccaccacggtgtagcgaggaccggaggcgcaccgaaggagaggagcggcgcgaggaggccgggaacaggacaggaaaagaggagagggacagacgaaagagacgaagaacaggagaaaagaagcaagaggacacaggaagcaaagacaggcagcgcacagcagccaggcgaagacagaagaagagcgaaaagaacgacgaagagacgagagaaaaagcacacgcggcaaacgcacagcgagcgacgcgccggagacctctcagagcgcgcaaaagagcaagagagaaagaagcaacaacaaggagaaaagaaa

SEQ ID NO: 698702 - DNA, 324 bp, Homo sapiens
tgacatcagagtgtgcgccgggccgagtcgccaaattggtccccgtcgccgacctccgcccgcgagccgtctgcctgtttcccctttccccgcccatagttcacttcacacgaagtggagaccatcggcgcctgatcggctgtgttcctcccgtaggcccaaggttcgcatggacaagactgctagtaggtccgtggattgatatatcgtcaatctccgtaaacgaaccggaagagcaagacaataattggcagaaaccattgcgtgcctgaatgcatggagccaactttgatggcagaatagcaattacatgttactctgaaa

SEQ ID NO: 698703 - DNA, 840 bp, Homo sapiens
ggtctgccaggagctacggccggaagatggcggcggccgcagagttgtcgctactggagaagtccctgggactgagtaaggggaataaatacagtgctcagggcgagcgaccagattccagattcttctagacgaaagcaatggtccaagtctaacgaggattgacgtactatagcagctcagtctagtcatagcatagccatacaaaggaatatttgctggggagtactgcaggaagaaaaagcataagtcgctctcagcgaggtggttagaatacagggtcactcaggtagatgggcactccagtaaaagtgactatccacacgactgttgaaggatcgttaattcatcatcttgaagataaagtctaccttacaggggtataactttacattgagcagatatactatgtactatggacttcatcgctttctagttgacgctgacagttcaagaaaaggagacaaatatcttaatgtgtctcgcgtggtttgtcacatgcagcattatccaggcatcaggcaacgtctgtctagtgtgtcttcatcaagaacagactatatactaattcccactagaaggctggtccatggccataacagaagatctattaagaactgtcttggctggaacatgttctctagaccaccgggactaactgtgaattaatatcaggcatcattattgctcgaacgtgaaggactccggagtgtgacctgggtctgaaggttgttggtccttagcgcacgtttgcactttctgtcacatccatgcctaacagggggatcctttattaaccggccgggaggctttccaagtggcccggcgcaaaaaaaaaac

SEQ ID NO: 698704 - DNA, 414 bp, Homo sapiens
  misc_feature (398)..(398): n is a, c, g, or t
gcgcgatctcagatcactgtagacactgtgtctcagattcaagtgagactcctgtctcagactctcgagtagctgtgatatacaggcatgcgctaacacacccagctaattttggatttttaggagagaccagggttctctcatgtgtcgacaggctgtgctcgaacttccaccttagacttccaaactggtgggattacaggtgtgagccaccgtgaccaggcaatgtgccttcttatagtggctactcaatgggctttggtctgtccagtgataacaatgggataacgcctgctacacatattcattgtgaaaccctttccctgtgctgagattaaatgagactctaagagtattaaatagtgtattttccttgacaggctaacggttgatgaatntaaaggcttatgtgtt

SEQ ID NO: 698705 - DNA, 352 bp, Homo sapiens
  misc_feature (60)..(60): n is a, c, g, or t
cttttttattattaattgttttctttttaaaatcagttcataaggcttttcaagggattnggtacagaggctggggatggtggcttgcacctgtaatcccagtgctttgggaggccaaggtgggagaattgcttgagcacaggaattcgattgtagcctgggcaagatggcaagacccctgtctttacaaaacattaaaaaatcagcatggcatcatggtgtgtgtctttagtcccagctacttcggaggctgaggccacagtatcccttgagtccagtaattcgaagtggcagtgagctatgatcctgccactgcacttcagcctgggtgacaaaatgagaccctgtctct

SEQ ID NO: 698706 - DNA, 991 bp, Homo sapiens
ctgcacagttcacagaagcctgcgagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttggttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagcagccggcgtggccctcatgactacgcctgggtcttctgcagactcatgcagccctatggcccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacaaaatacttgcaaatataatgattctaggaggggcccggtgcccaatccacctgttagtgagatttataacaatccactt

SEQ ID NO: 698707 - DNA, 105 bp, Homo sapiens
  misc_feature (105)..(105): n is a, c, g, or t
tccaaaggaattttctggcaactgatgggcttttttttaaccaacaaagggcaacaaaccttacaatccacgtttgattcacctattaacttagggtttattttn

SEQ ID NO: 698708 - DNA, 209 bp, Homo sapiens
  misc_feature (194)..(195): n is a, c, g, or t
  misc_feature (197)..(197): n is a, c, g, or t
  misc_feature (202)..(202): n is a, c, g, or t
gtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaattnntnttttncctatat

SEQ ID NO: 698709 - DNA, 200 bp, Homo sapiens
cgaccaggactgctgagacagatgacaacgggcttcaaaaacttttaggttacaggattgttctaactcctggggtcaagcaatcctcctgccttagcctcccaagtagctggggctacaggcacacatcaccacacccggctaattttttttttaagagacggggtcttgccatgttgcccaggctggcctcaaattct

SEQ ID NO: 698710 - DNA, 507 bp, Homo sapiens
aactcaaattctaatgagcatctccaccatcccctgaaggagaggaatcaaaacccatcataggattatcgcccccatcacctctttcaatgccacttttcttcttttgaatttgaactctggagttactgttctacagtttggcggggacggggcttgggggttttctcttttggttggttccccttccttttcccttttttttttttttttttggtggctttgcggtaggatgctctgatctgacctttgacatggacccaaaggtgctaaatgctcttgttgacttccaacagatgggatgggggaaacccagcagttcttggtaaagtcctttgtaataatagtttgatttttttatttcgaaagaatctttcattttcccaaggaagcttttttccttttttgcccaggttccttatcccctgctggagatggcttattttgcattcaagcagactatggtgcaagtttgtttcatctagttaactggaaattattgcttta

SEQ ID NO: 698711 - DNA, 1009 bp, Homo sapiens
  misc_feature (984)..(984): n is a, c, g, or t
tccccgcgggccccaaattttgtggggggggggaaaaaaaaacgggggggggggggtgctcctctcccccccccccccccccaaaaaaaccacccctactgagaggggaacaaaaccacccgcacagacgagcggcggtggtcccacaagagacaaagtgtgtggggacaaaaagataggggtagggaactctactagcgggccccccagcacgcagacgcgtcgcaggggggggggcactctccgtctggtcacacgccgcattcgattgtgcacagaaaacgccgcggtgtcacaccagcagaaggagccgcaggacaacactaaatcaccgcgcaacaacacacccgccgcggagggggggtcatctaccaagagcgcgcgggtcgcatcgcgcgcgcgggtgggaagtatgacgcaccccgaggagagctgggacaacaaatagagttagccaccgcgctggaggtggagcgacgaggtggtgtgtctccacgaaagagagagcgagtacctactcagagcgtcgaccggagagagtgcaatggaggtgcgtcatcactacacccacaccgccagaccacccacgcggcgagagatgagtgggcgcgccgcgagaaggaaacgacaacgaaaaccacctcgcgggagcaggcgcccaagacgagagagaggagacagcccgacgcgcgcggtcgagcgcgcgacaagaccgcacgaccgcgagaagaacaaaaacacctctctcgccacgcgcgccggggaggtacgaaacgacccgcggcgaatgcaaaaagcacaccccgcgcggaccggacgagcgtgcgcgccgccggagagccgaaccagccacaccgttggtcggcgcgacgcctcgcagtgcactcacccacaagagacattgtgtcgctagaacacaactgtcgcgccaccgccgcgcgtagtgacaatacacaccaccagcgaacagcaagtagatgacgngcggccacctcacgtaggagtgccc

SEQ ID NO: 698712 - DNA, 920 bp, Homo sapiens
  misc_feature (659)..(659): n is a, c, g, or t
  misc_feature (920)..(920): n is a, c, g, or t
gagcgtaggtgctatcaccgctggcgtcggcggcgtcgtttcgagggcagggagaggatccggttctgggaaagctggagacagtggtggtgactgaagaataagctttagcagaggacttaccgctagtttcgcgaagcaatatcttacctccaggcggtatcatggacgagctgtgcttggtatcagagacagactggttgcctaatctcccaggattgggctctttagttaacctgggtgtcaatgcccagagtctttgcgactgctggatcatcgggtgcggatgagatctcatgtggctggtgcacctccagatatagtgctctcgaaacagggtgggctgagtgaaactatggtacccttgtggacctctggatcagaggttccagcttccggggagacataggttgggatgtgacctctaatgggagcatgttcatgagaagaaaagtgtggttcataagagttggctgatgtactaggagaacctttatctggggaaggacatgagttgtgatgggacggtatgtgaatgaactttcaggtaggatgcactgtgaaggagaaattaaggtgcagaaatgacttggagtgcagagtagagtgtggcatacgaacgtgtcgagaattgctgcgcaacgatttgatcatgtgtncgggtagctaatggcaactaatgattctgactgtaacgtgagataagatgcttgacggttgggtgacaacttgcatgggggacaggcttttaaaagtttcatgtggggaatggctgtcctcaacggggttggggaaaatggcagaacgggggttgggacaacaaatttggggtgaagagacatgttttgaaggtggggaggtaatcgggcaatggtttaccaatatgagaaatgtgtggtggattttctggtggtgttagn

SEQ ID NO: 698713 - DNA, 147 bp, Homo sapiens
ggggagtacggtctaaagggggttcagaagggaaggatccacaagttagtgacaggcaatgccctccataatagccttatctccccggctccacttggcttaaggaggtggttctcgggggagggggatctcaagacgaagcgggtg

SEQ ID NO: 698714 - DNA, 100 bp, Homo sapiens
gggaggaatgaggcatccgctcactccagcgtcagcccctctagtcgaagaaagaggtaatgagaaggccaccttacatctgtgccatatgctaatgtgc

SEQ ID NO: 698715 - DNA, 117 bp, Homo sapiens
atgaagcaaagtctgcgtgcaatcattgcatactccagacctgagggacggtcgtaggatgcactgaagactttggtctggtctggcgtcgagatgaccgccagggcatacacggtg

SEQ ID NO: 698716 - DNA, 497 bp, Homo sapiens
tcagccacgcctaagtgatcttatttcatcttgacactaaccttggatatttgaaatagaattattcatttacaaaggaggaaaatgagattcagacaagctaaatacatgccaaagccacataactaccagcggcagagctcagtctgctttccaaacccatgcggctcccttcatcaccgtgactcacccactttatcccccaacttcgaggaagtctcttctgatcacccaagaataatgtctgcctccttagaaattttgtagccgttggtgtttcaattttgggagtgacatctaattgtcacacactgtttcacatgctagctatctgtgcacgtatctagacaagcctgcttaggctgtggctcctggaaggcaaagaccacttcttgtgtttatctctatcccatctactaacaccacactctgcacatgataaatgtttaatatatgattgattacaataaaaacgtgttaaaaaattgaaaaaaaaa

SEQ ID NO: 698717 - DNA, 106 bp, Homo sapiens
gttacatggctgctgcccatatcgtctgggtcaacagaagaacacagctttctttagaaaaaacatttactttaaaaccaagcaccttgatttagatattttagtg

SEQ ID NO: 698718 - DNA, 442 bp, Homo sapiens
ggcccctatggcggtggaggccaatactttgcaaaaccccgaaaccaaggtgggtatggcggttccaccaccaccagtagctatggcagtggccgaagatttttattaggaacccaagcttagccggagaggagagccaaaaaagtgccagggaagctcccggttcccccagatttgtgaactcaccccagcccagggggggcagggcctagctgctccaaaaaagacatgttttagaccaaaactcctggggatgggccaaaaacccgggggcgggatttggggctaattggataaccgggtattttagtttttgttttgtggaaaggggaaagccttccccccaaggggtttaatggagatttttttttttgccccccccgctgttgattgctaaatggcccagtctggtcgggcccctgaataaatgtcttttttttta

SEQ ID NO: 698719 - DNA, 651 bp, Homo sapiens
gagacgccgcgccggctggacgctgtagtggcttcgtctcggtttctcttccttcgctaacgcctcccggtctcgtcagcctcccgccggccgtctccttaacaccgaacaccatgccttcaattaagtggcagagtctgatggagagatatttgacagtggatgtggaaatgtgccaaacaatctgtgactattaagaccatgtgggaagatccgggaatggcatgatgaaggcagatgatgacccagtttcctctaccaaatgtgtgacttggcagcaatatttacacaaaaggtcatcccaggtggttgcacccaccaaagggatgaccctcgctcctcctgaagatgatgagaccaaagaaaagcgaacagatgatatccctgtttgggaccaagaattcctgaaaggtgtgaccaaggaacactttttgaactcattcgtggtgcaaacttacttagacatccaaaggttgggtttgatgttacatgcaagactgtgtgccaatatgatcaaggggaaaaatccgtgaggagattcgcaagaccttcaaatatcaaaaaatactttactgacgaggaggaagcccaggtacgcaaagagaccagtgctgtgaagagaagtgaatgttgtgctgacactgtaacact

SEQ ID NO: 698720 - DNA, 991 bp, Homo sapiens
caagattctgcaggagtacaaatccctccatcgatatcattgcgcactgctgtggatatggatgaatctatcctgaggaagacaatttgaacgtgttccgcgcacggaaacatacagcgtctcttgtttcagtccattccatgttgctgagagtcttcttcaggtcatatggggaagctggtaccccgtgaaaggagaccatcaaaggattccattcagattctggcatgagtgaattatgacgcagtctctcccagtaacagggctctatctactaatgagtgcggaacccacttggaaagaatgcgtgtgtgtaatacacatggcttgactaaggctggtcattgagacgagcatttcatcagtgaggtgagtctctctgctccgtcgtgtactggtactctcatcctttgacccctacaccacaaaaaagacttacaatttattcatgtggtaggccttgcacaagaggccgtatgagtagatagatactattgcttttctgaagcaggtattctacaggtttccaatacacaatgtacacccgcatcaatttataacatttcacttcatcttgcccttcattaatttgcaagccctagcagactccaactcctattcttgcacgaaaacgggggtcggaacaacccctaggaatcaacgtgcccattccgataaaatcaccttccatccttactacacgatcaagacgcctcggttaattcttcttcattctctccttaatgacattaacactagttctcagcagaacctccttaaggggacccagacgaggtatacctaactatccgttgagagaaacaccattcgcaaataagcccgaatgatatttcctagttcgggaaaaaaattcgatccggcctaagaaggaaggaaggggcctgtcctgttaggagacaaacttcctggataattcatatataaatacagggggggagatatatatatttgggcgatatttttccgaccc

SEQ ID NO: 698721 - DNA, 656 bp, Homo sapiens
  misc_feature (72)..(72): n is a, c, g, or t
  misc_feature (82)..(82): n is a, c, g, or t
  misc_feature (506)..(506): n is a, c, g, or t
cctcaacggcttcgcaagcgggtgggttatcctggaggcttagtcagcttcatagggacccccccccgtganaagaaagggntgggccagggccagttgctggacagctggaagctctgggctacacaaggaccaggaaattcagaccctaaaaagtcagattggggggccccccaaggccctggaggtttccaagggtgaggagattcagcaaaaggtgcaggacctggagacccgcaattcggagttggagcaccagcttcgggcgatggagcccagcctggagaaggcacgggcaaaacgggaacgggggcgggtttaggtgggccgggcagcccaactgttggacgtcaggctgttttaattgagttaactgggtaagggcctggcccccctggcttagggtgggcccttaaccgggggtggttttttattaacaattccggcctgggatgcgggccaggctgcaggcggcaaaattgggcccctttgtcctggaaagggantggggggtccccacttaaccctgggtgggccgggccgggttgggttggggtgggccccagttgggtttggttgttggcagctttgggggtgtttttgagcttttcattgggtagaatttttagatccccccattacatttttaagggtga

SEQ ID NO: 698722 - DNA, 123 bp, Homo sapiens
tgaattatgttggtctgaatctagagtgatcccgttcgtggcgaggtgcgcacgcggaggaagaggaaaggcacgggcgccgtcgcctacgcacgtgcgtagagcacggcgccgtcctacgca

SEQ ID NO: 698723 - DNA, 747 bp, Homo sapiens
  misc_feature (3)..(3): n is a, c, g, or t
  misc_feature (104)..(104): n is a, c, g, or t
  misc_feature (113)..(113): n is a, c, g, or t
  misc_feature (120)..(120): n is a, c, g, or t
  misc_feature (157)..(158): n is a, c, g, or t
  misc_feature (171)..(171): n is a, c, g, or t
  misc_feature (190)..(192): n is a, c, g, or t
  misc_feature (224)..(224): n is a, c, g, or t
  misc_feature (230)..(230): n is a, c, g, or t
  misc_feature (267)..(267): n is a, c, g, or t
  misc_feature (335)..(335): n is a, c, g, or t
  misc_feature (337)..(337): n is a, c, g, or t
  misc_feature (339)..(340): n is a, c, g, or t
  misc_feature (357)..(360): n is a, c, g, or t
  misc_feature (394)..(394): n is a, c, g, or t
  misc_feature (396)..(396): n is a, c, g, or t
  misc_feature (406)..(406): n is a, c, g, or t
  misc_feature (408)..(408): n is a, c, g, or t
  misc_feature (416)..(416): n is a, c, g, or t
  misc_feature (421)..(421): n is a, c, g, or t
  misc_feature (424)..(425): n is a, c, g, or t
  misc_feature (442)..(442): n is a, c, g, or t
  misc_feature (467)..(467): n is a, c, g, or t
  misc_feature (470)..(470): n is a, c, g, or t
  misc_feature (508)..(508): n is a, c, g, or t
  misc_feature (515)..(515): n is a, c, g, or t
  misc_feature (544)..(544): n is a, c, g, or t
  misc_feature (548)..(548): n is a, c, g, or t
  misc_feature (563)..(563): n is a, c, g, or t
  misc_feature (586)..(587): n is a, c, g, or t
  misc_feature (598)..(598): n is a, c, g, or t
  misc_feature (604)..(604): n is a, c, g, or t
  misc_feature (612)..(612): n is a, c, g, or t
  misc_feature (614)..(614): n is a, c, g, or t
  misc_feature (621)..(621): n is a, c, g, or t
  misc_feature (660)..(660): n is a, c, g, or t
  misc_feature (675)..(675): n is a, c, g, or t
  misc_feature (702)..(702): n is a, c, g, or t
ttnaggcgcagattaaaaatagagttctctgcatctactactcaatttacacgaaaggcggtgctatcacctcccctgtgtggacttgggagaggactgggccnttctccttngagggcngtggggtggcttttagggtggcaaggggcttcctgtnncaatgcgtctccnctttggcctgactattccnnnaacaacgaatgtgcaatcagggtcctcggccnccttgnggacgtttgggggctgctcgcgccaaccggctgctgncaccttcgaccgttccgagtttttagaagtcctgcgtcaagccagaagaaaaaaaaaaaaaaaaaccnancnnggggggggggggggggnnnntaaaagccaatgccaaatctcaatctttgttttncnggcgcaagtnanggtttttntcaanganngggggtgtaactgcaanctaaagtcaatatgtcccgcctaanaangcattttcgcgggtgggacgaatgggagggggccgggnctcggtnataactccttgctttgctagattccacantctngctgggaagggtggnacaggcgagggccagggattggnngccggcccgantccacnacgggagnanctttgcngctcaggggggaagcaattgaatccttgaatctttcatntggtgctggggggcnaggggcaggtgattctcctttctgcantcctggtcgggcaatgccaggggtacatggtgggtgccggccaga

SEQ ID NO: 698724 - DNA, 106 bp, Homo sapiens
tcttatgaataacatacaagtccatttgatggctgctataaatattaggatctctgcatacttactacaaatacaatgcccaagagtcaggaaatcagcctgaaga

SEQ ID NO: 698725 - DNA, 574 bp, Homo sapiens
ttcgcagcccacaggtatatgacgcagcataacaaaaatctgaagctgggatcctttaatatcacatcggcatccaagacctatctccctctacacatctagaaaaacaatcatatatccccacatatgctttaaaaatctcaggcctaaaaacaagacatggatcctatcctatcttaagcaaaagtaacagaaaatggtgaaagaaaatgtcagttgcacgccagccaggtgcgggcagagtccatgtttcgaaaggtaacactggcatgactgactcaatgtcggacccaggtaaattaaaaagtggtacatcaaaatccataaaacaggctgggcgcagtggctctcacctgtaatcccaggacttggggaggccgaggcaggcggatcacctgagatcgcaagtaagagaccaacctgaccaacatagagaaactctgttcctaataaaaatacaaaattagccaggcttggaggcgcacacctgtaatcccaggtactcaggaggctgaggcaggagaatctcttgaccccgggaggcagaggttgcagtgagccaagatggcgccat

SEQ ID NO: 698726 - DNA, 799 bp, Homo sapiens
  misc_feature (374)..(374): n is a, c, g, or t
  misc_feature (398)..(398): n is a, c, g, or t
  misc_feature (401)..(401): n is a, c, g, or t
  misc_feature (411)..(413): n is a, c, g, or t
ctagtaggtagggttagtaggtagggctagtaggtagggttcgtaggtagggttagtaggtagggctagtagtgtagggttcgtaggtagggttagtaggtagggctagtaggtagggttcgtagtcgggttcgtaggtagggttagtaggtagggttcgtaggtagggtaagtaggtagggtgcgtaggtagggctagtaggtagggctagtaggtagggttagtaggtagggctagtaggtagggtagtaggtagggctagtaggtaggtctagtaggtagggttcgaggtagggtcgtaggtagggttcgtaggtagggttagtagcgcgtctgtgctgcttccacctggtgcttcctgttcccaaatcanaagggcctgaaggtggtccctgcnttnctctttctcnnnctctgtgtctcagatggcgatttctgctgacagctgccacgtaaaatgcttcactcaacagtcctcatgtgcccagagatgtctatagaactgtctcgacttgcagcgcatcccctgtcccctcccaaggtcctgcaggatcgtggttctctgctaaagttcagaattccggggaagtgtccgaatccattttatactccaagaagactggtaagtcgctacttggaagcagcttcaaagcacatgaacggcaccaaactgacttaacgggttcgccctcacccgaggtaaaaccagatcttcattccccttgtaaagggaaacttgggcgcagcaaaggtctgcggtatagcactagcaaccagtgcttcaacctttggcactgg

SEQ ID NO: 698727 - DNA, 416 bp, Homo sapiens
  misc_feature (167)..(167): n is a, c, g, or t
  misc_feature (406)..(407): n is a, c, g, or t
tgtttgtaaaccaaatgcttcttgagagcaaaagaaaagtctttctgtgtgggaacacaagatagtaaacttatttaaaaaaccttattagtagaattagtggaaacacttaggttaaaagtgaatcttgtccatataaattatattcattggccgggcgcgggtgntcacgctttgtaatcccagcactttgggaggccgaggcgggcggatcacgaggtcaggagttcgagaccacggtgaaaccctgtctctactaaaaaatacaaaaaattagccgggcgtggtgcgggcgcctgtagtcccagctactcggagaggctgaggcaggagaatggcgtgaacccgggaggtggagcttgcagtgagccgaggtcgagccactgcagcctgggtgacaaagcgnntccgtctca

SEQ ID NO: 698728 - DNA, 140 bp, Homo sapiens
caggtaaacagctatgacaatataaaagacgtgacaattcacaaggtggaggcaggacagaatgtaggtcgcggcaagtaaagaaaatatagacttgaaagagaggcctgacatggtggcttatgcctgtaatcccagca

SEQ ID NO: 698729 - DNA, 319 bp, Homo sapiens
tgtgggtagcacaactagggtcagttttgcaggtgtaagccatttaccaagatagttgtaggtaaagaagggcagatttattagagaaattgtgaaaatatgttgcatgtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 698730 - DNA, 249 bp, Homo sapiens
  misc_feature (155)..(155): n is a, c, g, or t
tctgagctagggtcactaagaattacagcagatgctgttttcttcttccagagaagagaatgcccttctcccctgcccatcacttgaagctgaaacttgaagtatcacttcctactcaataggccaaggccatacacaatgatttagataatggnctgaaagactgcctggaatctaaacccagctttgacacatttactagctagctgtgttattttgggcaggttatttattatttattgtatgtcg

SEQ ID NO: 698731 - DNA, 309 bp, Homo sapiens
ttcaattgggggctactaattgatttgttgcttggatttcctgagaatttctctatttgtaggaagggttttttctttttacggtctgttgatgacaattactttatgggtgtgatgcaccgatggtacccaaggaatgtgttggggaatttcgaaaggaaaccttttctttcttttatctatgccaaaggaaactttatgctgcatgtttagaaccaacattaacagatctcttctggagtgaacagatctagctgtcttggatacaatattttgtgggaaaatgaattacctgcaacatgagtgatt

SEQ ID NO: 698732 - DNA, 859 bp, Homo sapiens
ccctcgccaccactgtcaagctgggagcgggggggggggtcatggaggaggacccttggcttccgtcgtggttcgtctcggtgtctcaagcaggagcagtacggtgcagggactggaggctctggggcgcggaggcgcggcgggctgcagcaggccccagagcgacttgatgaccccctcaccgactgacagagctacgcttcccctcttatagcaaacaccagcagcgcgagtcttggcagggatggggagcggggaggctccaaatccgactccaaccacatgaggaggtcactccccatccagacaaaccctgacacgaacggactccgagtcccacggaaggctcgacaagaactacaacggaaggcaaactcccatgggaatggagcggggccgaaaacacgcgggacgcggagtactagccacagcactgaaacaacacagacaattacaagagcaaatgaagcacgcaaccgtctacataccacagaacagagacaaacatgacaaagcagagagagcacaccaaagaaacaaaacaaaaaaaagacacacaacaaacaacacacacagcgtgcggtccggggcgggcgtcctcccggccgggcggggcggggggggagggaaaaaaaaaaaaaagaacaacaaaaaaaaaaagaagaaaaaaaaaaaaaaaaaagagagaatagacgcacagaagacggtacgcgcaggcgccacggcaaggccgacggccgcctagccatagagcggcctcatcacgcgcgcgacggtcagtaggctgggcgaacatggtgtgacacagagcgtacgcaatcgggggcgacagcatgactacagggagtccctgcacaag

SEQ ID NO: 698733 - DNA, 637 bp, Homo sapiens
gctattctccataggaatagtcgcccctgaggactgattcccatctacaaactgccccagtctacataactgtaggaggagcagaaaggccctgctgccaagggcggtgactgcttccacagaaactctggtaaatagtgagtgtggctgtgcagctgcggagccagcttcctccacatgagggctaaactgaatcctgtctgagagcccagagattggtgacgcagacaatgacagccaattgggaactgccacttaagaggacacacttgcttgggaccaacgggactagggtggagggtataaagggtgctccctgagaattaatcaaaagagctttctgccgcattctcaccggctcctggagtctgagcagttgattcgccccttctcacccactgcccccaaggggacgcagggcaggactgaggactcaagcaacacataaccacagtcccttcccaaggagggctgtcccttaagctactccacagtcacagtcacttcccaaggaagactgtccacaacacagtcacttcctacgtttttcagttctattgtggagctgaaatttcaaccagacctaaatatgtcagtgatgaacaacacacaggacaatggcccatgagattatacc

SEQ ID NO: 698734 - DNA, 220 bp, Homo sapiens
gttcgcgagactcatctgtactctccctcccttagttctgactgacagtctacacaatgtccatggatgatcaaaccctggagaactggagcagatcaacttactgacctgacattgtcatacttgcaaagaaatgtgaaccatcaggaccgttctccggttagctgcaacgttggagcatttcttcatcaacaggatacctctcatgaccccttacatc

SEQ ID NO: 698735 - DNA, 790 bp, Homo sapiens
  misc_feature (567)..(567): n is a, c, g, or t
ttgggtttccccacacaacgtcgatttatgatactatggggggcaacaaacaaatggggcctattacatccaagtatattttcatgcccaggcgtagtaccttatgttccagattgaataaataattcatcaccctggtgtattattcttccatggcaatgcctcccatgttcgctcctcgttctcgggaccagtgattaatcccgcatcagttctgtcgacacggctttatatgcaagaaagcgtccacgcaatttaggtctgagagagtatttataattacgcatgtcaaaacttttacttgaagaatatgtagtagaattagcgttggcggggtgttcatgcccccccgcgcccacaaaaaacacacaaccaaattgtggttctgcacactccagcatcgcccagactcttaacactgaccattgggaggtgtccacacaatcggagctgtcttgcacccactccactagtggaggtgactcggctccctcaccacgcaaatttgactctctcgagtgagacataagtacagaagtctgttgctaacgcactcctcgctctatntttctaataattggcgtggagtagatttcccacgcgcatgggttcggcgtctaccgccgctcgtatgaattcccacaccaccactctgcgggcgtgcacgagcagccagcctcgcgtctgtactctttaggcacgcacggatatctgcgagacgccaccctgcggcctcctcactgtagggaagatcattgtctttctaccgtaaataaaaagaccaaacaat

SEQ ID NO: 698736 - DNA, 518 bp, Homo sapiens
tgtttttgagcccaaggaacaagtatttagtcatgattgccactcgttataggctctgttaacagtgtaaagaaagttggaagttctctcctgagaagaagtaacttcaatgcggaaggacccgggcttctcatgtttctctttgtatcccgaccgccgggaactgccttacctgcagctacaaagtcctgcaagtgaggcttagacccagatcttgtgaactgttttcacatttccccatggatgcctagcaagggactgggactgcctgatccgctttggtcaagagcacgtgggtggcctgtgtgcaggcttatcatcaataattgcaggacttggtggagtatggttgaacaggtgctcagactgcatgcgtgtctagcgaggccatcctgaagctgcatgggagttgtaaaaaagttaccaacaagtttttagttatttgaataggtttttgaatagatttggaatgtgggaagcacttgcagaaataaacgtcttaatgactaaaaaaaaaa

SEQ ID NO: 698737 - DNA, 180 bp, Homo sapiens
actctgctgagaccctccgttcacattcgagcatcagtgccaggcggcactgcgctccaaaactcacaccctacttccttctgcgcaagcggagcctgcgcaccttgctggaataacacagagccttagcatagcaattgcgctgcccgctctataccaagatttctacaaagaatataa

SEQ ID NO: 698738 - DNA, 346 bp, Homo sapiens
ccccctgggggggattgtcttcccatgtttaaccccggtttaataaataaaaattggatttttttggtcctttatataaaatttgatcccctgggggaatttccccatcccggtcccatttttttggcttttataattcccatggtttttttttttttaattaaatcccaagttacccttttaattggtgggctggtttttttcctttttttgaaggtttagccttttctggggtttttttgtgaatcctcccgcccttccaatttgttttattattgtttgatgaaaactttttttttgggggtggttctggagttggttgggccattaaagttttcttttttta

SEQ ID NO: 698739 - DNA, 586 bp, Homo sapiens
ttaaaatgactgacaagttgctatgaggtgtccatagagtgttcaaggtcataaagacagtgtgtgagagtctatattaccagtgcttacattcttattcaaagtctatcacagatgtacacagttggagtaagaatagtcatagctgtgtagaatactggcatcttcatcatcaaaggacaggtctatgaaccagaatatagagcttgccaactgctgacactgcaatgtctcagtatctcgtggacatcatatccgttctgcttccgttctcgtagctgaagtatctcccaaaatgtgtgttcatgcaggggtatgcatgtatagtcgtcgcaataaactcagattatttacattaggtcaggtcatactttgcaaaactcgtctactatcaagactttatgtgcgaaatctctcatgatgtagatatagcttcgttgcactaacagacagtgtgtttaagccctgttgctaggtcgccggagttaggaaggaccgtgtgtccagttggcactttccgtttcatatgcatactctgagttaatagagtggtgtctgtgtgtcgacagcgaagaggagtgcatag

SEQ ID NO: 698740 - DNA, 128 bp, Homo sapiens
gaagaggactctgagatcatcagcgatgacatcagtgacatcttccgcttccttgacgacatgagcgtgtgcgactcgctgggcgtcatccaatcgtcgtgctacaacagcatcggatctctctctca

SEQ ID NO: 698741 - DNA, 626 bp, Homo sapiens
cccggctgggggaactaaactttcatcctccatctcccggtcccggacggccccctagaacgcgggcaagagtccgtgtgagaaccgggacacctgtcctgttgaaaagggggacgcaaaagctgaaaatgcccggaaggatatggcttccttgaactgcgggacgtgtagctgcagctgtggggtggaccatggaaacagctccatcagaagtaccagggaggactctgacaggcctggcctggatcagcaggaagaagagatggaagcaacgccatggaccttcacgtccttcagagtggaccataggggctggcagctgaagaaggtgacttggcccctctctagagggtgaacgcaggatcaattcaaggccatgaagtggatgcagctgggagagcctgcttggtgcttttaaacctcaacatgtcaaccgcaaatacctcaaacactgctcacaccgtggtaaaatctagttgcgaaacctgtcccgtggcagccttctccatcccaggtgcccaggccccatctcctgggagcaggcagctctccccaccccgattcatgtccctcctacagcccaaggcaactccctgccaccttggtgaatgaagcacatcatgctg

SEQ ID NO: 698742 - DNA, 752 bp, Homo sapiens
atgtatatttcagtgtagctagaagagaggaatggtagtgttcctagcacaaataacagataaatgtttgagttggaggctatcccaattaccctgacttgattgttctaccttgtacatatatcaaaatatcatatgtaccttcaaactatgtacaactatgatatatcaatttaaaacaagaatctttgggtgggcattattattagtctttttttatagatgaggaaaccaagactaccttgtatgttttcacacaagtagaaggcaaactcaggacttgcatccaggttcgcctcaagctaaggtcaatgtggtagtccagtgtagtaagttaagtaataggtattttgaggcggaatgttgttctgtcactcaggctggagtgcggaggcgtgatctcagctcactgcaacttccgtctgccgggttcaggtgattctcctgcctcagcctcctgagtagctgggatttgcagaacactcaacacaagcccagctaattttggtatctttggtgggagatgcagttttcaccctgttggccagacttggtcacgaaaaatcctgatctcaggtgatctgcccgctttggctcctaaagggctaggattacaggcgtgaccattgttgccggtcacaaagctaaggccatgggtttaaccaatgtttagcatgtacaggtgaaatgcctttaagtttgagtctcagaaagccttagtggttcagacattttatacttcataaattata

SEQ ID NO: 698743 - DNA, 1024 bp, Homo sapiens
  misc_feature (3)..(3): n is a, c, g, or t
  misc_feature (6)..(7): n is a, c, g, or t
  misc_feature (12)..(12): n is a, c, g, or t
  misc_feature (16)..(16): n is a, c, g, or t
  misc_feature (19)..(22): n is a, c, g, or t
agnggnnggtcntcgnagnnnntgggacgcgactgcagttaccgagtttctaaggcctcgtcccctgacgggaaggcggcgttggggggcggctgggtttacccttcgaggagttagaaaacaccaggaaaagggttgttcccacctggaagagaaatgctagagcaacacaccatcttcctcaacattatcatctgtctctggatgacaatgaaattcacaggacactgattgtctttttatcccattggacatcgtgatagtctacaatactgataacaccatgatgataggatctgaagacctggaagtaccagaggcagggtttcgccatgttgcccaggctggtctcgaactggacgcaagcaatcctcctgccttgacctgccaaagagctgggattactggatcagcaggaagaagagatggaagcaacgccatggaccttcacgtccttcagagtgtgggtgggcttgggctttgcagtgagagcaagtatcacccaggatggagatgggaggtaatgggtggccccgacaggtgcctcctactgctggcagcaaggagagagtgaagaggcagaatttccttggtctagactagagtctgggtcatgggcatggcagtgcttgagcttttgaccagaagcaagtggacatggatttgagcttcgggtaagaagggagacttctctccagggaccataggggctggcagctgaagaaggtgacttggcccctctctagagggtgaacgcaggatcaattcaaggccatgaagtggatgcagctgggagagcctgcttggtgcttttaaacctcaacatgtcaaccgcaaatacctcaaacactgctcacaccgtggtaaaatctagttgcgaaacctgtcccgtggcagccttctccatcccaggtgcccaggccccatctcctgggagcaggcagctctccccaccccgattcatgtccctcctacagcccaaggcaactccctgccaccttggtgaatgaagcacatcatgctg

SEQ ID NO: 698744 - DNA, 857 bp, Homo sapiens
  misc_feature (3)..(3): n is a, c, g, or t
  misc_feature (6)..(7): n is a, c, g, or t
  misc_feature (12)..(12): n is a, c, g, or t
  misc_feature (16)..(16): n is a, c, g, or t
  misc_feature (19)..(22): n is a, c, g, or t
agnggnnggtcntcgnagnnnntgggacgcgactgcagttaccgagtttctaaggcctcgtcccctgacgggaaggcggcgttggggggcggctgggtttacccttcgagagtccgtgtgagaaccgggacacctgtcctgttgaaaagggggacgcaaaagctgaaaatgcccggaaggatatggcttccttgaactgcgggacgtgtagctgcagctgtggggtggaccatggaaacagatcagcaggaagaagagatggaagcaacgccatggaccttcacgtccttcagagtgtgggtgggcttgggctttgcagtgagagcaagtatcacccaggatggagatgggaggtaatgggtggccccgacaggtgcctcctactgctggcagcaaggagagagtgaagaggcagaatttccttggtctagactagagtctgggtcatgggcatggcagtgcttgagcttttgaccagaagcaagtggacatggatttgagcttcgggtaagaagggagacttctctccagggaccataggggctggcagctgaagaaggtgacttggcccctctctagagggtgaacgcaggatcaattcaaggccatgaagtggatgcagctgggagagcctgcttggtgcttttaaacctcaacatgtcaaccgcaaatacctcaaacactgctcacaccgtggtaaaatctagttgcgaaacctgtcccgtggcagccttctccatcccaggtgcccaggccccatctcctgggagcaggcagctctccccaccccgattcatgtccctcctacagcccaaggcaactccctgccaccttggtgaatgaagcacatcatgctg

SEQ ID NO: 698745 - DNA, 90 bp, Homo sapiens
aattcaagcttctaacgatgtacggggacatgtttcttgtgaagggaaaataaacaaggtccagttttattttactagatagcaaaaaaa

SEQ ID NO: 698746 - DNA, 99 bp, Homo sapiens
gcggccgcctactactactactactgctcgaattcaagcttctaacgatgtacggggacatgtaaaagacaaataaatgatgacttcccccaaaaaaaa

SEQ ID NO: 698747 - DNA, 422 bp, Homo sapiens
  misc_feature (294)..(294): n is a, c, g, or t
cccggctgggggaactaaactttcatcctccatctcccggtcccggacggccccctagaacgcgggcaaggtatctaggccgacggcccctcatggggacccaggccttcttactcttttgggggtacattcaaggcttagaggccaccccagacaccatctccggaagagtgacgtcggaggacgagggggcaacggaaaggtcaaaaagatctctgatggatttgttgactcctctgtgggagaaaggcttggtctactgcaggtgttaacgctaagccaggctggagctgnggacgtcagtttcctcagctccccgctgttcgcttcgaacgtgacctcgacgtctgctctccccttccctttagctgacaatgtgacagtgcttgaataaaagtcagtctgacaggaacggtaaaaaa

SEQ ID NO: 698748 - DNA, 239 bp, Homo sapiens
  misc_feature (25)..(25): n is a, c, g, or t
  misc_feature (57)..(57): n is a, c, g, or t
gttccctgcaggctgtatcatttgnaaatattttctcccattccaaaggctgtctgntcactctgttaattatttctcttgctgtgcagaagctttttagtttagtcccatttgtctatatttgtttttgttgcctgtgctttgagatcttagtcaagaattctttgcctagaccagtatctagaagaagagttttctctaggttttcttctagtattttcatagtttcaggtcttcct

SEQ ID NO: 698749 - DNA, 337 bp, Homo sapiens
  misc_feature (209)..(209): n is a, c, g, or t
ctggaagagggccttgggcaaggcgtgaagcgattctgaatctggttcctattgttttttattttaaatggagttgtctatttggagtcaaggcaagagtgtttagtcttggccctcctattacagatctctgatggatttgttgactcctctgtgggagaaaggcttggtctactgcaggtgttaacgctaagccaggctggagctgnggacgtcagtttcctcagctccccgctgttcgcttcgaacgtgacctcgacgtctgctctccccttccctttagctgacaatgtgacagtgcttgaataaaagtcagtctgacaggaacggtaaaaaa

SEQ ID NO: 698750 - DNA, 321 bp, Homo sapiens
  misc_feature (3)..(3): n is a, c, g, or t
  misc_feature (6)..(7): n is a, c, g, or t
  misc_feature (12)..(12): n is a, c, g, or t
  misc_feature (16)..(16): n is a, c, g, or t
  misc_feature (19)..(22): n is a, c, g, or t
  misc_feature (193)..(193): n is a, c, g, or t
agnggnnggtcntcgnagnnnntgggacgcgactgcagttaccgagtttctaaggcctcgtcccctgacgggaaggcggcgttggggggcggctgggtttacccttcgagatctctgatggatttgttgactcctctgtgggagaaaggcttggtctactgcaggtgttaacgctaagccaggctggagctgnggacgtcagtttcctcagctccccgctgttcgcttcgaacgtgacctcgacgtctgctctccccttccctttagctgacaatgtgacagtgcttgaataaaagtcagtctgacaggaacggtaaaaaa

SEQ ID NO: 698751 - DNA, 139 bp, Homo sapiens
gcaaaaaccattttcaagaggctgtctgatatgttaaatactccctctcccagatgattgaagtcaatatataactagtctatactattatgtcactatacacagaaatgttagagttaaaaaataaaagtacacaggc

SEQ ID NO: 698752 - DNA, 113 bp, Homo sapiens
aatgcagcggactcggcaggagaaggagataagagacacattctgaatgcagagaatgacaacactaacaaaggcattgaaatagaggagggtatcataacgcaaggtgacat

SEQ ID NO: 698753 - DNA, 113 bp, Homo sapiens
ctgtaaaatctttaaaatacgagatgcactcgactcagatgtgaaagtaataaagtatacaaagacatgttgttctataaaactatcttcgtaaattatctgtctgacggatg

SEQ ID NO: 698754 - DNA, 285 bp, Homo sapiens
catggatgaaccttaaaaatattatgcttgggtccagagtttcagtatgggaagatgaaaatagttctggaaatgtatgacgttgattattgaacaacaatgtgaatgtacttaatgtcaatggaatgtattcttaaaaatggttaaaatggggccaggcacagtcgctcatgcctgtcatctcagcactttgggaggccaaggtggaaggatcgcttgagtccaggagtttgaggttgcagtgagctatgagagcaccagaacagtctagcctgggtgactttg

SEQ ID NO: 698755 - DNA, 1376 bp, Homo sapiens
attctcggacggccctgacgcagccatggcggaggcggctttggaagccgtgcggagcgagttacgagaattcccggccgctgcaaggggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgcccggaacctaccagcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcatggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtg

SEQ ID NO: 698756 - DNA, 174 bp, Homo sapiens
atcgtgctggtaattgggagttagagatggtagcttcccgactgccccattcgattttgttctgcactgtcattagcccagttttgctcacttgcttgcttgtatgtacattgcgacaagaagaacttgctttctgtcgccagataaccaagctgctaccacaggaggcagaca

SEQ ID NO: 698757 - DNA, 343 bp, Homo sapiens
gtgaggtcatacccagccatttgaagctggaattttaaccaaagcaatgactttgtaccagaacccatgtccttaccttaggaaatggtggccttacagtgacaaagagaaggatatagaaactttaaagccgagaaggccaaaccaagaatggggacactgtgcagagaatattatgagagaccaatactagaggtcagggaagaggagagcaataagagaggaattcagaaagggatatttaacatccatggagaacaactcactctagtttgcagctgtatttaacatcctcaatgtcacaagttttcacacaagggcatttgaaaggttaaaagttact

SEQ ID NO: 698758 - DNA, 490 bp, Homo sapiens
ggtttgctgtggctgtgcgggttctggggctgcggtgatgccggtacacctctcggtccttgcgaggaccggagagcatggacgatgtgccgcagccgttagggtggagtcacgggtccagttggtcgactgtgaggatcttgtccccctgccctgaggatgcggctgcggtgcccggctggtcgcgcgcagtgcgcattccttcagttggggtacctcgtgaacccgcacatcatccagttagggtccccagaagcacgggcgtgttgtttgcccggccaggatgcttcatcttccggatcgatccgggaatggggcagaggcaggccgggttggtgcgactcataaacaagctcttcaagacaacctggttgaatgtggagtcggtacttctggccagaaagctgtataacttgaccaagagcctcaggtagatatcctggctcttgggctccatgcgccgaagctttcggtccttgttatggcggat

SEQ ID NO: 698759 - DNA, 1981 bp, Homo sapiens
ccgggtccaaaacctccatccggagccggcaggagaggagaacgatgtttaactcggtcaacctgggcaacttctgctcgccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccaacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcgcctgagccgaacaatcctcgaactaaaagccttcccttgcccatgtgaaaagatccgctaagacagatgtctgccagcggaaacttctcgagctcccccctctaccccgccccaccttgccccactactttagggggcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaaagcagtgcccacttcatggatttatagctatagtctatgcagtcgttacctctttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttc

SEQ ID NO: 698760 - DNA, 415 bp, Homo sapiens
  misc_feature (342)..(342): n is a, c, g, or t
ctgagcaagagagacagactctgggtcaaaaaataaataaatacagtaaaataaatcgcatgggacgaaaggtttcgtgggtagaaaagcatataacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaattnttttccttccacagtgtgaccttggagatacctcatcatatcacacaaagagatgcagatagatctttgagca

SEQ ID NO: 698761 - DNA, 142 bp, Homo sapiens
agaggctcacctgggcagtgtgggtgctgttccagtctgtcagatgctcacctgagggtggggtttctgttccaggctgtcagatgctcacctgtggggtgtgggtgctgctccagaccatcacattcgcacctgggggtgt

SEQ ID NO: 698762 - DNA, 109 bp, Homo sapiens
tgggcaactgagacaccacttgggaacaccgagccccccaagggcaggttctgggcctggtccacctaagcctggtctccacctacctccatgcacagtaggggcccag

SEQ ID NO: 698763 - DNA, 1186 bp, Homo sapiens
gggtagacacatcggagagcgctgctgggcctgttgtgtaagtgcagcttgtgtcactggactagtcttctaggcatatccggcgcatgtgttgccgatgtggggtcctcgagcgggtccctggtgcctggccggaggccgggggcgttctggtgggcctcttgatctaggtcgtgcctgcatgagggggtcgtgtcgtccaggtgatccggggacgagtgggcccatgtgcaagattaggtctagccatgcggttacttggaccaagcaagtgcctgattcccagcgtgcaaagagacaagaccggattcctggtggagaagcgctgctggggacatcgccttgggtccccgtcaaacagattccccattgaatctcttcattcatgttccattgggcaggcaatacttatctcccattctttcccgtactattgatcggtgtggtatggattgggcccttggagaacccaatttcaagggcactttattgggcccatttttcaaggcccacacttgtcacaacggagtgtttcacagacacacgttccaaggcgcaagaaaagttctctttcaagcgggacttggggtcgtaaatcctcaattgggcgaaactcttggagtggggtttctggcgcaatctcgggcttggtctaaccaacgggtttgcccaagtacccactgtgggacactttgtttttaaaccctttaacacaaatttggccatttcgcggcaattatgggcggataaagcgccctttccacattttggaaaggcccccctccttgtgaaggaagacaatttgggcagatttccaacgtagggttggcgacaaggaaccttgcatcttattggtgaacacaccctttggtcacactacaagggcccggtgcgtccttggtgttgcgccgctaaacatgagtaaatctcggggagggatcacattgaatcttctaacacagtttcccgccttttcgttttaaaagagcccccatgttgtgggtatcccataataaaacggaaattaaacgtctccgtttataacagggctaacattttccacccttattaattgtgttgttatacacaaaggtagatgaccaccaaaaaaagagctctcgtattatatcaaccaccagtgtgatgtggtagtagttagcaacaaagggacgtgcctcttcaggta

SEQ ID NO: 698764 - DNA, 178 bp, Homo sapiens
gtggtcctagactgtcttctaccagctgcagtcatttcctacagtgtacacgaggacaccccggagctttgaacggcgtggattgtgcaatcttcgggtccccatacccaatgacaatggcgctctctgttctagtaactatagaaatgtgtaacgccctcaacagcttgtccgaaaa

SEQ ID NO: 698765 - DNA, 192 bp, Homo sapiens
ggatgagtgaggcgtgaagcggatcgtggtggaaggaacacattgatgcgagatatctgggtctagatagtatctagtagtctgcttccagtgtattcacagccgggacaagatagcaagaccctgtctccacaaaaaataaaaaaattagcagggcatggtggtcccaggtactcaggaggctgaggtgga

SEQ ID NO: 698766 - DNA, 238 bp, Homo sapiens
actcagtttacacaagtacttagcatgtcacacggcgtctgtatttcagatacacagtaacatgcgtgcaggtttgtagcctagcagcaataggctataccagatagcctaggtgtgtagtaggctagaccgtataggtttgtgtaagtcactctatgatgtttgcacaacgacgaagtcacctgacgaaggatttctcggtctgtatccctgtcattattggtggtgtaaactgatg

SEQ ID NO: 698767 - DNA, 795 bp, Homo sapiens
gttttggattccatgacagctggacccggcttctgcgtgggaagagtgtatcacagccatagggaactttcttcacccatcaaagcctcagggctgaagcatcctgaacaagaactcaggagagtgaaagaaacagttacctgtcggctgcagctggtaccagctccccaccccgtacagagaccgaagcgtcctctctctccccatcacccagcaccagactctgccccgcgacctcagcctgcacctgcttcctggctccatccagccttccagcctcactagatcatcatgggccactggccaacacacagggcagtgccgagcccaggccgtggtcacacatggctgggttagtagctgaaaacattgtttttcactggcctcacagtaatggcacctgcccccattttctgtgattgaatttttggatcctgctaccaggttatgatagattttatggtatgtctcaagatattgagataaaggtaataaaacagctataaagtcctggctaaaaaaaaaaaaaaaaaaaaaaaaattaaaaaaaaaaaaaaaaaaaaaaaaaaaaaaaaaaaaaaaaaaaaaaaaaaggaaaaaaaaaaaaaaaaaaaaacatgcggccgaaattcgggctaatttggccaattcgccctatagggagccgattaaaattaaactggccgcggttaacaacgtctaaattggaaaaaccttgcggttcccaaactaaatggccttgaaatccccttttggccagttggcgtaataccgaaggccccacctcgccttttc

SEQ ID NO: 698768 - DNA, 793 bp, Homo sapiens
taaaccctgaagccccaaaagggaaccagggtttaatacttcatttctggttaaataacagccacacagtggggggtacccagtgaaactattcccgtgccaggttaggaccccccagttggtggtctataaaataggacccgtgccaggcttttagtttggacccaaaacctcattctctcaggtctcctccctcaacatcttattcgtataagagctccgggtggtgcgtgtataaataccaggcgagtggaacagacactcaattaaggaagcggtattggagtgaacagcccgggctacaataggtgtgttggcagccccgtgcactcaaattcacacgcctcttttattccccagtgggtataaatttcttataaaaagctgtggcccacaactccccaacatcagtggtggatgtggtgaacaatttcctcccaaacactcttctcaaatattatttcagtgtcttatcaaagagggcacatttaatcatgaggggcaagtcaaacaatattccctcaaagcgtgtgccctcttttgtagaaaagctccaccggtgcttcacggcgtgcctataaaaatctccactctataacaatagacgaggagtttcccgtgcccaccacagtccctttccgaggtgtttaaaaaacaaaaggtagaacacccatttgtatgtgccccaaggggcccttttgaaaaaaatacgggtaaggtgccaagagattgccaaaccaagaaataaaactgggtggtacgcaggtgtcacctttgggggaaaacgctttga

SEQ ID NO: 698769 - DNA, 337 bp, Homo sapiens
gacttctgcacacctggtctgctgagcctctctcggagtcccggagaccagccccacaggagggctgcaccaagctccataactgagcatacaccatcacttatttctccccagccataggcgaggcactgcagacactatcctagggccctattgagttagtatactagacagccttgtgaactcagcatatacacgccattcctatatattacctactcttaacatctgaaatgcctggagcagcttgcttcactgactggactctgagcgggacaccatagatctcggacacgcataaggcttatttacacatcagagtatgatttttttaaac

SEQ ID NO: 698770 - DNA, 144 bp, Homo sapiens
ggggggccccttttttcccccctttttgggggggtttagccagaaaattttttttccccccgaaaccggggttttcttttacccaaattttcccccctcccttcccccttcccccttgggccccaaaagaaatttccttttcta

SEQ ID NO: 698771 - DNA, 765 bp, Homo sapiens
ggtccgcccgggggctgccgcccaccgcgcctcgctcgggccgttgccgtctgcacccagaccctgagccggcgccgccggccatggaggtggcgcctggagcagcgcgcgcatggactggctgcaccctggccgatgctgaactgcgcagacaccccgactcacaccagcctgggcctggcgcacaactacatggaacccgcgcagctgctgcctccagacgaggatggacgtcttcttcaatcagctcgactcgcagggcaatcccatactatgccaagcccggctcacgcgcgggcgcgcgtatcctacaggcccgcgcacgcccgcctgagcggaggccagatgtgccgccacacacttgttgcacagcccgggtttgcccttggctggacgggggcaaagccagccctctctgccgatgcggcccaacagcacaagcccgtggaccgtgaggccccttctccaaagaacgccagtgaaccaccttcagcttgctggagggccctggaggcccaatctctgtgtagccaggggctggtgagagattgggacgccgagggagacgggcacgcagaaggcagcacaagatggggacatcacccgtacaggccgcaaaaaagggaaagcggccgagctacgtggacaaaaccgcgaaacgattaaacgggggactaccccacaagcgcccaaagggacacacccagaagaagagaacagatggtcagtcgcctgaaggccctaagagagcgtataggataggag

SEQ ID NO: 698772 - DNA, 104 bp, Homo sapiens
cgtgccatccacagtgcttaatgtgtacaacattaaaggcatggaccgtacaggaaagaaggcagactgttaatgcaaatacaactgaagtgtagacaactgct

SEQ ID NO: 698773 - DNA, 195 bp, Homo sapiens
tttttaaaaaagggtttaacttttttttaaaaaaaaatcttttaactggcccttattacaagggcccccataaagttgccgttaggaaagggatgggcagggaaaaactagtttttagggtctttaaataaaaacatgaggctaagggttggttttgtttttgttttttccttaaaaaattttatgctttatgga

SEQ ID NO: 698774 - DNA, 859 bp, Homo sapiens
cacgcagctgttcatcccctgcttaatgtactggtgagttccttgaagccctgaacctgaggacttcttgtgtactttaacacttttgttatatctgaagatattctgattggcaacatttttaacatagagaactgtttaaacgacaaatacctgccagcacacaactcatccacaaattgctgtctcccgaaaaagatggcgaggctgtgactgagatcatcagagaaccagcccggcaccccaaacataatagggcaaaggagtcagatgcgaatcccgtccagtatgagacactggaccaacaagacaggacccttgacctcagaaatgcaggaattcaggactatcctagaacatgaagtagcagacgccgtgccggcagacattcatagcactaaactcttgcagcactttcccccgaggactctgcgctgtctccacaacggcctctcggactgccaggctgtgaaagggcaccaaaccggtacccacgggcacagggacgtgcccccacccctacccgcagtgagccacgcacggccccaagctgccaaccatccaaacaccgggcccctgcgcaccctccccccatacgggatacaccaattcacccaccatcccgcaccatgccatctccactgcaacccactcccacttcctcccccgaccgcacaatcgaaataacaccactgccccaggcacacacgggcaacatcacacgcgccgcagcgcggccccagccgcaacacgcccacaccgaaggggaccaaaacagcacagctcccacgccacccgccgccaccgcacagacgagcacccccacctacaccacaagggccacgccaccacccaccac

SEQ ID NO: 698775 - DNA, 357 bp, Homo sapiens
agcagcagcagcagcgtccagttcgagatggttcaaaaaaacacgtttaaaacccccagctgtgacatgaccccaaagcagtccaaagtggtaaggccatcctgtggcttttgaaaatcaagaaaaggggcaagaaagagctcccggccagagcagaagccatcatagtttccctggaagaaaaccccttggtgaagaccctcctggacgtcaacctcattttttgcgtgagctgccccatctttatctggggctattttgcttagtgtggggtgaacccaggggtccaaactctgttttttttcagggccccatttttttaatgaaaaaaaaaataataaagcttttgtttcccca

SEQ ID NO: 698776 - DNA, 273 bp, Homo sapiens
  misc_feature (17)..(17): n is a, c, g, or t
  misc_feature (19)..(19): n is a, c, g, or t
gggatatagcgcttttnanttgggaaaaaggctatttgacccaaaataagtacatttgtcatgaactagcactgtgtggaaatgaatgtggatactggtcctgtgtcatttgggccacttggatgaaaaatggaaaggatccagtccaccttcagaaagggaaaaatggcccttcctgtactaagggacaaggtaacaccttagagctagtaataaccaatccccttgatccacgctggaggaaaggggagcatgtaccttagaatcaatggg

SEQ ID NO: 698777 - DNA, 310 bp, Homo sapiens
gcaagtctccgctgctgtggaaaacaaccctgctgattggcttaacccatgtcaacccctctgcaaagcttttattgccacagatgaagacattaggaaacaggaagagcgagtgcagcacgttcgcaagaaattggaagaagcactgatggcatacatcttgtagggagctggtgatacagaagagatggatattgaaatggacaggtggtgatgacgccctatgaatttgatcaaggaaactttcaaccgactttccccaagagaaaattctctagaaatggaacaaaaatgtttccactggcctttt

SEQ ID NO: 698778 - DNA, 837 bp, Homo sapiens
tgagtgcagcagcagcccctgtagccaggagtgtgccaacgtctacggctcctaccagtgttactgccggcgaggtaccagctcagcgatgtggatgggagtcacctgtgaaggacatcggacgagtgcgccctgcccaaccctgtggggcccacatttttgctcctaccggttgcataaacatccctggaaggcttccagtgcagctgcccctcgtcttgctaccaggcttgggcccccaaatttgccgaaaattgcccaagacaattgatgagtgtgtgacttgggcatccacaaattgttcaaatcaagaagacctgtttcaacattccagggcggttttccggttgctctaggcctttcgaagtgcccttgaagaactaacgtgcgttccgggagccccaaccctgttgtgaagcgctttgcctttgcaattgagaatcggggagtgctccaagcttggctctgagaattaacctattaccactctttttccccaccaaattcaagccgccgcgggtggttttccgcattgggcccctccatgtgctgccccggggacagcatgcaggttgcgatcaacggggcaattgagggagggcttttttcaccacccggaatgtgagcccccacagtggggtgtggtgcctcaaccaagctgtccctgagccagggaatttgctcctgacagtcaagatggatctctctcggcaagggacgacagctcctttgtggacaagcttaatctttgtgtctgagaagttcgagcactccgctcgggtgggggttcctcactgtgtttctaacttgcccggggtaaaagttagaacgccccgt

SEQ ID NO: 698779 - DNA, 160 bp, Homo sapiens
  misc_feature (4)..(4): n is a, c, g, or t
  misc_feature (14)..(14): n is a, c, g, or t
gagncaggtgtctnccttgcctacgaggcctccctaaaaacaacgccgcgttacactttttctaccgagggttgttgtgtgacacagcagatgtgttggaagtgatggtgtgtcacttctgaggttaggtcattaaagacgcagcggcttctaaaaaaaa

SEQ ID NO: 698780 - DNA, 1260 bp, Homo sapiens
acgctgtcactgatacccggaaggacgagcaggagcgtagcgatcaccgatcaagtcaacatgcgcatctcccatcttctacgagctctcggagaatgacttgaacttcatcaagcagcagcaaggacggtgccggctatcctcatcaaactacatatgactcccccgggcatagtcgacttactcctcggaggtgactgctagctctctccgagtacaccgactggcagcattgggcaggcaggatggacatgcgtgtcagcgccgatgcttgcgatgcagaacaggagaccacgctgccagcgggcagcgccatatgccgagacaacaatcaagcactgctgcatcgactgaatagaacacagaatggaaccgccgcacctgccatggcagccagacaggcaagcgacgcaccgaaggacgcaacataagcaggagcatcaccaagacgcactcggctggacgacaccgctgaaccgaatcagacaaataaccaagcacataaccgggccagacggccgccgaacgaagccgagcgccacacataggcgagcaacaagactgccaagaacacggaatcccaaggctacctacgcgcacacccccgcggcggacctaaggaccgacccacggaccttcccaccgcggcagcaggcacaccaccccatggacacgccacaaacagccccgcccacatgcccaaagagggccccaaagccgacccacccggacaacagagcgagggaagtaggacaccacccacgagcgggccccaggaccgcacacagcgaacccagacgaaaaggtaagcaagggcacacatgccatgacacgaaaccaacctagaaaagagatcagacccgcgaccaacccaggcaagaccaacagccaacacggcacaaaaaataccacaccacaagctcagcaaaaccgacagccccacacaaaagagcaaagcacaccagcaatcgacaacaacaccacgcgccaaagcagaaaaccggaaacacccaagaactcacacagcgcaccagaaagacggaaacacgagcaaccagaaccacaacgcgggcacacagagaaaacacctaccggcgaccacaggtaacaatacaactgagacacaagcgtggagaacggcaatagaaaacggacagcagagaaggaacgcgacaaggaacggaagagaacagaccacaaaacaaaagaacaacacagaaacatccaagaacagccagagaacgcaggaaacacgacagg

SEQ ID NO: 698781 - DNA, 159 bp, Homo sapiens
tcatcaagcctgccgtgtaagatggtgcaagtcctagatacacagctagccagagtgaatacacttttttctccaaaatgatgccttgtgagtggggacgtggtaggggtcaagagctcccacctctaaggggcacacactcgacttgcttatgccact

SEQ ID NO: 698782 - DNA, 111 bp, Homo sapiens
  misc_feature (103)..(103): n is a, c, g, or t
ggcggtgatctagaggatccgatttcctaaccttctcattcaagagacatttaacttggtaaccttctttttaggtctaagaagtctcctggtgagccagttngactgtgg

SEQ ID NO: 698783 - DNA, 347 bp, Homo sapiens
tggtagtgcacgctcgtgatgtgggcgggctggagcagctcgtcgacggactggtaccagggcttgccggagatggcctcgaccacggcgcccagcagcacatagccggagttgttgtaggcccatttctcgccgggcgggaagtccacaggcaggtccttgaactccttgatcaactcggccgtgctgaggtcgcgccgcaccgggttgcccatatagccggggatgctggtgtagctcttgacgcccgaggtgtggttgagcagctgtagcagcgtgatctggccgccgttgggatagtagggcaggaatttagatacggggtcatccagcttcgccttgccctc

SEQ ID NO: 698784 - DNA, 397 bp, Homo sapiens
gacagagaactataaattgcggaattgtaaaagctggaaacaaatccccagattatctatgacaacttcctcattctatggatggaaaaactgaagcccacgcatatttatgaaaaagagggtccactgagctttctcaaatagccgtctgacttacagaaaatgaactcccagtctaacttgaaaggccgtctgtgtgggtcaggacaagcaccagccctgctagggaagggagacagtctacagcctctgttaatgtctgcagagctccatttatgttggcagctggtgaaaggggtacacctgttttcctctgaggtaataatcgtgatcacggtgctcatatacctgatatgtgttttccacttcctctgattctacaggaccaggacagaaa

SEQ ID NO: 698785 - DNA, 213 bp, Homo sapiens
  misc_feature (33)..(33): n is a, c, g, or t
  misc_feature (47)..(47): n is a, c, g, or t
  misc_feature (60)..(60): n is a, c, g, or t
  misc_feature (75)..(76): n is a, c, g, or t
  misc_feature (101)..(101): n is a, c, g, or t
  misc_feature (130)..(130): n is a, c, g, or t
  misc_feature (147)..(147): n is a, c, g, or t
  misc_feature (151)..(152): n is a, c, g, or t
  misc_feature (179)..(179): n is a, c, g, or t
  misc_feature (186)..(186): n is a, c, g, or t
  misc_feature (190)..(190): n is a, c, g, or t
  misc_feature (201)..(203): n is a, c, g, or t
caaccagctgtcactgcaggagctgcagaccancagccccctgttcncgggcgacgtganctgcgtgtgggactnngggcacagtgtggagcagtatggtnccctgggcggcactgcgcgctccagcgtngactggcagatccgccnggtnngggcgctactgcaggcacagcaggccnaggtccncccncacctgccccnnnataaagtggc

SEQ ID NO: 698786 - DNA, 425 bp, Homo sapiens
atgtgggcgggtggaacgggcgacgggtctggcacacgtcttccatgggcctgggaatggtggccgtccccgtgtaggcccgcctccatcccccgtgtccccgctccattccctgtgtctctgctccgtcccgtgtctctgctccgtcccgtgtctctgctccgtgctcgtgtctctgctctgtcccgtgtctcttctccgtccctgtgtctctgctctgtcccccgtgtctctgctccgctcccgtgccaaccgccgtcgagctgcccatttgctctcccattccacggggatctcgctcgggtagaagcctttgaccaggccggtcacgctgacctggttcttggtcatctcctcccggcatgggggccccggtgtcacctttggttctcggggctgtcctttggttttggcgatagtttact

SEQ ID NO: 698787 - DNA, 450 bp, Homo sapiens
aaaatacgctttttcccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagt

SEQ ID NO: 698788 - DNA, 743 bp, Homo sapiens
ggggaggggctggtgtgcctggtgcgggagctacggggcccagcgatcgtgtgtaaagtagtgcttgtaccaacatgtcccgtggttccagcgcgggttttgaccggcagattaccatgttgtcacccgagggtcggctctaccaaagtagaatatcgctgtataaggctattaaccagggtggtcttacatcagtagctgtcaggagggaaaggactgtgcaggacttgtcacatcagaagaaagtacctgacgaataatggattccagccagcagtgagctcacttattcaagataactgaaaacatgggttgtgtgatgaccgagatatgacggctgactaggagatcccaggtgacaggagggcagcagctatgaggtagcataggttggaaatacaagtatggctatgagattcctgtggacatgctgtgtaacagaattgcggactatttctcaggtctagacacagaatggtgaaatgaggctctatggaggtagtatgatccttaatgggtatgagatgagagagcgaggggccatcaggtgatataagttgtgatccgtgcggggtctactactgtgggggtttagtagccacatggtagcgggagttgaacaacacgtgatgtcaaacaagttcctgtggaaaagacacatgtggagaagaagtttgattggtcggtcttgagcagacggtgggaaactgcaaggtagtgcctggctagtggtctaacagtga

SEQ ID NO: 698789 - DNA, 217 bp, Homo sapiens
  misc_feature (90)..(90): n is a, c, g, or t
gcggccccctagtttagcaagttccaatagccatattaattcataaatcaattttttccgggaaggatgtcagaatgcatctcttggcanagagttcagcagcaatggcatcagtggccagcaggcacacacattttttcatttcagattttccggtgctgttggacacattttaacacatatgcatcacatggctatggaaacttctaaaactagg

SEQ ID NO: 698790 - DNA, 364 bp, Homo sapiens
aggctgggtgcagtggctcacgcctgtaatcccagcactttgggaggccaaggtgggcggatcacttgaggtcaggagtttgagatcaccctggccaacatggtgaaaccccatctctacaaaaattatttgggcatggtggtgtgtgcctgtaatcccagctactcagtaggctgaggcaggagaatcacttgaacccgaaaggcggaggttgcagtgaggcgagatcatgccattgcactccagcctgggcaacaagagtgaaactccatctcagaaaaaataaataagtaaataaataaattacctggttttcttataactgaataaatgcttacttttaagtcaatcctataaaaattga

SEQ ID NO: 698791 - DNA, 732 bp, Homo sapiens
catgtacccagctatcactatgtagagcgggtgtatgatgaataaaaatggcgactcgcctgttaactaacagagagcccacgaagcattgcatgctagctggctcataccatgcaataagaggagtggtgattgaagatctacacacaagatacagatgctcacctttaccaacgtgattcaacatatagctggaaatgctgtcgagagcaccatatcaagagacataagggcgcacaaattgtaaaagaagacagattctgctgaagacacgaagatatatactcagtatgctaaagactccaccagagaaccgccagtactgaataaagaatttagtaatgttgaaggatacaccatcagacatatcatgagcataacatttaatatccactagcagcatacaaccttgctgaagatatgacggtcagcgctcacacttaagaagctactgagagtagacaatagatgcaaagtatctaagatacctaggaagcaagttaacccaagaagcgatagatgtttattaggaatactatgacaaactgatgaaagaggtccatgatgacacacacaataggcgaggacatttcatgctcatggattagaataagttgacaatactactcagagcagtttatagattctatatgagctctatcagaatgccaatgacatttcttatagcacaagtaattctgaggcagagacgcttgagacatcatatttctg

SEQ ID NO: 698792 - DNA, 164 bp, Homo sapiens
aactgtcatatagcgaggcgatggtgactggaggagtaactggattatttcactgtcatcttatactcggagactcccaagccctccatctccagcagtctaattaaaccccagggaaggtcatggatggctgtgcgctgtgttaccgcagctcgaatttcgta

SEQ ID NO: 698793 - DNA, 866 bp, Homo sapiens
cccccagcaccccatgctgacttggatgaaccccagatctctgtggtgcccagccatgtgcatgggatgtgtgtgtgtgcagctgtgccaatctacctcacatgtgcccaccccctgcctgtgtgcatgcctgtggtgatcatgtggcatgggaatgtgctcttggggtgtcggatgacacctgctgcttagcacccccagccagaacacccatgagtggtctcgtgggctctggagagagtgtgggcgggaggaagaattggcaccttcctagggaaggagacgagcgcttcgccttgattctccgagaagcctccgagaagtgctttaagtgtgtttgcatgcgccaggcgtgtgggcagctgggggcctgtccagccctctccctgccatccttaccccaagtgacgtccactgccttgtcaccagcagacctgcctgtcatgcccaacccctgaggaagcatggggaccctaacacccatggtgccctggaccagacaggccgtggtcaggcccaggacagcggacgggtactgccaaagatacacacacgtgcttgctgacatgcgtgtgcctgtgtgtggtgtctgtagctgtgatcagtgaaactgtgacccatcagtcagtccaagacaaggtgagttggcctcgaggccacagttattgcaactttcagaggtgtgtcataacgacgtcaacggctattaacgtcgataagtcttataatgtaagtaaaaatgcccagggagtcctgggaaggtacgcggagattgagggggtaaaatattaagggcttagaaatttgaagaataaggaggacgaaggcagaatgagctagacaggaagggttggcatgtggatggg

SEQ ID NO: 698794 - DNA, 635 bp, Homo sapiens
  misc_feature (194)..(194): n is a, c, g, or t
  misc_feature (322)..(322): n is a, c, g, or t
ccgcgcgccggcggggttttgaggaaattaaataaaataaaaacccccacccccccccccccccgggggggggggggggggggggggggcggccccccccccccccccaaaacaaaaaaaaaataaatttttttttttttttctctctccccgcggggaagagaaaaaaaacccccccccccccccgcgccccnctttttttttttttttgttttttgttggtataacaaaaacaaccccccccccccgcgggggggggggggtggggggctccccccccccccccccaaaaaaaatattttgttgttgtgggcggggccgngttggtccccccaaaaaaaaaaagaggggggtttttttttaaaaaaaaaaaaaaggggggggggggggggggccccacaaaaaaaaaaatttttttgggggggggaaaaaaaattttcccccccttttttcccacaaaaaaagaaggccccccctcccggggggggggggggggtttttttttttctccccccaggggggcccccgggctcataaaaaaaaaaatgggtgacccccccccctttgggcccacaaattttgggtttttaaaaaggccccagggttttttttacaaaattcccagggggcccccg

SEQ ID NO: 698795 - DNA, 266 bp, Homo sapiens
tcatgcggtgagccatcaactaacattttcctcctgcacaattccattttccacattacacagaggtattcatagttgtattccatgtcaacttccaaagattaaaaacccaaatatcttaggttttccttaatacatatgtgtttcttcataccatatacaaaagttatctcaatattgatcaatcttacatctaagagctaaaatttcttcctaaacactcttagagttgtaaaggtgcataaccttgcaatcagcccaatgat

SEQ ID NO: 698796 - DNA, 355 bp, Homo sapiens
  misc_feature (195)..(195): n is a, c, g, or t
  misc_feature (199)..(199): n is a, c, g, or t
cattgacttttcatgaaaaactaaaaccagaagcatttcacgaagctaagcacaggacagaaggtttgctgggatgggaaacctgctcaaagtccttaccagggaaattgaaaactatccacactttttcctggattttgaaaatgctcagccctacagaaggagagagagaaatctggaacccagatccagcgncggnccttcaggattctgagagccatccttgcagacctgcaggcttacaaaggcgcaggcccaagagatccgagatgcaattcaaaatcccaatgacattcagcttcaagaaaaagcttggaatgcggtgtgccctcttgttgtgaggctaaagaggggg

SEQ ID NO: 698797 - DNA, 356 bp, Homo sapiens
ctcataatgtgtccccacgaaaacttctacacaaatgcttgtggtaacattattcataataactaaaaggtggaaacaactcaagtgtccattgacttatgaatggacaaacaaaatgtggcattatctatatgatggaatattattcacccatgtaaaggaataaagtactgatacatgctatcatatggatgaaccttgaaaacattatattaagtaaaagaagtcaggcacaaaagattgtatttttattccatttatataaaatgtccaaaataagcaaatctatagacaaaaagtagatcagtggttgcttaggcctagggggaataaggagattgtgcgggatagctaca

SEQ ID NO: 698798 - DNA, 231 bp, Homo sapiens
gtcgagatacagatcgagcacagagcatgtgagacatctatgacaccacctctctggaacaagaaagatgactggggaggaaacacaggtcagcatgggaacaggggtcacagtggacacgagggtgggctgtctctccacctcctcacattatgctaacagggacgcagacacattcaggtgcctttgcagaaagagatgccagagactcttgaagtcacaaaggggagg

SEQ ID NO: 698799 - DNA, 377 bp, Homo sapiens
tagctgttctcgaggattcgaccacttgtaaacgtaagcacgaggtttcgtgagtcgagactgggccagtgctttccagcctggatgagagagcaagactctgtctcacaaaaaaaaccatcaaactaaaaattagaaggttgacaagtcccaagttctattttaaaaacatggaacataaacttcagttataggccaggtacagtggttcacacctttaatccccagacatttggaaaaccccgagttgggtgcatcatgagttcagaatgtacaagacccatgcttggcccaaaagggtgaaacccggtctacgacaaaaattaccaaaaatttagccatgttagtgttggaaggcacctctgtaattcccatgt

SEQ ID NO: 698800 - DNA, 1340 bp, Homo sapiens
  misc_feature (703)..(703): n is a, c, g, or t
  misc_feature (711)..(711): n is a, c, g, or t
  misc_feature (728)..(728): n is a, c, g, or t
  misc_feature (831)..(831): n is a, c, g, or t
tatggtggctcacacctgtaatcccagcactttgggaggctggggcaggcagatcatgaggtcaggagatcgagaaacatggtgaaaccccgtctctactaaaaatacaaaaattagctgggcgtggtggtgcgtgcctgtaaccccagctacctgggaggctgaggcaggagaatcacttgaaccagggagttggaggttgcggtgagcagaaattgtgccactgcactccagcctgtgagactccatctcaaaataaataaataaataaataataaaaaaagtttgttagtgtcaaacacagcactgcttatatttctcacatatttctaaaactgagggcttatatttctcatgtacttccaaaactgagggttagagggaaatttctacttctctagatttatctggctctagctgaagtcattagatataaatgaactgtttttttccaaagagtttttggctaaattatggtaacactgcagttgatggtttcctggacagaaattttgcattggtcaagtgctggattagttaaaacatgttccaatgcctaagtgaaggaattctggaggggcatacagcacctacagtttacatagatgtggctttgcccaggcaattcatttaccaaatgggttgtgcctcatttaaccagaacaggcattaccacctaagcatgacgatatattaaggacantaaatgtnccccattttaaaatgtnagtttttaaatacacattttacaaatgtacctaatttcaccccggcccaatagtgtgaatatcctataataaattctctgaagtacagaaattcaattttggngggaatactgatttacattaaccgactggggaaaaagtactataggggtctatcatgagccagttattaaataaaattttgggattaagcagaaggctgatttaaggccgatactctaaaaaatcacttccttaatggccaggaaatgacctttaaatctaaatccagctggactaaggggtttctcttatcgtttaaaaaaatatcttcctttgggaaaggaagattttggtattagaaacggttacaataaaccaatttaaggtcactggagggaattaccttgggatttaaaccgggaacccgtgtaaaaattaaggccgcctcgaaaacagatgggttttaggaattacaacgcttaaaaactttttacgcaacccgtgggtggcgacgccgttacccatttgggctgggggcatattgtggagatgtcgccctctccatatgcaccctcttttctatgggggctacccgttctacgggtggcgactgctcccccgggggtggcc

SEQ ID NO: 698801 - DNA, 80 bp, Homo sapiens
  misc_feature (50)..(50): n is a, c, g, or t
cctcctctctgccccggaagctgctgccctgggaggagggcccgggccanccgccaccacctctgcccgggcccttggca

SEQ ID NO: 698802 - DNA, 771 bp, Homo sapiens
  misc_feature (216)..(216): n is a, c, g, or t
tggccggagaagtagaccccgtgaaagagaccgggaacgagagcgagaccgcctagagataacagagagacagagagcgagatagaggagtgatagagaaagagaaagagagcgattatgtgatcgagacagagaccgaggggagagaggtcgatatagaagataatgggcttttgaagcactgatggtttaaagatacaaaaaatctgtgtatcnccggtggtgtgttacaaggtagtaaatttatttacagtgtctgcctatgaagtccatggtgtagaaggattataatgacccctttggttccaagcattgtagtatcataagacaggaaaaatctcaaatccgccaaaaatccacagctgacagtgtgaatggacaccttttatggggcagatgaacagtccaagactgtagatatgattctttctccataaatgtctatagtggtgtcatcctagagttatttgtgtggtacccctttggggatctggatgggtaacgtgcatgatatttgcttggaggtgtctacattgtgctggcacaccgttcagtacaaatagtgtgctatcgagtatgcaatattgacgtatgatggtttgctgtatggcagtgtgtaccgcctcttgttttttcccagtggcccttttaaacaactaataggcctttatttcccaggttcaggggagcaatagacatgcccccactcactttaagaaacctgtgagcggcggggagggccccaaggtaaggcggtgcactgcgggggac

SEQ ID NO: 698803 - DNA, 185 bp, Homo sapiens
ctttttgggggaaaattttttccccttgggggtggggggccgaggcccctttgaaatcttttttacctgtttaaaacccggaaagggactgccccgttttttaaacccccccccccagggtcgggtttgggtttccccctttccagcccgggggagattttataattaaaaagggtttcccggga

SEQ ID NO: 698804 - DNA, 471 bp, Homo sapiens
tgatgttatcgcccaacacggtgaaactccgtctttactaaaaatacagaaaattagccgggcatggtggtgggtacctgtaatcccagctactcaggaggctgaggcaggagaatggcttgatcccaggaggtggaggttgcagtgagccgagattgcgccatcgagattgtgccattgcactccagccttgtgcaacagagcaagaactccgtctcaaaaacaaaacaaaacaaaaaaaaaccccttggcttgggggaaaaatcttaaacagctataaaagaacattttggaggcaattgaggaaaattcagatatggactgtaggtaataattgaattaattttttcaggtgcgatacaagtatcttagttatgtacgaaaatgtccttattcttaggaaatgcacactgaagacatttagggggtaaactgttcataacctgatatcttgcactttccaagtgattc

SEQ ID NO: 698805 - DNA, 537 bp, Homo sapiens
ccagtgcactccagcctgggtaatagagtgagaccctgtctcaaatacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgtttcccttgaatttctgtcattctctgtttggcttatggtacttctctttccctttcccttctcaccacacacacacacacacacacacacacacagcctgtcagtctcataggtgctcctataagggtaaataaggcaggcaggcatttgaaattacagcagggatagaacgcaaagctcaggctttggaagaggaacctcttgtgcctgtatgcattagcttttaccttcagtgccttggggattgtttctccctctgtaccagatgtgctctcccagcccaggatatcttatgatgcccagtgagaggtcataaaaggacagaccatcgaa

SEQ ID NO: 698806 - DNA, 377 bp, Homo sapiens
atgaagtcctacttccgcctggatacgcccatctacttttactactctgatctgagtgtgccgcactgccatcgaagaggtccaggcagaagaggaaggatgatagtcatccagctccacgtggacaactgcatcctgaatgccgagaccctcgtctgtatcaaagagccccgagcctacaccttccgcgactacagcgccatcctttacctaactagggactgcgatggcggaaactttgatgtcacttcactggatgccaagaccgtcacgtcagatgtccagcctcagtttggacgaccgtgggattcttttagcacttaaacccacatggggtaaggctgtaccaggggcagcatgtccatcccctttgttca

SEQ ID NO: 698807 - DNA, 156 bp, Homo sapiens
cttagatgatccccgttctccccgttgcagctgagtgagtggcacgatcagagctcactgcagccttgactcctgagctcaagtgattctcctacctctgcctcccaagtagccgggattactttttttcttttttggggaacggggttaccccat

SEQ ID NO: 698808 - DNA, 978 bp, Homo sapiens
  misc_feature (12)..(12): n is a, c, g, or t
  misc_feature (15)..(16): n is a, c, g, or t
agaagagggggnccnnaaaacacggctaggtaacgaggctgggttgtagtccgcccggagcacagagctcgcctttgcgatcgccgccgtcacacccgccgcagctcaccatggatgatgatatcgccgcgctcgtcgtcgacgacggctccggcatgtgcaaggccggcttcgcgggcgatgatgccccccgggccgtcttcccctccatcgtggggcgccccagggcaccagggcgtgactggtgggcatggcgtcagtaaggattcctatgtgcggcgacgaggcccagaggcaagagaggcatcctcaccctgaagtaccccatctgagcactggcaatcgtcaaccaaacgtgggacgactagtggagaaaatctggcaccacaggcttctacaagtgatgctgcgtgtggctcccgaggagcaaccccgtgctgtctgaccgaggcccccctgaaccccaaggccaacccgggagaggatgacccgttgatcatgtgttgaagaccttcaacaccccgagtgcatgtacgttgctatccaggctgtgctatccctgttacgcctctggccgtaccactggcttcgtgtatggactccggtgacgggtccccacatgtgccctatctacgagggtgtatgccctcccccagtgccatcctgggtctgggcctgctgggccgggacctgctgactagctcatgaagatctcaccgagcgcggtacaagtttcacagcacggcgagcgggagatcgtgcgtgacctttagggaagctgttgctacgttggcctggagttcgggcaagagatggcgcgggtggttcagctcctccctgggaaaagtccagtgcttgaaggcagtgttcccttggcctagcgggtcctgcccgggggggcttcaacctcctcctgggggaggccgtgggtcccacaaactcctcccctgatgtgtgggttccccgccttttctcccg

SEQ ID NO: 698809 - DNA, 1043 bp, Homo sapiens
atcgtggaggatgttcgccatcgagggcactgaccgcaatggacgttttttactaccaggcagatcgatgagctactacatcccccgggtcgtgctgtgtggacttggaagccccgggtgattcactccatcctcaactctcaccctatgccaaagctctacaaaccagagaacatctacctgtcggaacgtggaggacggatgctggaaacaaatggtggccatgggatattcccagggagaaaagatccagtgaggacattattgacatcactaggactcgtgtgaggcagatggtagctgacgacgtcatagtagggcgtattcgtgctgttgttcatctccaatatgctggagggggggacgaggctcatgcgcatctgtggttcgctacctactatagaacgggctgacatgacgacgtgatagtccctacacgcagagcatggctgcaagactatatctcagatgtgtgtcccaagccaaggaacgagatgagcgatgtggtagtgtccatgaccattaggggattacgatctctctatcacttcgaagagtgcaggcggctaaatggcgatgacagtgttggctggtcggcctaggacgatcaaccaggtacctgtaacacggattgccagagattccgtctgttaggatgcagaagccatacttctcctagaaataatcggctggtgtgggaccatcatgtcgcctaggacaccaccctgagtctagcctggtacttgaacaatgatctatggcttaataagtcgtctggattccatcccatggcttcccttcttcaggactgggtaaaccctctcagaacgccaagcgagggcaccgttattgcgacacccggcctgaagatacaaggcggtgtggcgcagaaatttgttgtgccggcggaatcggagaccaagagaatgggggcgcatcagggaggggccccagccaactgttgcacgaaggagtgttgccccggggatagggggggataccgccagggtagagctagcgaacatgatgggaaaaagggggct

SEQ ID NO: 698810 - DNA, 158 bp, Homo sapiens
taaatcactcagatctatcgtattctgtaacagcagcagaggatgaactaagacggtaactttcagcctggcacagtggctcatgcctgtaatctcagcactttgggagaccaagtcaggtagatcacctgaggttaggagttagagaccagcctggc

SEQ ID NO: 698811 - DNA, 440 bp, Homo sapiens
agtagcaatcatgatgcttacatgtgtgtggctctgtctcgcctttactttcatctaggagagtttaggctctaggtatcttatcttctccctggtcttcttcacttctgtgatcttgtataattgaatatggccatgcctaattttacaagtcaacaggagctcagaaatggtgcataaaaatgaaggtcatgtagctaacgacgtcacaggtgaaggtaggagtgagtcctatatgtatagacttctatagcccagggagaaaactctcttttctaggcctttgacatcctcagtcatttttatacaccatccccacctatctgtattttgcacgccccattatgcttagctggactgatgacagtcttcctagaagctgtaaccctttccacatcgattgcactctttctgtgtcatttctcccaggtagagtcaag

SEQ ID NO: 698812 - DNA, 1120 bp, Homo sapiens
agcggatctgtcacggcggaggcaggagagtgctgctgcgcctgcctccgggaccgagccgtatccacagaccggctgccgctgccctgatcctgcttcgagttggagctctgaaggaagctcatgtagcaggatgtagtgttcgttccccatggtgcgtccttgtgctgatgagtttggagctcatcctaggcaatcaatgccctgatgcatgagttatacgattaaccgagagttggccggatgttgtcgggagcttggtctggtgaataggcatggagctcccttgggtgttgaggtccgctgcaggaggacatcagttcactgggcagtgagtcctacaatctctcgtaacgggcgtgcgaatagaaacgatgcatagctcgtgtcgaatgtgtgaagtcagacttgcttgaccatacgtaggctgtatcctgtcatgcattttgacagtagtcgaccgtacacacggatccggggaaagcctaacgcagtgttcgccggcagtcacctgcgagtccagagatggtcccattgcgttcgcacattgcgggcagcgagccttgtccactcacctggggttgtaactacgcgagtatttgccaatgacacgggacgaagtccctgttgggactgggactgctgcagaatggcactacgattgcttagcgacaacggagacttcgttgctgaaggaatacagcatatgaggggaccccgtttggatgaagacatgtttcccccaagttcaagtcgcccttggtgttgcgagggacacaccagaacaggttgtttacagtggaattaacggcccacccaagggtcctggtggaatgaggtaggcagcgaaaagaaaagtccgaaacgggctgtcgcaagtgccccaattgggcggcccttgcgagcgacttgggtacacggttgggttagcgccggtatctagttgaggccggaaacccattcgagggcgccataagacgttctaggccctatttatacctgtctgtataacgcgggaggtacttttttgtccccagggcgaagcccggttgcatccgaacccccttgggacaaaagcgtgccaggagaacctcgttgaagagtttttctccacgaaata

SEQ ID NO: 698813 - DNA, 147 bp, Homo sapiens
atcccaagatcttaacacacacacacacatcacacaacacacacacacaccacacacacacctcacacctacacacaaaagagagccccaaacataccacatcgcaccaccacacatatacacaccagagattcacacacaacacac

SEQ ID NO: 698814 - DNA, 1201 bp, Homo sapiens
taggaattccttcaggtctctaacacactctcttgcttcagggaagcctggaaagctgctgttacaggagatcgaggagctcagtagagactagtgtaggtgatagaaattctgcaattaaaagcagtgcagattgtaactagagatacggactgagatgaaattacctaaaatcttctcattagagaaaaaatctgcacacttttaaaaatgcataccggcagggcacagtggctcacacctgtaatcccagcactttgggaggctgaggcatgcaaatcaagaggtcaggagtttgagaccaggctgggcaacatggtgaaaccctgtctctactaacaaatttaaacaaattacgctgggcgtggtggtgggtgcctgtaatcccagctactcgggaggctgaggcagtgagaatcgcttgaacccaggaggcggaggttgcagtgagccgagatcatgtcattgcaccactccagcccaggagacagagtaagacctctgtctcaacaaacaaaaaacacaaacacaacaccacaacacccaaccaacaagcccataagacagcagacacaggctggaaagccccaacacacgtgacacccgcgaaagacaacagcaagaaggaataacaataaccacgcagaaaacgaacaaacaccggccacaaacgtggcgaaaaacagcgctacacagcacacaaataacacacacacacactcgacgagcagacaacacaagcaagaaatactacaccacaaaaacacagacaccacacaaacgaccaaagtaacatcctgacacacaggcaaccacaagactatataacaacagcagcctgacactgccacaccccgcgcgagacacacacacacaaacactcgaccaaaaccacaacacaaggcaccacgagccaaaaccaaagagccgcacaagaactacaaagcaacaggcgccacaccacacgcaccgcccaccacagccaacgcaacgcagagctaacaacggcacgcaggcagagccacacaacgcgcaccacgaggagcgagacacacacaggaggcgcaccaccgacgattccaagcacaaccaccggcgacacaaccatacacgtgacgacacaccgccaacacaagaggccgcaccacgcggcaaccgaaccaacgccaccaacaagcgaaaaaagagcagacacaacatg

SEQ ID NO: 698815 - DNA, 794 bp, Homo sapiens
agcggagaggggctctccggagtccttctccgagtagccgggcgagcacgcgtcattgtgttacactgcggccggaccgcgagctaggctgggataaaaaataataccactaccttcccccattgtttccattgcagacaaactctaaacaagggaactacactaggctgcaccagtaatcatagataataacagaacagggagaccgcagagaagaaggaaagacagaccgagaagagtcgtaaaacggacgagagagcgtatataaaaacgaatgcaaatacacgaaattacagcaagacagagagaccagggaaaacattaggcaaaccatgaaaacacaggagaacagaaaataggaacacggagaacacaagaaaaagaaagagcgaacagtagaacccagagaaaaaaaactaagaaacacacagaagaacgcaacacaagacaacgcacaaccaaaaaaaaaacaagaaaaaaaaataattaaaactaaaatctaaaaaacagaaaaaaaaaagataaaaacaacacacaaaacagaacacataagaaaaaaatcaataccaacaaaataaaataaaaaaaaaaataacataaaaaaaatacaaacaacaaaaccaccacaaatcccaaactacacctactatttatcacaaacataagtacagacaaaagaaaaatacaaaaacatgaacaacgaaaaaaacaacaatatcaaataaaaataaacaacaaaataaaaaaacaaacaacacaaaaaagcagaaacactaaaataaaaataaagtaac

SEQ ID NO: 698816 - DNA, 219 bp, Homo sapiens
accatgtagggacacccgtgaacatgggccaccctccatactctcccgagactatcccgacagtgtggactggactgtaggctcacatacccccccacatacctctccatagatatccatgcgccttcttgacacccttaatcaccatatgatgttggctgcgctgtaacggtatgggacccaaggccatacaggagctggaatgccaccgagatactc

SEQ ID NO: 698817 - DNA, 5874 bp, Homo sapiens
atggaattccccattggatccctcgaaactaacaacttccgtcgctttactccggagtcactggtggagatagagaagcaaattgctgccaagcagggaacaaagaaagccagagagaagcatagggagcagaaggaccaagaagagaagcctcggccccagctggacttgaaagcctgcaaccagctgcccaagttctatggtgagctcccagcagaactgatcggggagcccctggaggatctagatccgttctacagcacacaccggacatttatggtgctgaacaaagggaggaccatttcccggtttagtgccactcgggccctgtggctattcagtcctttcaacctgatcagaagaacggccatcaaagtgtctgtccactcgtggttcagtttatttattacggtcactattttggttaattgtgtgtgcatgacccgaactgaccttccagagaaaattgaatatgtcttcactgtcatttacacctttgaagccttgataaagatactggcaagaggattttgtctaaatgagttcacgtacctgagagatccttggaactggctggattttagcgtcattaccctggcatatgttggcacagcaatagatctccgtgggatctcaggcctgcggacattcagagttcttagagcattaaaaacagtttctgtgatcccaggcctgaaggtcattgtgggggccctgattcactcagtgaagaaactggctgatgtgaccatcctcaccatcttctgcctaagtgtttttgccttggtggggctgcaactcttcaagggcaacctcaaaaataaatgtgtcaagaatgacatggctgtcaatgagacaaccaactactcatctcacagaaaaccagatatctacataaataagcgaggcacttctgaccccttactgtgtggcaatggatctgactcaggccactgccctgatggttatatctgccttaaaacttctgacaacccggattttaactacaccagctttgattcctttgcttgggctttcctctcactgttccgcctcatgacacaggattcctgggaacgcctctaccagcagaccctgaggacttctgggaaaatctatatgatcttttttgtgctcgtaatcttcctgggatctttctacctggtcaacttgatcttggctgtagtcaccatggcgtatgaggagcagaaccaggcaaccactgatgaaattgaagcaaaggagaagaagttccaggaggccctcgagatgctccggaaggagcaggaggtgctagcagcactagggattgacacaacctctctccactcccacaatggatcacctttaacctccaaaaatgccagtgagagaaggcatagaataaagccaagagtgtcagagggctccacagaagacaacaaatcaccccgctctgatccttacaaccagcgcaggatgtcttttctaggcctcgcctctggaaaacgccgggctagtcatggcagtgtgttccatttccggtcccctggccgagatatctcactccctgagggagtcacagatgatggagtctttcctggagaccacgaaagccatcggggctctctgctgctgggtgggggtgctggccagcaaggccccctccctagaagccctcttcctcaacccagcaaccctgactccaggcatggagaagatgaacaccaaccgccgcccactagtgagcttgcccctggagctgtcgatgtctcggcattcgatgcaggacaaaagaagactttcttgtcagcagaatacttagatgaacctttccgggcccaaagggcaatgagtgttgtcagtatcataacctccgtccttgaggaactcgaggagtctgaacagaagtgcccaccctgcttgaccagcttgtctcagaagtatctgatctgggattgctgccccatgtgggtgaagctcaagacaattctctttgggcttgtgacggatccctttgcagagctcaccatcaccttgtgcatcgtggtgaacaccatcttcatggccatggagcaccatggcatgagccctaccttcgaagccatgctccagataggcaacatcgtctttaccatattttttactgctgaaatggtcttcaaaatcattgccttcgacccatactattatttccagaagaagtggaatatctttgactgcatcatcgtcactgtgagtctgctagagctgggcgtggccaagaagggaagcctgtctgtgctgcggagcttccgcttgctgcgcgtattcaagctggccaaatcctggcccaccttaaacacactcatcaagatcatcggaaactcagtgggggcactggggaacctcaccatcatcctggccatcattgtctttgtctttgctctggttggcaagcagctcctaggggaaaactaccgtaacaaccgaaaaaatatctccgcgccccatgaagactggccccgctggcacatgcacgacttcttccactctttcctcattgtcttccgtatcctctgtggagagtggattgagaacatgtgggcctgcatggaagttggccaaaaatccatatgcctcatccttttcttgacggtgatggtgctagggaacctggtggtgcttaacctgttcatcgccctgctattgaactctttcagtgctgacaacctcacagccccggaggacgatggggaggtgaacaacctgcaggtggccctggcacggatccaggtctttggccatcgtaccaaacaggctctttgcagcttcttcagcaggtcctgcccattcccccagcccaaggcagagcctgagctggtggtgaaactcccactctccagctccaaggctgagaaccacattgctgccaacactgccagggggagctctggagggctccaagctcccagaggccccagggatgagcacagtgacttcatcgctaatccgactgtgtgggtctctgtgcccattgctgagggtgaatctgatcttgatgacttggaggatgatggtggggaagatgctcagagcttccagcaggaagtgatccccaaaggacagcaggagcagctgcagcaagtcgagaggtgtggggaccacctgacacccaggagcccaggcactggaacatcttctgaggacctggctccatccctgggtgagacgtggaaagatgagtctgttcctcaggcccctgctgagggagtggacgacacaagctcctctgagggcagcacggtggactgcctagatcctgaggaaatcctgaggaagatccctgagctggcagatgacctggaagaaccagatgactgcttcacagaaggatgcattcgccactgtccctgctgcaaactggataccaccaagagtccatgggatgtgggctggcaggtgcgcaagacttgctaccgtatcgtggagcacagctggtttgagagcttcatcatcttcatgatcctgctcagcagtggatctctggcctttgaagactattacctggaccagaagcccacggtgaaagctttgctggagtacactgacagggtcttcacctttatctttgtgttcgagatgctgcttaagtgggtggcctatggcttcaaaaagtacttcaccaatgcctggtgctggctggacttcctcattgtgaatatctcactgataagtctcacagcgaagattctggaatattctgaagtggctcccatcaaagcccttcgaacccttcgcgctctgcggccactgcgggctctttctcgatttgaaggcatgcgggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggcaacctttaaaggctggatggacattatgtatgcagctgttgattcccgggaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagttagggggccaggacatcttcatgacagaggagcagaagaaatactacaatgccatgaagaagttgggctccaagaagccccagaagcccatcccacggcccctgaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactccatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcgtggtcaacatgtacattgcagtgattctggagaacttcaatgtggccacggaggagagcactgagcctctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtga

SEQ ID NO: 698818 - DNA, 125 bp, Homo sapiens
ccccacccctgcgcccaagaatgaatgtaagtcaatctaggcttgagaaagagggtcactccacaaatattccagctctgcccaaaagactaaactcctaaaaggtccccctgctggaacaagta

SEQ ID NO: 698819 - DNA, 2426 bp, Homo sapiens
gtgttttatgtatggtatttaaggagaataagtcaaggttctagaagtctgtatgtgcaagtataatacacacactcacacttctaaatgagtgcagtatgcttgtaaactcatccgtcttctcactgcaacccaccctgaatgaggttaagggaagaaggtctaaatccatcttcagctgcccaatgtctctcagtcttctgagtctgaattattgcactaattaacccacttctcttgcttcttccaaaggccactggctcatgaagcagcctgaatgagtatagaaagagatagaatccagcagagggggtgaggcattgggaggttccaggtctttctctatctcccaccaggtggtggtggatgccctggtgggcgccatcccatccatcatgaatgtcctcctcgtctgcctcatcttctggctcatcttcagcatcatgggtgtgaacctcttcgcagggaagttttggaggtgcatcaactataccgatggagagttttcccttgtacctttgtcgattgtgaataacaagtctgactgcaagattcaaaactccactggcagcttcttctgggtcaatgtgaaagtcaactttgataatgttgcaatgggttaccttgcacttctgcaggtggcaacctttaaaggctggatggacattatgtatgcagctgttgattcccgggaggtcaacatgcaacccaagtgggaggacaacgtgtacatgtatttgtactttgtcatcttcatcatttttggaggcttcttcacactgaatctctttgttggggtcataattgacaacttcaatcaacagaaaaaaaagttagggggccaggacatcttcatgacagaggagcagaagaaatactacaatgccatgaagaagttgggctccaagaagccccagaagcccatcccacggcccctgaacaagttccagggttttgtctttgacatcgtgaccagacaagcttttgacatcaccatcatggtcctcatctgcctcaacatgatcaccatgatggtggagactgatgaccaaagtgaagaaaagacgaaaattctgggcaaaatcaaccagttctttgtggccgtcttcacaggcgaatgtgtcatgaagatgttcgctttgaggcagtactacttcacaaatggctggaatgtgtttgacttcattgtggtggttctctccattgcgagcctgattttttctgcaattcttaagtcacttcaaagttacttctccccaacgctcttcagagtcatccgcctggcccgaattggccgcatcctcagactgatccgagcggccaaggggatccgcacactgctctttgccctcatgatgtccctgcctgccctcttcaacatcgggctgttgctattccttgtcatgttcatctactccatcttcggtatgtccagctttccccatgtgaggtgggaggctggcatcgacgacatgttcaacttccagaccttcgccaacagcatgctgtgcctcttccagattaccacgtcggccggctgggatggcctcctcagccccatcctcaacacagggcccccctactgtgaccccaatctgcccaacagcaatggcaccagaggggactgtgggagcccagccgtaggcatcatcttcttcaccacctacatcatcatctccttcctcatcgtggtcaacatgtacattgcagtgattctggagaacttcaatgtggccacggaggagagcactgagcctctgagtgaggacgactttgacatgttctatgagacctgggagaagtttgacccagaggccactcagtttattaccttttctgctctctcggactttgcagacactctctctggtcccctgagaatcccaaaacccaatcgaaatatactgatccagatggacctgcctttggtccctggagataagatccactgcttggacatcctttttgctttcaccaagaatgtcctaggagaatccggggagttggattctctgaaggcaaatatggaggagaagtttatggcaactaatctttcaaaatcatcctatgaaccaatagcaaccactctccgatggaagcaagaagacatttcagccactgtcattcaaaaggcctatcggagctatgtgctgcaccgctccatggcactctctaacaccccatgtgtgcccagagctgaggaggaggctgcatcactcccagatgaaggttttgttgcattcacagcaaatgaaaattgtgtactcccagacaaatctgaaactgcttctgccacatcattcccaccgtcctatgagagtgtcactagaggccttagtgatagagtcaacatgaggacatctagctcaatacaaaatgaagatgaagccaccagtatggagctgattgcccctgggccctagtga

SEQ ID NO: 698820 - DNA, 162 bp, Homo sapiens
  misc_feature (8)..(8): n is a, c, g, or t
  misc_feature (25)..(25): n is a, c, g, or t
  misc_feature (28)..(28): n is a, c, g, or t
  misc_feature (43)..(43): n is a, c, g, or t
  misc_feature (49)..(49): n is a, c, g, or t
  misc_feature (58)..(58): n is a, c, g, or t
  misc_feature (62)..(62): n is a, c, g, or t
  misc_feature (85)..(85): n is a, c, g, or t
  misc_feature (87)..(87): n is a, c, g, or t
  misc_feature (116)..(116): n is a, c, g, or t
aagtttgntttgtccgtatggactnttnaaagtcaagtttaanttccanaaacctttntttntctgagattactttttggggtantntaaaatgagagacattttgtaaccctgtnaaatacatagggaatataacattccagtgtatacaaagaaggcaaa

SEQ ID NO: 698821 - DNA, 420 bp, Homo sapiens
  misc_feature (185)..(185): n is a, c, g, or t
tccgagtctgtacaaaccatacaaacaagcaagagtggtgagctctacaaatactaggtctaaaagcaggtcaagaatgagagacttgtctaaagtacagagttaggcagcttctttatttttcacatacacaacaataaccaccccctaaccagctgacaataccacagtctcactgaggagtnaattaaaattacagaagaaaaagagactctgctattaggttgcagggctaaataaagcaagcactaagtccttctatcttcctaggggaagctatatggaaatgggaaggtgatcagcagaataagaaacactttagtttcttaataaatgctacagcttgatagagcctactacatatttaaagagaacctattacatacacagacaacagaaagtttttgaactaaaccgtcg

SEQ ID NO: 698822 - DNA, 334 bp, Homo sapiens
gaaaagtgatagccattgttgaaggtggggcctggtgggaggcgatggatcatgggaggcaatggatcatgttgggtgatgagtgagttctgtgctcagttcatgggagatctggttgtttaaaggagtctgggacctcccctgactcttgctccctctcttgccatgtgactctctggctccccttcacctttcaccatgattggaagcttcttgaggcctcatcagaagcatatgctggcatcacacttcctgtacagcctgcagaaccatgagccaaaataaatctcttttcttttttttttttttttggagagtgcattctagtgtggtg

SEQ ID NO: 698823 - DNA, 304 bp, Homo sapiens
ctcggccaacattggctcgacatctgacgaggtgagcagggttcgcaaatcggacgtggacctccgcagccgattgatggtgtgaccgggctgaacgcgtgttgataccgtcgaacatgtgactgccacatgctgacccgccttctgcgtacctacatgggcgcctaccgtcgcgagttgagtgcggtggttatccttcaattcgtcgccaccgcggcaatgctctacctgccgactctcaatgccgatatcatcgacaacggtgtggcacaaggcgataccggctacatcctgcaggtcgagg

SEQ ID NO: 698824 - DNA, 242 bp, Homo sapiens
  misc_feature (162)..(162): n is a, c, g, or t
gaactgtcagccctataatccaatccttgagagcacggtgccctgtttctggctgttgcagagctattgtgtggcagccaggacagctgggcccttaataaatactttggttgatgctgccttgttgtgcaacgagcccaaatgggcaatgtacaagctcanggacttccatatcacttggcagctgtttggaaaatccgccccctcccatttcagaactcaggacatttttatagcaattc

SEQ ID NO: 698825 - DNA, 467 bp, Homo sapiens
ttcgtgaggaaacagaggcgaggcttttccgagatcgtctcagcgatggcgcttaggtcgcagttaagggggactcggtttgcaggaaccctgggtgcaggttcgcagcccagtcaaccagctccgagccggcagcgaaacctgaagtggaccctgtggaaaatgaagctgtaggcacagaattcaccaaccggaacccccggaacctggagctttaatctgtagccaggaaagagtggggctggcggaaggtgtatcactcccgtgagttctggcacaggttgcgagttataagggctcagcatcatgtagaagcaattgtggagcatcagaatggcaaggttgtggtttcggcctccactcgtgagtgggctattaaaaagcacctttatagtaccagaaatgtggtggcttgtgagagtataggacgagtggtggcacagagatacttagaggcgggaatcaac

SEQ ID NO: 698826 - DNA, 942 bp, Homo sapiens
gaacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccgggccatatgggctggcgtgactgttcggtcggctagtcttccctctgagctggtgaacaatcggtcacatcttcaaacctcatagcactgtttcaggcttggcacattgacagttttgtacatgtgttcccgtgggccacgtggctgttacatgactctttagacatcaagcgccaccggttctcatacattcaccggcctttcatcggccgtgctctggcggcaggttgaacctgacatcccttgaggggcacccgggccttataaccagcgcgcggatgcctcgttctttgcgtgtagggtgatgatcgcctatggagtgagtgccttcttcagctaccaggcctggcgaggagtaggcagcaatgcggccaccagtcagatggctggcggatatgcctaaaccacctgtgccacgggcccctctggggctgaagccgccgctgggtcacagagcagtgtcacccttgaagcctgaagctggggagccctgcgttggagtcagggccagcggggactgggttttgggtccttctcttgccggtcagacattagcgcttcagcggcggcaaggagagcaggccccaggcgtgggagggagtttccgcgttgcaggagggcgccttgctgggagcctcttt

SEQ ID NO: 698827 - DNA, 189 bp, Homo sapiens
agatatctattggtcgaactccaagttaaatctatagttatatataactctgatcatggttatcaatcatgtttagcatgcaaacatttaaactgaacctttcttctccttatttgttgccatcatttacttgatctttgcaaatatctttccctgagattcatgacccttatcgacagtgtccttgtt

SEQ ID NO: 698828 - DNA, 366 bp, Homo sapiens
atttgaacatctagacaatagacaggtttaggataattctaatttatggagcttttttgttttgttggtttgggcaattttttttggtaggcaatattgcaatgtcatcacaaaaattagaacaaagactttgttcaggtatgtgtgtaccttgatataaatgttggatatactttgggattcggcttttttattaactacattgctatgtggttttcatgattataattttaatggctacattctatttcttcaagtggaggactagaactgttaaccataaaattgggcttccagttaaatctagattttattataataataaataccaataaacattttcatgaaaatcccaataaaaaaaaa

SEQ ID NO: 698829 - DNA, 372 bp, Homo sapiens
  misc_feature (289)..(289): n is a, c, g, or t
aaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtcganagggataagataattacacaagaggcaccagaaccacttgaatgtgggagagctcttcattaaattgacaagctgcctttggg

SEQ ID NO: 698830 - DNA, 117 bp, Homo sapiens
tgccttatcatacctacctacttctttctttctttctttcttcctttctttctttcctttctccctccttcctttctttccttcctttctcagtgtaggtattatgaacggacgggt

SEQ ID NO: 698831 - DNA, 112 bp, Homo sapiens
atcacgctgaaggactgtggcatgtagattaactctttcagccagggagaacttagactgttgttgttggttgggggtgggggtgcccaaagactggagccaagtatttcta

SEQ ID NO: 698832 - DNA, 1379 bp, Homo sapiens
  misc_feature (1028)..(1028): n is a, c, g, or t
  misc_feature (1044)..(1044): n is a, c, g, or t
  misc_feature (1072)..(1072): n is a, c, g, or t
  misc_feature (1081)..(1081): n is a, c, g, or t
  misc_feature (1097)..(1098): n is a, c, g, or t
  misc_feature (1106)..(1106): n is a, c, g, or t
  misc_feature (1156)..(1156): n is a, c, g, or t
  misc_feature (1233)..(1234): n is a, c, g, or t
  misc_feature (1247)..(1247): n is a, c, g, or t
  misc_feature (1249)..(1249): n is a, c, g, or t
ttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaacagaagagaccaaatacaagcagaactggattccaaagttgaagtttgacctataaaaaggcagatactgatctgttccagaggagatnggaaaacttgaagatnaagtggaatgtgctaataatgcctgaangcagattgngagagatggaaacaannatatgcanatgatatcaagttagcatttacagatatggtgaggagaatatccattatnatgaacagtgccttgctacgtgggaatcattccttacatcacagaccaaccttcactgggaagaagcctctgaagannaacttaatccatngnggccttctgatagatctagagagacagcattattaacaaagtatatatccgggagttgccggtccttataagcggatgtaaaactgttagtacccatctggaaaccagaacttgaaatctcagtatccac

SEQ ID NO: 698833 - DNA, 1229 bp, Homo sapiens
  misc_feature (1083)..(1084): n is a, c, g, or t
  misc_feature (1097)..(1097): n is a, c, g, or t
  misc_feature (1099)..(1099): n is a, c, g, or t
ttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaacagaagagaccaaatacaagcagaactggattccaaagttgaagtttgacctataaaaaggcagatactgatctgtgccttgctacgtgggaatcattccttacatcacagaccaaccttcactgggaagaagcctctgaagannaacttaatccatngnggccttctgatagatctagagagacagcattattaacaaagtatatatccgggagttgccggtccttataagcggatgtaaaactgttagtacccatctggaaaccagaacttgaaatctcagtatccac

SEQ ID NO: 698834 - DNA, 763 bp, Homo sapiens
  misc_feature (214)..(214): n is a, c, g, or t
gggggcagcggcgctgatatgtggggtccgtatttgatgtcgcgtctcccagggggtcaataagatgtgttccagtagtgatgcgcttcggagatgacctggggagataatatggggcgccccccttcacggggtgctggagtttgttctctcagatcttttgttcaagagagccggggttcttatcccgcctatgccccgatgcggttcttgnatagctcctctccccccgttgttgtagtccaccctgctcgctttgcgggcgtttctccaacctatttgggcactatccggagagggatcccctgtgccccacgcgccgtccccagggcatttttgaaccccaggtggcgtctatctccccatgatcagggggctctttgggacgccccccccccctgtgagccccccttggtcaggtgatgttcccgaagcattccctcgccttatcagcagttgcccccgtttctccctcccggaaatttgcgccacatactcacactccgtttatagatccctcttccttctttataagtttgcctagaaatcatcgggtatgctataccacgcacactattcactgcgaatgctgcggcttcgagattccaataaaaccccacaattctctaagaatcaccccctatgcaacctccatgtcgtttttacccccccccaaggtgcttccccaaacatcccttcaccctacttatgtcacccaagccccaagttttggtttcccaaactataacaaaccaacaaaaca

SEQ ID NO: 698835 - DNA, 1331 bp, Homo sapiens
  misc_feature (980)..(980): n is a, c, g, or t
  misc_feature (996)..(996): n is a, c, g, or t
  misc_feature (1024)..(1024): n is a, c, g, or t
  misc_feature (1033)..(1033): n is a, c, g, or t
  misc_feature (1049)..(1050): n is a, c, g, or t
  misc_feature (1058)..(1058): n is a, c, g, or t
  misc_feature (1108)..(1108): n is a, c, g, or t
  misc_feature (1185)..(1186): n is a, c, g, or t
  misc_feature (1199)..(1199): n is a, c, g, or t
  misc_feature (1201)..(1201): n is a, c, g, or t
actcatagaggatccccgtcactgatgtctcgtgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaacagaagagaccaaatacaagcagaactggattccaaagttgaagtttgacctataaaaaggcagatactgatctgttccagaggagatnggaaaacttgaagatnaagtggaatgtgctaataatgcctgaangcagattgngagagatggaaacaannatatgcanatgatatcaagttagcatttacagatatggtgaggagaatatccattatnatgaacagtgccttgctacgtgggaatcattccttacatcacagaccaaccttcactgggaagaagcctctgaagannaacttaatccatngnggccttctgatagatctagagagacagcattattaacaaagtatatatccgggagttgccggtccttataagcggatgtaaaactgttagtacccatctggaaaccagaacttgaaatctcagtatccac

SEQ ID NO: 698836 - DNA, 82 bp, Homo sapiens
gcacgagtaaagcttttccattggcaatctgacattttaatgaaactactcttatttattttttctttctgaggtattaaaa

SEQ ID NO: 698837 - DNA, 164 bp, Homo sapiens
cgttaggtgcttagaggatgcgttatcagtcgctctagggactttcttactggatgaggtgagtaagaataggtacacgtacctatccttactcacctactaaagaagtttacaatccataggaccgtcatccctcacgcgacttggctggttcagagtttcct

SEQ ID NO: 698838 - DNA, 397 bp, Homo sapiens
actcatagaggatccccgtcactgatgtctcgtgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttctacgagacatcagtgcgggatccc

SEQ ID NO: 698839 - DNA, 1153 bp, Homo sapiens
  misc_feature (802)..(802): n is a, c, g, or t
  misc_feature (818)..(818): n is a, c, g, or t
  misc_feature (846)..(846): n is a, c, g, or t
  misc_feature (855)..(855): n is a, c, g, or t
  misc_feature (871)..(872): n is a, c, g, or t
  misc_feature (880)..(880): n is a, c, g, or t
  misc_feature (930)..(930): n is a, c, g, or t
  misc_feature (1007)..(1008): n is a, c, g, or t
  misc_feature (1021)..(1021): n is a, c, g, or t
  misc_feature (1023)..(1023): n is a, c, g, or t
ttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaacagaagagaccaaatacaagcagaactggattccaaagttgaagtttgacctataaaaaggcagatactgatctgttccagaggagatnggaaaacttgaagatnaagtggaatgtgctaataatgcctgaangcagattgngagagatggaaacaannatatgcanatgatatcaagttagcatttacagatatggtgaggagaatatccattatnatgaacagtgccttgctacgtgggaatcattccttacatcacagaccaaccttcactgggaagaagcctctgaagannaacttaatccatngnggccttctgatagatctagagagacagcattattaacaaagtatatatccgggagttgccggtccttataagcggatgtaaaactgttagtacccatctggaaaccagaacttgaaatctcagtatccac

SEQ ID NO: 698840 - DNA, 385 bp, Homo sapiens
gtgacggtgctgctgttggtcgtctctagcaggttcccccggccgccacgcttctccattctccagcggatggagctatggctttaactagtttatgcttgtggaaggttccctctagcgtataagtcagtttggatcttggactccaacctcaagcagtctggcacttcactcccctactcttaccactgggctagcctgcctatttaggttggccaagcttatagacaggttggagatcgggctagaacagggtctggatcagaccctggaaagtctccaatgctgatccaggcatgtcttattcaagatgcagtggagctgtgactcacggtatactctccctagggcaggggctgagtgaactgagacctgggaacaggca

SEQ ID NO: 698841 - DNA, 357 bp, Homo sapiens
tttcgtagacccaacataagaagaatacttgaggctagacggggaagtcggttacaaatcacatcagataagctactaacaaggactgggtgtaatttaaaaaaaagctaaggcagaaggcttctgggaagagttagacgaatctggaaggccttaactatagtagcttagttcgaaaaatgtgaaggactttcgataacggaagtaattcaagatcaagagctaagttaccaacgttaatgtctcgcatcgagacttgaggttaagatgtatggtatcaatcctgaggacctagcattaattgacagctgacccaggtgctacacagaagtggactcagtgaatctaggaagacag

SEQ ID NO: 698842 - DNA, 219 bp, Homo sapiens
gcactaggcgcacttctcagcctgagtgtggcatctgcttctgacgggccctaatggatgtggctcacgcctgtcatcccagcactttgaaaggctaggccaagcacagtggctcacacctgtcatcccagcactttgaaaggctaggccaagcaccccggttcacacctgtcatcccagcactttgaaaggctaggatgacagaagtgcgcctgggtg

SEQ ID NO: 698843 - DNA, 459 bp, Homo sapiens
  misc_feature (198)..(198): n is a, c, g, or t
  misc_feature (427)..(427): n is a, c, g, or t
  misc_feature (430)..(430): n is a, c, g, or t
  misc_feature (450)..(450): n is a, c, g, or t
  misc_feature (452)..(453): n is a, c, g, or t
actgagtttaacctggtgtgtggagacgcctggaaagtggacctttttcagtcctgtgtgaacttgggcttcttcctgggctccctggttgtgggttacattgcagacaggtttggcaagccctgcccctcattttgtttggggttttgggcctgagtgctggggctgtgacccttctacttccggagaccaagggcngtgctctgcctgagactattgaagaagcggagaacctgggaaggaggaaatcaaaggccaaagaaaacacgatttaccttcaggtccaaacaggcaaatccccacatacctgacagggatgccgtgtcaggagctgagtggagagaggaaggaggactggccacttggaagattcctagaagcctttgccttcccagacacttctatatattcaaccaggttccaaatnaantcccaaaccttaaagacttntnngaaaaa

SEQ ID NO: 698844 - DNA, 217 bp, Homo sapiens
  misc_feature (19)..(19): n is a, c, g, or t
  misc_feature (62)..(62): n is a, c, g, or t
  misc_feature (64)..(64): n is a, c, g, or t
gctttgtttacacttcaantttcaccctgattcttgcccccactttcataaaagaaacttcnanaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctct

SEQ ID NO: 698845 - DNA, 458 bp, Homo sapiens
agaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttctcctgtcctccagcctccctgcttcccttgtggccgtgaaagcatcagtttgcacggcagaatgcaggagctgggagactgtgagtgcctccctccctcagcccggatggggctgtctcccggaccccagtggtggggtgggggaagggggtcggagaatcactcaggcagggccccagggtggggtcaggaggttcctgctctggcaggtctagcgagaagggagtggagatggggctggttcctggtgcagtgacggccccaaacgggacaataaagagtggacactcagttggc

SEQ ID NO: 698846 - DNA, 527 bp, Homo sapiens
tcttcctcctctggggcctgcctcttcctacccataagcaccagagccaggcgctgcccatgacagagggggcaggctggcctccctttccaccatcccggctctcccagggctggtcctgcctcagctcctcctggaatgctggccccctctccctgctgagcccctcctcccctcatgcgtctctctgcctctccacgcccgctccctccaggaggcggggggtgtgagggcgggcccgctgggctggactgtctgctaggggctgcgcgcagagacggaaggtcgcacatcgagcggccaggccccccgagtgacgaacgggagatacagggcaccacagccaagtcgccagggaaggaaaaccaggggcctagaaacgcacggcaggggacacagaggagccacacagcagacaggcaccccaaacgacaacagcgtccaacaacacaagcaaagaatcgcatagaaaacggacacaaacaagcacatacgcacacataaagcaacccaagaacagaacccgc

SEQ ID NO: 698847 - DNA, 633 bp, Homo sapiens
gcaacggtctcaagatctgcgagaagtttgggcccaatctggacacgtgccctgaaggcaccatcctgggactgcggctggacagctctggggggctgcatcttcatgttaatggggtggaccaggggtagctgtgccagatgtgccccagccctgccatgcgcttgtggacctctatgggcagtgtgagcaggtgacaatcgtgaaccctgagccagggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcctgaagattatttcatgcctccgccaaagcgaagcctgtgcgccctggctcctacaccccgggacccccttccgctgccccgggaatatgcactgccctttggctggtgcaggttcaacctcaggtactgctccatcctgagctgccgtcctttgaagggagaacctggggtagggttcgaggagcctggcgagaactgtgcacctcctcgggaggagcagccccctcctgtgctgctttccccctcc

SEQ ID NO: 698848 - DNA, 243 bp, Homo sapiens
accacacctgatgctcccacctcagacatgaacagaaccaaatctcatactcatgccagatcttacctccagacatgacagacccagatcctcatacctgtaccagatactgcctcctcagacattgacagacccagatcctcatgcttatgccagatcctacctcctcagtcactgacagaaccagattctcataattaataccagatcccacctcctcagacactagaaggtccaggtatg

SEQ ID NO: 698849 - DNA, 193 bp, Homo sapiens
tgtgatgtgagaatttagaatcttgagcaatgcattgcggacactcagcaacgtgcattttccagtgtcaccgtcatctcctccattgatgctgcagccacagcgacgtgaagtgttttctcagatgtggaatgctcttaactgtggtggcttttccagagaaaaccatggttgaaaggatactaggttgtga

SEQ ID NO: 698850 - DNA, 736 bp, Homo sapiens
gtgggcgttggacgggtggggcggcgtggtgtgggtgatgggggtggctgtggtttcgcccagcgcggttgggggcttgtcgtgggggagttgccgggcgttggctggactcaggggggaagagggccggtgtgggcggcggggcgcgggggggggacgctgtggtagaggcgccggggatgggggctcgctgggtgtgtcacggggagggggcacgagcccggagcgtcctggcggcgctccccccaagccttggtatgggcggcgagcccggtgagacacaggggtcgtattgcgctgacggcactcctctgggtgtccgcggcccccgcggccctccttccactgagtggtggtccccgcggcgtcgccgccgttaagcgggggttcttggtgctccccagtgcgcggaagacgtattggtggggctgtgcgcggcatgtgcgtagttagcctcggttgttgcggcgcgccccgtttgagttcgcgcgatggacacggtctggacgcgcagcgttcggcggggcacggcgggggtgaggctcgcccggttgagtacatgtgagtcctccggcttggcggtgccagcactgtgctgagggcctagcgccccggtggtgaaaccacgcgggaccgcccccgcggctggtggacttggacgaagccccggctgcccgcttgccgctcacgggtatgcctggcccgccttgcgcccccgttaattcccccccatgcc

SEQ ID NO: 698851 - DNA, 225 bp, Homo sapiens
cgcgaatcataagttacgtaaccatcaccacaatcaagatgcagagctgttctaacatcacgaaggaactcccttgtgctatctctttgtattcttattcacctcccaccacaccccaccttcatccctgtttcctggcaaccactaatctgttcttcacttctagagttttgtcattttgagaatgttatataaatggagccatagagtatgtaacttttaggg

SEQ ID NO: 698852 - DNA, 104 bp, Homo sapiens
cctgcgcttttatcacgacagctcaagacagcctggtagactggcagcatgtggagttgttacaaaagtgagtccactgggcctgtggaatgtgaggggagtgg

SEQ ID NO: 698853 - DNA, 120 bp, Homo sapiens
aacggttaccagcacatcactatctctgtgtctcctcctcctcctccttctatctcgttctcgttctccatttccttcttctttttcttctcattctttcttcttcttcttaatcttttt

SEQ ID NO: 698854 - DNA, 136 bp, Homo sapiens
ccctggtaaagtcggctcatattggcgggaatatagtattagggaagtaaggcagctggtatggaagcggggactctctagtttaacccctacggctgctagggaggcaggtcatatattactaggcgcagaatag

SEQ ID NO: 698855 - DNA, 1292 bp, Homo sapiens
gcgataagatgggggtgtggtcatgatgaatgattgccgcgtggtggttgcgttgtttgtggggttgtaggtttgtgtgatcgctgccgccagcgggtgggcgttgcgttctggatggcgacggccggtccgagggccccgtttggttgagcctcctgtccgggcggggggtcctggcgggaggggggcgctcccgggggggggtccgcccattgtgctcttcccgctgtggttgtccgacgccctcgcttggttcgcagatcggttccgccggccgtgtccccgcgagtgggggtcccacagggttgtcccccgcttgggcccgcttttggggtataccaccccaagggcccacaaaggggagatgttgggcgcaccaaggcgccccgagaaatatttgggcccccctgtgtgtgggcgggcccccctccggtgttagagattatgttttggagaacaggagataggtggtcgccccccgcacacttttgtctgtgcacagatgtttggggggagatatggggtgtctttgtgtgggccccctccaccaagatgtgttgcgtttgctcatgatgagatgttggtccctttctggaagtggagaagtgaagatctatgtgggggtgcgtaaataaacacgttgtataagagaggttagagagcgcttatatggtatatttggcctgaaagatgttgtgcccacgcgttattagcggtgggttcgcggcaaaataaagagggctaaacgggtgccccacaggtgtgtgggttactccacagatgagagaccccctcgtgaaaatgagatgtagcctgtcactcgttctcttttctccgctgtggtggttggtgcccgctgcctgctcttgccccaatatggtattttgtgacattttattggcactcttggttctcggtgagatttcacaggtttctggtgagaaatatatttttgggaatttctaatagccacactttaacacactcttttactagagtttctggcgctcacttgtgcctctgccctcgagggctccctctggctggcttgtgtgggccactcttctctcgcctcttttaccacgtcaccctgagacccactgagcccactcacttctcttgcttgcttgaaatcttgctgaaaatgttctcactttcccgctttgccgtaatgggctcgcggtgggaatgtttgttggctctggttgtgtttagttcaccccactttgtaccacattaatttgttgtcccttactactgtaaaccgtaaatatagtttggtattctgtcca

SEQ ID NO: 698856 - DNA, 921 bp, Homo sapiens
gaggcgagggcgccgacccacaccgcgctgcgcagttttgttcttgctccagctgttcgaaggtgatccagacgcaaggaatggttgtcctctctaaggaatatggttttgtgcttctaactggtgctgccagctttataatggtgtggccacctagccatcaatgtttccaaggcccgcaaagatgtacaaagtgagtatcctatcatgtacagcacggggaccctgaaaaattgggcaccatcttcaactgcattcagcgagcccaccagaaccaccgtgggaagtgtatcctcccttcttatattttctagctgtgtgaggtgtttaccacccgcgtattagcttctgcctgggcttgcgcctggatttgttggacgagtcctttatgcttacggttatacacgggagaacccagcaagcgtagtcgaggagcccctgtgggtccatcgccctcctgggcttggtgggcacaactgtgtgctcttgtttcccagcatctgtggttgggctaaaaggtgccttggcgcagtggccccaaattgtggccattacacagatttataggggggttaaaaaactctcatccaatttaaaatttgacttaccgttttatttcccccttttaacatttttttttctttaactattatttaacaaactttacctggagtcaggcctcattaccttagaagaaaagtaatgaaacacaacattttgtggggggccccgcctcgaaaaagtttaaaagacattgtggtgggggcgggcccagattgaagtgacctttgtctcaggtttgccacagagacctggtgtaagaaggtgtcggttcaccacaaaaaaaacccgcggggccggcgttttgagcaccccggggcgtcggcctcaggtcacacggccaaggctacacccgcgggg

SEQ ID NO: 698857 - DNA, 731 bp, Homo sapiens
aaggcgggggacacacgcccgagaaaagagatgagatatatggagagaggaagagggacgacacagcagtgtgcgccgatgatgatcgccccccaccagagaggagcccacagagagtagagcccccgcaccgcagcagagagagatgaggatacatataggacacacaccacacacatagagagaggagagaaatagatggtataacacatataaaaaaaaaaaagaaaagggccgccgcgcgagaagacactattgtcacacccgtcgcacacacttgcacacgctgtctccacgagagattcttaaacgcggggtgcacacactctcgcgagagtatagagagagaggtcccccccccaccccacacctcggggcaaagtggccccccccacgagtggaacaccgcgcgtttctcacccacacccccaatccgcccatccctcgtcgtagagagaatttgtccacacaagcgggagggagaaaaagagagccccaacgttcccaaggccccgccttttttttttaaaaaggatccttttaaaaaggagaaatttgtttgtaattttttatatttcaccctttaatatttttggaaaaattgttagggctcccccccttttatagtgatttcggggggccccacccccccttgggacgttttttttccaaatttgtgactttaccttttggggggacccagtgttcccttattaaattttaaaaaaaaa

SEQ ID NO: 698858 - DNA, 343 bp, Homo sapiens
aaccgacgcctttggagtagaacagttgcgtgctttagtctgtgagcctacgtgtctgcctataggagggggagctgttagggggtcgacctagcccaggagaagtggtagacgtttggctatcaccccaagaagatgtgagagggtgcaagcaaggttagcaactgtggacagagaggtcgtgatttgccctggcgtagggagagaggccaagttcagagctctctgtctcccccagccagacacctgcatccctggctcctctattactcaggggcattcatgcctggacttaaacaatactatgttatcttttcttttatttttcaaaggaggtcccggg

SEQ ID NO: 698859 - DNA, 137 bp, Homo sapiens
ctcgttggggaagagattggggcgacatcaccctgcgcttcaactggaacttccagagggacctggcgacgggaggcactgtggagtatgccaaacgaaaagcacatgctggccctggaaccccaaacagcaactgc

SEQ ID NO: 698860 - DNA, 477 bp, Homo sapiens
  misc_feature (2)..(2): n is a, c, g, or t
  misc_feature (85)..(85): n is a, c, g, or t
  misc_feature (126)..(126): n is a, c, g, or t
  misc_feature (278)..(278): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (302)..(304): n is a, c, g, or t
  misc_feature (308)..(308): n is a, c, g, or t
  misc_feature (313)..(313): n is a, c, g, or t
  misc_feature (316)..(317): n is a, c, g, or t
  misc_feature (319)..(320): n is a, c, g, or t
  misc_feature (331)..(331): n is a, c, g, or t
  misc_feature (334)..(334): n is a, c, g, or t
  misc_feature (343)..(343): n is a, c, g, or t
  misc_feature (345)..(345): n is a, c, g, or t
  misc_feature (352)..(352): n is a, c, g, or t
  misc_feature (359)..(360): n is a, c, g, or t
  misc_feature (362)..(362): n is a, c, g, or t
  misc_feature (367)..(369): n is a, c, g, or t
  misc_feature (385)..(385): n is a, c, g, or t
  misc_feature (389)..(389): n is a, c, g, or t
  misc_feature (395)..(395): n is a, c, g, or t
  misc_feature (401)..(401): n is a, c, g, or t
  misc_feature (408)..(408): n is a, c, g, or t
  misc_feature (412)..(412): n is a, c, g, or t
  misc_feature (421)..(421): n is a, c, g, or t
anggtcaaagcgggaaaccaaagagtatgtggtatccatattcgttgcaaaaatgataattactggaattttccaaacatcaaangaagggggatcaatggttaccactatcgttttcaaccaatntacagatgttcgctcaaggtctaggttttatttctacatagtagtattcacatgagttccctattctgaagtattatcaaaacgaggacccttgaaggtcgagcccagctttgtcttgacttcaaagatgacacagcagccatacctagaanccgggnttncngttngantncgannnagcnggtcngcnnanngggtacaatangcngtgtctcgnanaacgaanagcaganngnagagnnngctgaaacagggcggnggcncaagcngccgcnccagggnaccnagacagganaaaaaggtgctggccctgagcgtgcaaaacccaccaccaggaaaccaaaacggacc

SEQ ID NO: 698861 - DNA, 723 bp, Homo sapiens
  misc_feature (266)..(266): n is a, c, g, or t
ttcgatacaaactgtgtccgttaactaagttccagttgcaccactcaatcctactctcctctcgcggaaggcaataaatttttggcgtagaaaccacaatagccctttcgtctcaagcacacactcaaaaacataacatttaagcatctctcacgctcttcagatcacgtctccaccagctcaggtttattacacgcgctccccgctcgataaaaataccatgattgcgaaagagaagtctctcaagtatctttatctctagatancaaacaaaaccacccttctctagtgacagcaagaaatgatcgttcatatgaaagaaataagagttgttcctgtaatcagaagactatctatataattttgacccccccacacaaaaagggtactaaacaaattgtttgatatgtctatgaccggtttatataaaaagtggcgccccccaagagcatctctcaaccaacgagttacatacataattgtctctctcccggcgctctctcacagaaacaatctctctatttataccaagttctatttcactcatagaagactgtattgtttaaactaccccaccacaacaaccactatttttatccactcacccattgtgatcaccaggttgtcaagcactttcttggttctattatcatcttgtgagcaacccccttgtgaattaaaaaacacatgttgtgcaactttcataagcaataataccacaaa

SEQ ID NO: 698862 - DNA, 117 bp, Homo sapiens
  misc_feature (14)..(14): n is a, c, g, or t
  misc_feature (23)..(23): n is a, c, g, or t
tcaggatgtcactnattgcactnattgcattaatcaatactgcactttttgcaactgtggctatgacagcctgaacaagaaggttcctgttaactgcagtactttctgactatgatc

SEQ ID NO: 698863 - DNA, 170 bp, Homo sapiens
tgtgctgatcggggtatgcgtcgaattcataacgaccaggaggtagaagtagggtctcggtgacaaaactatgttgtgtagagttcagggagagagtgcgtcactatgttgttcctaggacgattgtagttggtgagggtgtccacttataatcatgtttgtgtattcgg

SEQ ID NO: 698864 - DNA, 433 bp, Homo sapiens
tatgattagacgtgactagatggagccacatattcctcagtccctccaggccctggctttttccggaatgtcatgtagttggaatcatacggtgtggagcgttttcagattggcgtctttcacttggcaatatgcacttaaagattcctccactaggcatgatggctcatgcctataaatccctgcactttgggaggtagagttgggggaatcgcttgagcccgggagttcgagaccggcctgggcaacgtggcgagaccctgtctctacaaaaagtaccaaaaaactggccaggcatggtggtgcacctgtggtcccagccttgggaggttgaagtgggagaataacctgagcccagggggcagaggctttgaggagccatcgtggcaccagtgcatgccagcctgggctggcgtgagatcccatctcaaaa

SEQ ID NO: 698865 - DNA, 105 bp, Homo sapiens
aacagctatacaccaacagccagctgctaaagtctgggtttattctcttgagccttacaggtccccaacacaataaactattatgtgacaatagggctttttttt

SEQ ID NO: 698866 - DNA, 1265 bp, Homo sapiens
  misc_feature (387)..(387): n is a, c, g, or t
  misc_feature (979)..(979): n is a, c, g, or t
  misc_feature (1100)..(1100): n is a, c, g, or t
taacaaatagcactttttattggccacctattggaagtctgaacttaaaacagattctgggacggggggttcatatccatcagcgtcgtttcaacttttagccaccgtgtgtctcgttccccagggggctttcccaaaactagcgtgccttcaccagtgaagcctccagtgagcttccccaattcaaacgtggggacttcttcgaccatttataactttcctaacgaaagaacttcgaggggagagaggcatacaatagaagtgggcgaagcgcctttctctagtgctctttcccaagggcgtgtcgggaactcaatttagtggcccctttcttctcaagctcatgtgggtcgtgccacctcgctgcgggctcgcagtgaattctcnccatcaatactgtcatctcgcggaatatggggcggacaccgtgtgtgtgggtgcgtgaagcacataagagagggtctcgccgaaaatcgtgaatggggggcgtattttaagctaaaagaacccaaacaacgagaaaacagaccggagagccagagttaaacacatcgcggtgaacgtcctgtgcgacactctccaacgcggggagagccttccaacagtacagtggggttcggcgccaatatcttggggaagaccccagggggaaaccaccatttttggggccccgcggggtcaacgaaatcccactggtgcgccatgggggaaatgttttacgctccaggggccaaggtaattatatcaccccgtggaaatcaattctttttccacgtaaaatcacaacggcttgagagattttcttctaaaaatgcgcgccacctcttcaaatcacattttctcggcggaacatctatcccggcaaagaggacttcacctctttccaaaaaacaccacacgaaccccctttgtgaggaaccccatatccaggaagatgtcaacaccgggggtggtcccccccatgggggaccccccggtngcgggacaaacacacgcgggtgttttgctcccacaaaactaatctctttctcattaactattgcgcgaacccactcggcacagcaggggggcgttccaccacattttcttataccacccancatctcttttcatgagaaaaagtggggtggaacccccacacgttccctcagtggcggcacccccaattaatagagagcgcagcactaagcaaaaagcggccggctgtgttagttgaaacacaacaccgctgctgtttgggtagcgacatcattcatcacagtcgc

SEQ ID NO: 698867 - DNA, 646 bp, Homo sapiens
agcatctagagcgagagcaggctcttgctaaacagtttgcataaattctccatttcacactccgggtttgatgaactcaagatgacgaatccgtgcctatgacgagaatgatatcatgcgtattatagaagaacatggagtcgtatgaggattaacaatggtaccggcagaaggagaaaatgagagtaaataatgaagtgggcaaatcgaatgtcttagtaaaatgctggaggcgaactcgcaatgcgtgaaaaccttgagtgatgccagaataaaatttgtatcagagaataaaaatttaccaatagaaaatagcacagatggttaaagcagaatggctagtgtatgcagagtcatgctggaaacaccgtgaatacagaagcagatttacaaatgaggagacagtgtcattctgctggagggtaatggtgggtgtcataatactctatgaccacgtagcatccagtgggagtatttgtaaaatttccaaaattgatatgacacggttgtctcacaagttccttacggaccaaagctccataaatagctgtggcacgggctttcgtacaatggtctcagggtacagaacgaaaacatttggagtgttgcgactacctccaagccaattaaatccatgcgggaataa

SEQ ID NO: 698868 - DNA, 292 bp, Homo sapiens
  misc_feature (44)..(44): n is a, c, g, or t
cttttactggcttaaatagccgaccaattcagcctgttaccaantccttgcaattttgggaaaaaaaatatttgaccagatacaatgctattttacagtaaacaaatatagactttcatcttatagggaagttcattaaacagttcacatcacctgcaaaactcattccaagcaacacaactcttaacacatggctcaaaacacgctcagtgcagccaaacactatgcacaaccctcactgagataacacgtcgacgcggccgcgaatttagtagtagtagtaggcggccgc

SEQ ID NO: 698869 - DNA, 110 bp, Homo sapiens
aacgttggtcttgagaaacaatcactgaagataagggtacttgggaggcccagacgggtggatcacttgaggccaggctggtctcaaactcctgggctcaagcagtcctc

SEQ ID NO: 698870 - DNA, 348 bp, Homo sapiens
  misc_feature (239)..(239): n is a, c, g, or t
  misc_feature (243)..(244): n is a, c, g, or t
  misc_feature (255)..(255): n is a, c, g, or t
  misc_feature (257)..(258): n is a, c, g, or t
  misc_feature (287)..(287): n is a, c, g, or t
  misc_feature (295)..(295): n is a, c, g, or t
  misc_feature (307)..(307): n is a, c, g, or t
  misc_feature (324)..(324): n is a, c, g, or t
  misc_feature (327)..(327): n is a, c, g, or t
cagtctctcctcctcacagaagcctggagctgggcatccaagaagaagcagcctcatttgttttctggtgtcatcgtaggtggccacctatggcttttgggaccaaaaagaagaatgtacttcatctggttgggctggattccctctgataagccttcccagttgactgaaagatgaggctaggctctagcaagttgagagtcaaaccagctccttcaagaagctttgagcagaatgangtcnnggaggacccancnntccagcccaggaagcccactgtacctggngccatctnggataagctttnacccatgctcccatatncanagcctgtcatcctagccatcc

SEQ ID NO: 698871 - DNA, 574 bp, Homo sapiens
tcaacgagcaatcaagacaaaatgtggtaccgttagcctcaagaatctgctgtttagctaccattgctgcttctggctggctggcctggctgtcatgactgtgagcatcctggcgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggacgtgtggtcccagacagctgctgcaagacggtggtggctctttgtggacag

SEQ ID NO: 698872 - DNA, 351 bp, Homo sapiens
tccaaagaaaaaaattcccgtgaattgtgccgaaatgctggtttttcccccctcctaaagaaaacctttcccagggtgttttggagtagaaaaaaggttataaagttgggatctttaattgtaaaattaccccttgagtgtccaagttttaaaagccgaactccttttgtgccatgaacctaaggaaagactcctgtataggtttttttttttttctccctttaaatgaagaaaagctttgcttaagggttgcctacttttattggagtaaatctgaatgatcctccccccttggagtaaaactagtgcttccccgtttcccattgtatttagcttctggttggaatttga

SEQ ID NO: 698873 - DNA, 594 bp, Homo sapiens
gagtctataagacagaagttggcacttggaagctactttgatgatggcccaggaatctataccagctgtagcaaaagtgggaagccaagcctttcctcccgactgcagagtgggatgaacttgcagatatgctttgtcaacgacagtggcagtgataaggacagtgatgctgatgacagtgagactgaaaccagcttggacacccccttgtctcccatgagcaaacagagtgtcttcctattctgatagagacactactgaagaggagtctgaatccttggatgacatggactgtcttacaaggcaaaagaaattgcaagctgaagccaaaatggcccttgccatggccaaaccaatggccaaaatgcaagttgaagtggagaaacagaacaggaaaaagtatcccgtcgctgaaacttgaagcagcaaaggctgaaaatgcaggaagtgtttgggaaccagaaatggttgacactgtcccaatcctttccccaattatgccaacctgcggttctctcccgccgcttcgcccccccccctgtcattcactacacattaagtttgtttatttttaccttcctactgtaggactga

SEQ ID NO: 698874 - DNA, 141 bp, Homo sapiens
caggcgttcacgtggctggacatctgctgctgcacctgttgacgcctgttatcacctgtggtcgacagcccggctgtggcgccggcacgttcgccgccttcccgtgaccagtgtcgacgcccagcgcaagctcgacccgaa

SEQ ID NO: 698875 - DNA, 171 bp, Homo sapiens
  misc_feature (94)..(94): n is a, c, g, or t
  misc_feature (154)..(154): n is a, c, g, or t
ccacattagggaacttgcctcaaaaacagtccacaagtgggcaatacccggcttctgttcaagctttttaaaagtgcttgagcccttacaaacncccttgaagggaaagggtgaccccttttgaagagggaatcatcttttttttttaattttnatttttcaccctggggt

SEQ ID NO: 698876 - DNA, 156 bp, Homo sapiens
cactatataagaaaactcacctcagaatctattgactctattagagggaaaactcacctcagaatctattgactccattaacccccaaaggccacttgagtgccccacccgcagcataaggacacacaggcacaggcattgcaacacggtctctca

SEQ ID NO: 698877 - DNA, 812 bp, Homo sapiens
ctctgaagacttactatttgatgtgctttttaatcgataccgattcacaagtttaggttatagaaaacaatactacttcgatgctttggagctgggaaatctggggcgcgtctttaagcatgactcttatatatcagtatattgaaaatagccataagagaagtagtaatattcagacaataatcactggacgaccaagaaatggattgatacgtgagctgtacttcacatgtatgaactagttgtagtggcgaggcttcttacctcaaggtacgatgcatgctcgggtaaggcgagtcaccctgagagtcagagcaggcgatacggacagtaacgcagatatctgtgaccactactaaggtctaactggtggatagtagtgtgtgcctcatagcgagagagtgacatgaatgcgacgttacaagaaggtcaaccatcaaacatctcaactgccaaccaatcctaggcagacatttcgcgagggactttccttatcgagagtctgtacagacgttacatgggatatttagcacatactagcatgcaatgaactggctatagtaaccaaggattgcttatttccatatttgcgactgtgaccctgctaagatgaactcaaaaggccgttgcagtgaccctgacacccaggtgcctaagtagtaactaggtggacatgcatgggactatgaggtgtaatagcagtaaagtaaccatattaatgcactggacttttgggatggtgtcgtccaaaaattcattggagcttgtaaaaacttagacgtgtgaagagtgtgtggagtgtgagattgtat

SEQ ID NO: 698878 - DNA, 534 bp, Homo sapiens
  misc_feature (148)..(148): n is a, c, g, or t
acggtcgatcatctgcgcagtttggccatatctatacatctttttatagtgtctgattatgaaaatgtatctatgaaatatattcctttagtatatgaggtgttccccatgtgatgacatggtatttgtaatttctgtcatgtacttngtcatttcaaaatgacatggccctttatcattgaaagattatactaaggagtataactgttttccataattttgcagatttcccctaatctgttaatgttgaaaactactgtttgattataaattgtatattaaattttaccatcagtgtgaaattcactaagatagagttatggagatagtgtctaatgctgcaaacagtctgtgtagtacgatacagtgacccagtgttgttctttttgttaacaggtaagaaaagaagtttttgttttacgttttctcaaattcctttggagtagaagtgttttatcttcattcctcaaggcaccaagcctaatgccattgacccctttaagaattcgtttttgaattgtctgagactttatg

SEQ ID NO: 698879 - DNA, 220 bp, Homo sapiens
atctctattgtagtttactagttaagtatgtattttgagatggagtcttgcctctgtcacccaggctggagtgcagatggtgcaatctcagctcacatgaaacctctgcctcctgggttcaagtgattctcgtacctcagactcccgagtagttgggattacaggtgcccaccaccaaacccgaataattttagtatttttagtagccatgtggttttgc

SEQ ID NO: 698880 - DNA, 347 bp, Homo sapiens
ctctagaggatctcccgctctccacccaccccgaggctgcagtttccagctgggtgagtgctacgcggggcccaggaggggtttgctttccgtccgacctgccacgtcctgggctctgctccgggaggggcctagtgcctgctgccaccccttgtgttcacaggcccaggctctgcctcctgccaggacgggggaaacagatggaaagctggggccgggagagtatctggaatggaccagggtgacagtcggtgacaaggacccatcacccagtgtgactgttcttaacctacagggctgggtgggacttgaccagctggcctgatgttggggtgggtggagagcgg

SEQ ID NO: 698881 - DNA, 654 bp, Homo sapiens
  misc_feature (145)..(145): n is a, c, g, or t
  misc_feature (393)..(393): n is a, c, g, or t
  misc_feature (398)..(398): n is a, c, g, or t
  misc_feature (422)..(422): n is a, c, g, or t
  misc_feature (454)..(454): n is a, c, g, or t
  misc_feature (470)..(471): n is a, c, g, or t
  misc_feature (480)..(480): n is a, c, g, or t
  misc_feature (485)..(485): n is a, c, g, or t
  misc_feature (490)..(490): n is a, c, g, or t
  misc_feature (532)..(532): n is a, c, g, or t
  misc_feature (548)..(549): n is a, c, g, or t
ggcacgagggagcatggaataattgtttcacagaagagggaccttcttcagtcaggtttactcctgatgggaagtacttgattgtggcccagctgaatcttagcaggctctcagtcgtagcagcacccccagtgggaagcattgnggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcattaggttcataatgtttctttcccgggaatatttcaagtggcagttcagattctcaattcactaagtgcttaaaaatgatgttcaagcacaagaatntattnttctagtatgatctagtatcaganagattcggttttgatcattaagaatcttatantttggtgccctctggnngactagttntattngtaangtgcataaggatatttaatgaaaggaaagtactaacaatggngtgggaagaggactanngtgtacctcattattgcctgtagatgatctcctggtaaactactaatgctgtgaagatgataatactatgtatgagcacaagtggctcgctggcgatcttggctg

SEQ ID NO: 698882 - DNA, 392 bp, Homo sapiens
  misc_feature (11)..(11): n is a, c, g, or t
  misc_feature (368)..(368): n is a, c, g, or t
ccgacgttganttatagaccagtttgagtaagtactgctttttttttttgggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttgggttttttagtagagatggggtttcaccatgttggccaggctcgtctcgaactcctgacttcaggtgatccacccatctcagcctcccaaagtgctgggattacaggcgtgagccaccatgcccggcccataagtaccgtttgggaggttcagtcttaaacatntgctttaagaaaacagtcttgaat

SEQ ID NO: 698883 - DNA, 478 bp, Homo sapiens
gaaagctgtgtagcgacatcgatgctgcggtactgcgatgtaggatatagaagctctgcgcggcgggacaaccagtcttcgacctgggtctacttgatcggcagttgcttgcgcagcacatcgaacatggcctggtagcgctcgcggaacgagtcgaagtgataccccagccgcagtgcctcgcgcttgtcattcaatacgctggtatcggccaggccgcgggcgctgagcacttccagcaaaccgttgggggtgatgttgtccaggccggtcaattgcgggttggcgctgccgctgcgcaacagtttcaggctttcgaccgcacagttgtaggagataaagaagtagttgccgtcatagctccagtgcatctcagccgcatgttcgacggtgtcgtcgatttcctggcggctgagcttcagcggcaccgacgccaggccacgcagttcggtcttggtgtactcatcgatgacctggg

SEQ ID NO: 698884 - DNA, 215 bp, Homo sapiens
gctgtagctgcaaagtggatcttccagatgacttgattggatactttagtatattcttaaatcgagaaaaagaggattgagccttttcttttgtacggaagtttgcaagatttttatctgccttatgtttctttcaccagccttcggatcaagagtataagattgtgctaaggaagagttattgggactctgcctatgataacgatttaattgaa

SEQ ID NO: 698885 - DNA, 100 bp, Homo sapiens
atctttgcatacatccttaaatatttgctttaatacagtacaggggtaaaattacaggaccaggctgggcgcagtggctcatgcctgtaatcccaacact

SEQ ID NO: 698886 - DNA, 388 bp, Homo sapiens
aagtatgatatggagtgcacgtggatgaggaactgatgctggctttgaactaatgcatgtgtcaggaagcactgggaaaatgtggcatggtgttagagagaggccaggaagagagagacagtgcactctatagccttggtgcgtgtataagtgccagtgagatcaaggacgaagtgtggacactgcagattagtgggcacatgccttctccctgcagattcaacacccacgtaggatgaaacacggtgcacaggcaaaggtgacaacgcagtccatctgcggaatgtcttggctccctgagctggagctgttgctctcgcgtgtaggatataacgcttgccaccccacctaccagtgcctgtcatcctgtctagcgcctgttctgtcc

SEQ ID NO: 698887 - DNA, 339 bp, Homo sapiens
  misc_feature (249)..(249): n is a, c, g, or t
gggggggcccccccccccccccccccccccctctgtttgggaaaagggattttgggaaaccccaggttttcccccggggggtccccccccggggggggggggcccccccccccaaaggtttcccccggggggggggtttggggggggggggccccccccccccccccggtttccccctgccccccccccccccttgggggctggccccctttttcccgggggggcccccccctttggggggccccgggntttttttttccccccccccccccccccccctggggttttttttttttttttggggggggggggggttttttttgggggttttttccccca

SEQ ID NO: 698888 - DNA, 127 bp, Homo sapiens
tgtctccgtacccattacaatctccagcatcccctcctcaggatttgatgacaggctacgatgaagggtttgatggaaggtttgatgaagggtttcaatgaccagggtttgatgaagggtttgatga

SEQ ID NO: 698889 - DNA, 302 bp, Homo sapiens
caggtctctcagaagtaaggacgatagacacctcatcatgaaaggagtctcaaacacatcctttggaacttactatgggtcccagtttaggtttgtcgttcgttgtattttctgtaacagaggactatactcagtctgcatgtaacttttatgatagttattcccaattccagaagaagcagtattaacatcaattgatcgacacaaagtaatttttaatttaattcatcatttcacatgtttgtactttgtcttcccattaacctttgccagtgttatgattgtataaatttttttaaatg

SEQ ID NO: 698890 - DNA, 211 bp, Homo sapiens
tttgggcccccccggtttttcccggttttttgggggggcccttttggccccccttggcccccttttgggtttttttgcccccggtccccccccccccccctgggggggccggtaaatgtttggggaaaagggggaaaaaaggttttttccctttttttttttttccggcccctgggggcctttttgttttttttatttggggtttttttta

SEQ ID NO: 698891 - DNA, 215 bp, Homo sapiens
cggttagcgtctgaatcctgagaacaatccccaggcagaccctgaaatcagacactagacttcccgttatgtgaggcaatgaactcctactggttaagccactttagttagtagttatctatacttgcaaccaaaagcaccccaaatgataggaacactgaggtctgtgatgctcagcttcccaaaggtgtacacgaaccactttgtaaatactc

SEQ ID NO: 698892 - DNA, 965 bp, Homo sapiens
gcgagaggctggcggcgacagggagggaggaagcctatggagtcctgccgctgggacggaggcctggtgggaacttgggagttcagcgtttcgtgcagagtggcccactaggaacctcgtgattgcccactggaaagccaagccacgtttctttggacaagtccgagcaccagcctcgctctatcgtgccctggacgaaggctcctagtgggcttggcctttgtcgcatcagcagcattccttcagcaagggacccaaagggagacacataagcatttacttgttacagaagcaccggtggaccagcatcgtttcaaaagtgaacccgatattcgctgggctccgcacgaaggcatttagcagccgtcacacgacgtgcagtgcctggcaagctggatttagtgccgccgtagtagaagagattgtgctgacaacagctaattctatggtcttcgcagagtgaacactgccgacggtacatggacgtcacagagcttgctggctgcactgctgcagcacagtacgaaggctaaccgggcaacgtgactggccgcacccatactaaaacgccttgagggtaaagatacgcagtgcgcaagcaagttaacttaccgaacagctagatgtaagtagccaataggtggaggaagaacactatcggttcggctacccagagacccccgggcaagagagcgggtagctggacccagggctagccgggcagcagtcgggatcaaccgggaagctggagggcctggacgactgacaacttcgcaggatgacccccacgccggactcccatcagactacggcaggagactggcctcaggcggatgaccgatgcggacacgtggaacgaaaagagaagaaaaaccggaggtgatcattgtaaacctacgcctcccgaaaaacgctgcaggcctgtaggacgtaccaccctgacggtggcaagggccctaagtacg

SEQ ID NO: 698893 - DNA, 833 bp, Homo sapiens
cggccctggtacgcgcgtggggccgcatggttagcgcggatacctgtggtggtattgccgtggcccccacgttgttgggggccccccgtttgtttacccactgcggctgtctgatgtgtccgtcggtctcccccccttagtttgtcggccgtcacagcgtctttccccagggctttgtcgcattgtgtggtgcaccccggtggggttctagaacggaaacggtcatttatttgggccacgggtaggcccgcgggaccagaaacttcgggcccggccattcgttgggcacaataatgtgcaggccctgtccacgatgggcggtccttccccccagggtctcccttctagggcgaagcggccccccaaaacccccttctgggcgcactggtctggacccagaaaaaacactccggccgcaactgtgtgggtttcaccttttccctccacaaagccccccgttctaaaagggaaaccgttggccaagccccccaatactacaaacgttgacaaaggttctccgcatacacttgccaatgcagcttgggaaatttctgggtgtgcttcctccgagtcagcaacagtagtgctttccagagagccctggctgcagcagagccgccctgtttcgacgccgatcacaagaacggcgtgcctagttgctaagctatagccctctactcttcgtgcggggcaataacgcctgtaaactctgccgcgttgagcagtccccgcgttgttggcacatgtcggacgaccaacttcccctgggaacaaacttctcgacggcaatactccccttggctccacatcaacaattttctcgcccacataac

SEQ ID NO: 698894 - DNA, 103 bp, Homo sapiens
aaaataaccccccccaaaagggacaaaaaaggggggccccccccggggggggccggtttaaaaaaagggggccccccggggggccggaattcggcccggggga

SEQ ID NO: 698895 - DNA, 366 bp, Homo sapiens
  misc_feature (4)..(4): n is a, c, g, or t
ctgngaggcagatgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtt

SEQ ID NO: 698896 - DNA, 396 bp, Homo sapiens
  misc_feature (62)..(62): n is a, c, g, or t
  misc_feature (106)..(106): n is a, c, g, or t
  misc_feature (137)..(137): n is a, c, g, or t
aaggatggcacactgatgtgtttatgcacctgtacacaggaaccgcatggccatggctttgnaaaggagaatggaaaaatagaagaaggtcggccgggcttggtgncttaagcctgtaaccccagcactttgggagnccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaagg

SEQ ID NO: 698897 - DNA, 655 bp, Homo sapiens
  misc_feature (17)..(17): n is a, c, g, or t
  misc_feature (103)..(103): n is a, c, g, or t
  misc_feature (109)..(109): n is a, c, g, or t
  misc_feature (117)..(119): n is a, c, g, or t
  misc_feature (123)..(124): n is a, c, g, or t
  misc_feature (126)..(126): n is a, c, g, or t
  misc_feature (136)..(138): n is a, c, g, or t
  misc_feature (140)..(141): n is a, c, g, or t
  misc_feature (147)..(147): n is a, c, g, or t
  misc_feature (149)..(151): n is a, c, g, or t
  misc_feature (153)..(156): n is a, c, g, or t
  misc_feature (284)..(284): n is a, c, g, or t
  misc_feature (297)..(298): n is a, c, g, or t
  misc_feature (301)..(302): n is a, c, g, or t
  misc_feature (462)..(462): n is a, c, g, or t
  misc_feature (465)..(465): n is a, c, g, or t
  misc_feature (493)..(493): n is a, c, g, or t
  misc_feature (497)..(497): n is a, c, g, or t
  misc_feature (506)..(506): n is a, c, g, or t
  misc_feature (553)..(553): n is a, c, g, or t
  misc_feature (568)..(568): n is a, c, g, or t
  misc_feature (615)..(615): n is a, c, g, or t
aaaaaaaaaaaaaaaanaagccacttcactcacttcaagacctatatacatgtaaagttgtattctgaggaattatttattttaaatcttttttaaatttttnttattntttgtttnnnatanntncgaggggggnnngnnggcggngnnngnnnngagacgcgcgagtttcaggaaaccctgccccagcagggcaggtaagcaacactctccctgcccacatctagtttgatttcacgccctgatgcttcaaggtgcccagaaaagcggcagcttgtggaagnggaaatctatgcnnggnnggtgcttggggcccagggctcagtaagctttcgagaaagcagaggggaagactagcttactgcaaaaacctttttaaaaaatattcatacacttcagtgagcgcctgttgagacgttaggggaacaagagcttggaaacatcccgtccaggccattgggnggnagcgtcttcctcacaccccgtccctggnggtngggggggcngggggaaggtcccggctcttccactggagaaaggagactcacctggnttcctagttcatttntgactatttcctctaaaacctgtgctgagtctttgactgcatggcangggaagcacaaacgttcggcttgtttgcaaaaaaagtaca

SEQ ID NO: 698898 - DNA, 505 bp, Homo sapiens
tggactcactctgcttatagtcttagtaataagagctagtgttgataatagctaagaatgtaacgacacttaccatcataatgcacagcgtatggcatgccgagttactaggctccggtagacatggggtcacttggaacaagattgagtgtgcctatgaccgattgactcatgcagcttgaggatcattacatataaaagcatgtgatctgtcccgcgtggagattacctcgcgagccaaccatataccgaggttgggtgcatggcaattcatggagacactacagagacagaggtattctccgaccgataaagaatgcaacctggttatcctgtctcatggtgagatttctacccgtccgtggatggggcatgctgccaagtatagtacatcagtcttcttgtaaaggatcccacatggcttggtacctgttcagccatcggccagtgaaagtgttgtgcctgatggtggtgaggaagggaatcttagaagatatacagttgg

SEQ ID NO: 698899 - DNA, 130 bp, Homo sapiens
tataagtgcaggaatgtcaccctgtagtctcaggtctatcctgtattggattctgccaataccagccaaatgactgacaatgcaggcccccttggcagaccagatggagccatgaactcagtcgctacag

SEQ ID NO: 698900 - DNA, 520 bp, Homo sapiens
gactctaaggatctcaatgacgaacagtgtgacaggtgctacgtggatattattggcataaaaaggatggagttagatacatctgtacacagatgatcttgaaacagtatcctcatagaagaagcattcacaaaagtccaatgactccatttatatgacacgggcagagtaagcaaatccacagagacagaaagcagagtagaggctgctgaaggctaagggaaggatgaatgggaagtgacagctaatggatattggatttctattttgagatgatgaaaatattctaaaattagactgggggtgatggttccacaattctctgaaaatactaaaaaccatctaatcataccctttaaaagggtagattttatggtatgtaaattatacatcaaggaagcagtaaaacaaacatcatggtcaagatgaaggaccacatcaagtcaaacacaacgacaatgttttaaataggttggtggagataatcgcacagtcatttgctggctcttttggcactgtt

SEQ ID NO: 698901 - DNA, 844 bp, Homo sapiens
gtatctcctttctgtaacctccatggacctgtgacacatgaggtcactcttctcacccgccccaccgtctggcagggtgcgctgattttgccctgccccacccagcggctttaggactcagactcttcaggaacaattagggagagggcccttggggtctaactgcgatacactcatacttggaagctaggaaaatcccggtgggcgataggtatggattgtcatacttagaacacatttggcgctagtgtgccccgcgggaacactctgtgctgtgatgctcgttaactggatgtctgtgcacccatatgacagaaggcaacctgagctctatgtaagtgtcgggaaatgctgagatctggagaggtggaaacaggcttcttctgtgggtgtgacgaccttgtgcagagctcgttctagaaggagagttgcgtagaccacagcgtgaaatcactgatagaaaactggccagccaggcctccagggtagggagcaattcctagacatttgcctgtgtccctgggggacgctggctggctgtgaccatctcacgtgggaaattcccttctgtggcgaggttctgtagtgttccagaggctcccacggagcatgctgggtggcgtggtctgtatgagaccacaccgttgatgaacccgtggagggccccagcaggttttttcaacaaatggtccagcatcggtgatccattccgggaattggccctccatacaaccttgtgaaaggtgcctcacaccggccaatgggtcaggtcacaaaacacatgtggtggatctgaagagaaacagaacaacccgtgggaaaaatgtggacacctgaaaaatat

SEQ ID NO: 698902 - DNA, 616 bp, Homo sapiens
aacaagcagaggttggaacagtttggagggctcacgagaagacagggaaatgtgggaaagtttggaacttcctagagagttgttgaatggctttgacaaaaatgctgatagtgatatgaacaataaggtccagactgaggtggtctcatatggagatgaggaagttgttggaaactggcgcaaaggtgcctcttgttatgttttcgcaaaaagactggtggcattttgcccctgccctagaaatttttggaactttgaacttgagagagatgatttagggtatctagtggaaaaaaatttctaagcagcaaagtgttcaaaaggtgacttgggtgccattaaaagcatttagttttggatgcgcacggtggctcatgcctgtaatcccggcactttgggaggccaaggtgggcggattatgaggtcaggagttggagactagcctggccaacatagtgaaacccccgtctctactaaaaatacaaaaattagctgggcttgttgtcagatgcctgtaatctcagctacttgggaggctgaagcaagagaatcgcttgaaaaaaacaaaataccaacaaagacattgcggcgcattttgagctactttggccaattc

SEQ ID NO: 698903 - DNA, 1104 bp, Homo sapiens
  misc_feature (7)..(7): n is a, c, g, or t
  misc_feature (10)..(11): n is a, c, g, or t
  misc_feature (17)..(17): n is a, c, g, or t
  misc_feature (19)..(20): n is a, c, g, or t
  misc_feature (22)..(23): n is a, c, g, or t
  misc_feature (27)..(28): n is a, c, g, or t
  misc_feature (36)..(36): n is a, c, g, or t
  misc_feature (65)..(65): n is a, c, g, or t
  misc_feature (73)..(73): n is a, c, g, or t
  misc_feature (79)..(79): n is a, c, g, or t
  misc_feature (98)..(98): n is a, c, g, or t
  misc_feature (109)..(109): n is a, c, g, or t
  misc_feature (113)..(113): n is a, c, g, or t
  misc_feature (118)..(118): n is a, c, g, or t
  misc_feature (120)..(120): n is a, c, g, or t
  misc_feature (122)..(122): n is a, c, g, or t
  misc_feature (768)..(768): n is a, c, g, or t
ctgggantcnnagaggntnncnntcannctgcgccnggtgatcgagaaggagcggcacagctggnggaatgcnaggagncgtccatctacagcccggncttccccaggnagangtggnangngaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacgggctcacccacgacccactacgccagaaggcaatgtttctggcagagcctggtgcaggaggtagaaactgaacattcgngggccgggctatggggtctccccacacaatgtgggccgggatatacgcccggcagcctggcggcgtgaccacggaggcaagaaccttacatacgtggcccggccccggcggaaagcaaagggcagcagtgccagtcacgtggtccaacgggctaatgtgggccccgcggccagctggaacagcggcaccaacaccgcatgctcctcggagccccgacacgtctcttggcacacacatcacgctgttggcgcccccggacacgtcgcgcagaacaacgtacgacacgacgaccaacaggacaggagcggggcaacacacaccaggcggacagagaga

SEQ ID NO: 698904 - DNA, 159 bp, Homo sapiens
  misc_feature (49)..(49): n is a, c, g, or t
  misc_feature (93)..(93): n is a, c, g, or t
cgtaacccccttccgtaacgacgcctaacgaacgcctccgtaacagccntccgtaacagcgccaccaagaaaagaaaaatcgcgatcccgatntaaaccattctagggcgtcgttacggaggcgctcgttacgaggcgctcgggcgcatcgttacagat

SEQ ID NO: 698905 - DNA, 730 bp, Homo sapiens
  misc_feature (135)..(135): n is a, c, g, or t
ttcaagaccagcctggccaacatggtgaaaccctgtctctattaaaaatacaaaaattagccagatatggtgttgggtgcctgtaatcccagctactcaggaggctgaggcaggagaattgcttgaaccccaggngaggctggaggttggcagtgagccgagatcggcatcatggcactccatcctgggtgacaagggcagaaactcgcgtctttaaaaaaaaaaaaaaattgacctgcccccttatccccaccccttggcactctgggtttccttccctgttctttgtggtcccattaggcttggtaaaggccaacggtttaggggtcactaacatggttgcgcatgctatgtgttctgccatccatgtgcagctgaaaatataaccgtgtgaagcgccagggatctttgggccactatggaactccgagcatgaattggtccaccatacggagcatatccaataaatagcctgctgcaatgccctggactcagcaggggactttgggaaagcggctctcatggtctcaggacatgggtcgttcggtcctgccagttgctcgaaggagaacctgctcaacctctgaaggaactccttattcccggggactccgtatgcaaggaagacattcacggtaggctgatggatctggccttattctcccgtgctgcccatttttctgacaccgtgtccatgtgtcacaggggtagcttatagactgacaatgaa

SEQ ID NO: 698906 - DNA, 342 bp, Homo sapiens
  misc_feature (141)..(141): n is a, c, g, or t
tcatgtatacaactaaggcatatatactgtataaatatggagatacttctaatgcctctctaaaattaaattttacataaaagttagttttattcacctttagagctttccaagtgaaatggtgactaaatatttttcaantctatacataggattctttcaccccattaagcattactatacggtagataaattctattatggcctatgttatatatgcatatataattttctaagtgtatacatattaaaattacacaaattgttcattggtggtttgtatccccagaatgtgttgtgttttttaaaaagatgcataatagctgaatgtatacatgaaca

SEQ ID NO: 698907 - DNA, 181 bp, Homo sapiens
gtggttggtctagtgctcagtggagccttaaacagtacaggttcaggcgattctccagcctcggcctcgcgagtagccggtattgcaggcacgtgacaccacacccagtttttgtttttgtgtgtgtatattccggtagagacagggtttcacaatgttgctcatgctggtctcgaattcc

SEQ ID NO: 698908 - DNA, 496 bp, Homo sapiens
  misc_feature (54)..(54): n is a, c, g, or t
  misc_feature (56)..(57): n is a, c, g, or t
  misc_feature (74)..(74): n is a, c, g, or t
  misc_feature (102)..(102): n is a, c, g, or t
  misc_feature (109)..(109): n is a, c, g, or t
  misc_feature (114)..(114): n is a, c, g, or t
  misc_feature (160)..(160): n is a, c, g, or t
  misc_feature (479)..(479): n is a, c, g, or t
  misc_feature (481)..(481): n is a, c, g, or t
aaatgctgaaatcctattggcaaagtaaactgaaattggctgctatattttatntnntcatttctgcaatcccnttttttgaatactaatatttgacatggntaattcntattnatttgttggaattgtttattgttaataatgcaaatagataattttnaattatccacaagtaacatttcactgttaatggtttgaaataggtgataagcaaacgcaatttaggataaaatataaacatgtgccattgtattataacactatacactggcacaagtaacatttcactgttaatggtgggggggggggaataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgancntttgcaaaaaaaaaa

SEQ ID NO: 698909 - DNA, 1669 bp, Homo sapiens
cggcaggaggaggacggggaaggacggagccgagccgcggctgccttccctcgcctcactccctcgcgcacatcgcccgcccacatacacgtagcatacacggaccgtgacagaggcaaagagtactcagagacaaagcgaaacaaataagggaccaggattagtaacagagaaagaagagcggaagacggctagagccaggcacgacaccacgccgaaccgcgacgcccgcccaaagccggcccggacccctaccaaagacgacacccaaaccacagcagaagaacaaaccagcaacacccacagacaaacacaacacaacacaacaacacagaacaccacagaacgaaaacgaacagaacacaacaacacagaagaggcgaccaaaaaacagaacagaaatacaacacacaagagaaaacacaccacagagcaggacgaacgacgaccaaccaaccagaaccaaacagagccaagacaagaaacaaacacaaaaccagcagcacccgtaacagcacaacacaaccaaacagacgccggagagcaacacaggaccaaagaacgagagacacacacacagccatatacacgagaacagcacacaggcacacagacagagaaaaaaaagaaacgacaggcacaaaacagcacacacacaccacaaatagaagaaaagaggaaaaacacaacaaagagagcaacacgagagacagcacagaagaacagcgaacagcgacgacaaaacagaggaacaggaagacacacgggaagaccacgacaccagacgcgcgcacacacaagaaccagacgccgacgacagacgacaacagagagaaacagaaagaagcacgcgacgaacacggagcacaaaacacgacacagcgcaacgagacgagcaaaagacaacagagcagagacagagctcaaggacgaaacacagaacagcaaagcgagaagcacagcaaggaacccagcacaccagagacgaggaccgcccagcaagcaacagaacgagcaagaaacacaagcagcaagacccaggcacaccagacagagagaaatcaaaaccaacgaacagaagagaaagagaacgaaggaggagaagcgacagaaagtagcagcgacaacacgcgcagacacggggacgaagacacacacacagaaacaaaacacggacagacaacgagaagacagcagcagagagagcagacagagagcgaccaacgaacacaacgaggaacggagagaaagagacacgaaagcgcgagacagcgaggacgccacaacaagaaaaagaccaaaacagagaagcccactacaacagatgagaacaaagacagacatacggacagaactagaagaacgaaggaccacagtgaaagcagaaaggagcgagaagcgaagacacagccgagcaagaaaagcagcgggaagagagcagagcagggacgcccgaagacagacaaaagacaagagcagcgaaaagtagacgaaaagcagggaagagccaacacagcgagagagaagcagcacggcagcacgcacacaggaccggagcacggaaaaaagagcaagagagacgcacaacagagtaaggagacgcagaagaagcaacagagaagagagaagagtgcagagaagagggaacagcaagaacgacggagggaac

SEQ ID NO: 698910 - DNA, 392 bp, Homo sapiens
  misc_feature (54)..(54): n is a, c, g, or t
  misc_feature (56)..(57): n is a, c, g, or t
  misc_feature (74)..(74): n is a, c, g, or t
  misc_feature (102)..(102): n is a, c, g, or t
  misc_feature (109)..(109): n is a, c, g, or t
  misc_feature (114)..(114): n is a, c, g, or t
  misc_feature (160)..(160): n is a, c, g, or t
  misc_feature (375)..(375): n is a, c, g, or t
  misc_feature (377)..(377): n is a, c, g, or t
aaatgctgaaatcctattggcaaagtaaactgaaattggctgctatattttatntnntcatttctgcaatcccnttttttgaatactaatatttgacatggntaattcntattnatttgttggaattgtttattgttaataatgcaaatagataattttnaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgancntttgcaaaaaaaaaa

SEQ ID NO: 698911 - DNA, 1547 bp, Homo sapiens
ctggtggtagtgctgggtgcagacaatgtatttggacacacactttggggggggccgacgtgtgggtgttctccgcacccttgtgtgttgtggtgtgtgtcgttggccaccatcactagctatgtattgttgtggcaacgccccggcggtcgtgtgctgtgttgtggtggtggcgtctccgcccagcttttgctcccgagcatgggcggttgtacatgttggggccctctcgtgggtgtggtggtgccaagtggagcgggtcgtacttgttgtgtttactccccccatcgcgcgtgtcgtggctgaagatgcttttgtggtgcgtgaccacgactgttgttgtttgttcgcgtccgcacccatgtgtaggtgtgtcgttgttgtgtgtgcgacccacatcgcgccgcacttttgtgttgtgtttgtgtacactctcttattcggtgcccgacacaggttgggtgtccggtgtgcaatagttgtttatcttagaggggatcttatcttttgtgggtcggttttttgtttcgtccccttcgcttctctgttagagagaagtcggttcatgtgcgggttcgtctttctctccactgccctggcgctctcgttcggtggattggggtggtgtcttctcttctgctgtcgtgtgagtagtgacatcacagctgggtgatcttcacacacacacggtgtggtgtcacgtacacaggtgctcctgtttttattattagagtcacagccacttagctgggtgtcgccttctccgttagtagagagggtcttctcttgggtttgcatcgcctcgtgtggcgtggtactcactcgcttgggggtgtgtagtaatacctcgtgggccacacgcatggcacgctcgcttctgttatgactcgcggcgcggtgtcaacactctctctttggtggtggcagatcttttcgtctcactcacaacgagtggctggtcgttgatcgttgcgcacgagagcagagatggggttggctcctcgcttccccatcagcatgagacacgtctgttaaaacagaggcgctgtatctagtgcggtggtttttttttgtggttgtgtggtgtgtcgtgtgtcttgcgcgggtcgtgtttgtgggtctttctcttgttgtttttctgttttcgtgtgggcacacaccgctgtgagcgtgaacggtccacgcgtgtgcacgcggctgtatattctatgcccgtggtgagcagttttgcacggttcaccactcttttcttgagaggtagcgttcttccacggcgccgcgacagataatgggtgcaaatctacacttagaatatactcggtcgcccttctcagatgctccgtagtggttatcccgggaagggttgatgtatgtttgccagcatgttggttattttatattggtacgcgggttctcccgttgtctacctggggaatgaactggagtaaatgggaaggtgaatctctggcccacctctgtttggagttttttgggtttaaaagggctttccaaggaccttttttaaaaaacagcccccccttttccca

SEQ ID NO: 698912 - DNA, 1626 bp, Homo sapiens
gtgctattcctctacggtagtgtctcttgtcctggattatgattctctgcctcccggagggggtcactgaggtgcccaggaatgccactccggtcacatctcaggtccttcggactgtgcacagttgctgtctcctatccgcgcatgcactggtcaatctctgacattcgctcgggatgtgatctgcaaggacgcagcatgtgtgtggtgcatctggatgtctggtgtacgttcaatcaggcccctgtacccctacgaggcgtacacgcctggggtggtcgtactaagatcgacgcaacccaatgatagtcgcaccgagagcttgcaggccctcgttaggccagactcactgagggtgcctcgtaggagccttgcggatagactgatcctcctcgcgtgcgatctagctagagcgcgtcatgtcggctcgagcatagggcgtgagcacatgtaactagccgttctcagttggaggactctgtgcgtcggcctaacaaaccagtttacacccttgctcgacgcagctagcatgggttccctgggagtactcaggttgtatagcagctcccacatagatagttcagttgcgctagcgcacccccaaagaaagggcttgtgcgtggcaccgggcaacaaggaagccgttcgcggtgtgtcaccggcatgggccaattttggtggccctagtcgaaaccaaacttagcaccaattgaattgccattgggggcgcccatactgaagtcttgggacacgctctcggtcgtattgggtgcacctaccttgacaggggggcgtatctagtgcgaagtgaaaagcctgccggacagatggcatgacattgttgggccacggcgccatggcctgcaagacggcgaaccgacgtggggctaccaccctgggtgcctgtccaacagaggatgttcataccactggcctttgtcgatacctttcagtggtggcccttggcgacaacggtgcacacagggcacagaggtggtgttcccagacagaggccttgtggtggacgttgcatcattaggccacttccactttatccccggtaagcgctatgagcgagtaacccatgtagacggaagacgcagcaaaacggggcgctaaaacacacagaggacatgtgaccccggtggaacacgaagtgattccccccccgacggaggagagaaagtagcaggaggaagacacatgactgcctgcccatagtgggggaggaatcacccccacaacggtggggatggcacacatcaaagaaagcaccggaacttagcatgatgaaagtaccaggacgttgagaacacaacaaaaagccaccgccgccgcgtgcaggcattatcagagacgagcatgagcaaggacagcggggaaaacgcagagccacatgatcccacgacccggaggaaagagacggacgagtggaccagggcacaactcacttgtggcactggagaacagaggcgggcgcatggatgaagacccccgcatggcaccacaaaaggggagttcaaatgacacaagcagcagaggcgaggaaaccagatgcgcgagaggggcagaagccacaacgacgtaagaggggaaaggacacaggacaagtaaatcgaacaccag

SEQ ID NO: 698913 - DNA, 342 bp, Homo sapiens
  misc_feature (206)..(206): n is a, c, g, or t
cagtaaactgctggacctgtaccccagtgtgactacccatgccggcctgtgccctgtgaatgcctgctgctcgtgtgtccctgcctgcatgtctgtgctgtgtgtgtgtggatgtgtgcatgtgcatgtgtgctgtgtccctgcactgcctgatgggttaaccccctgccgtgtccctgtgtcctgatgcttggaccatgatgccnctcctccatgaaaccccatgctgtcctgccactgtgcccatgtgtatgggacacacgccgcccggaaccgggggcgagggggtatgcagggagagaatcgagcgacaaagaggggggaaaggagcgacggacttgc

SEQ ID NO: 698914 - DNA, 224 bp, Homo sapiens
tcttagaggatccccgcctgagatgctatacaagtaacaaccccaaactattatcccagctgcactattgtgagagcacatggcattccactggtggtcattattggtgagcaagaactgaaacaaggggtcatcaagatccgttcagtggcctgcacagaggaggtggccattaaacgggaaaattttgtggctgaaattcagaatgccgactgtcatctcag

SEQ ID NO: 698915 - DNA, 1451 bp, Homo sapiens
catgaattacagagacagcagagacacacaagctttaggacaagagccaggaagaaaccaccggaagggaagcagtgctcacctgatgtgtagaagcatggactatcacgacgcatgagccggtggaatcatcatcgccacgcctatcctagacctcccgcacgccacaagacgtgacacggcagcacagacacgccaacggcacgtgctacaaggaacgacaaggactagctcagcggcactatcattgccacatacccgtcacaacagacctctttcaccagccccccaaagagttattctactcaacgtgtcaaccctcgaagcacgcttgcatttatgcactgattgttgtgtgtacatgcaacatgcaggtctctacccaacacggaaacacgtccacttgtgctcatcagccattgtatcgttgaattgtgcagagaagacaccgtcttgttcatggggacccacgccaacgccggaacaccacatgtggttcagcccacgcagagccgaccggcacggaaccgcacagcgacaggaccgccacacgcacgcgcgccccggccagacaaactccggccgctaacccaaccacaaccatcccattccgtctcatcgctggcatcacttccccaaacgaccaacgttccaccagagaaagaccaactgcacccacgaatgcaaacaaagcctaccgaacgaccccaccacaattcgtacacgattcaataccacacacatactcacaagcactactaagcgcacggactaggggcaaccacaacagctagaggcaaaccgggagtgtagagcacaaagagctactcgcaccaaggatcaacaaacaggcaatattgcacagtgagaacttcaaacagtcatcgtacaatcagccaccgcatcacccacaccaaatcgtggccccaacacagcaacgagcacaccagcaggccacacccactggaccacaccacacttccgaagacacaccaacaccaaccacacgcgtacactgacaccacacaccaaccagacaacaaccccacaaccaccacggagaacacatctgcaagcatctaccccgaccggccggtcaccccagattgcccgtggcagaacatagaagccaaagaacaaatgcgccgccacgcacacgccgacaattcagaccatacagagagcggcacgcacagcgcctgcgaagaccgcgccacaatagccaccacaccccacgcagaccaggacgaacaaccatacagacagcaagcgcacctagcgcaagcccaagcgctccacgttccatactgacacaagccagtcgacacgacaagacacgagagccacgtgctcatacaacagaataacaacagaacccagcgagcactacaacaatcagccagatcgcaagctaatcgtgcagagacaatatacagatctacgctctgcgc

SEQ ID NO: 698916 - DNA, 1215 bp, Homo sapiens
agcgggtctcgcgggacgcgctgctggcggtcgggcgctcgggcggccctggccggggagacgagttgcatgtgtaggttcagctaggcgatagcggcgggagcggagccggcggggcctgtgcgaccgcctgggtttgtgaaatggctgctgacatttctagaatccagcggggctgactgcaaagggagacccaaggaacagtgccaagttaagatgccgatatacccatttcggagtccttaataggtgggagtctggttcattagcgaacagagtacgtgtgaatataatgccgtgatgttgctaaatgtagacaagtggttagagaagaattttccaaatgaatttgcaaaaattacgtgtagcaaaccattcgccccaaacaacgacgctgggcaacttagtgagggtccagggaaacaagcaggggggaccgaaacgagggacgcacagcaaaaacaggacagaccgagtgtgcgcacggcggcgtacacacattacacaccccacatcacacagcaacgaccggtacccaccaaaacacgggtctacctcaataaggccaagacatttccgccaagaagtcaaactgaaacgaacattagtaggtgcaagccacgacgtacttggtggggcgcctttggcacagtttttcgggaccaactcggacctcctttcaccgcagcacagggcgatcaaaaggaattattgtggggctcccacacacaattacttcccttggttgggtggctccttcccaggtaaacaccaggggcgagacgtggtacatttgacaaccatattaacttccattctccaggtgggacgcgactttattgagacccagggaactttggacgcaataacactttctggacactggtcgcagttagccacaggaggaaacacagaatgggtgcccaagccacgggggtacggaagttggaagattggaccacagcgtacttttcgagagacggaatctcttgtggggtagaggagagtttaacaaggaagaggtggaaccattgtgggacaacaatatgtggtgtgtggatgattacacatgtggggcccttagacattggaggaaggattggactagtgtgggcgccaaagtggtgacagtaaagcagggatatttgtaagagcaagatatgagtttaggacgtagaacgacagcgcataattatacagtgataatgaatatac

SEQ ID NO: 698917 - DNA, 523 bp, Homo sapiens
gacagtgcgcgggtgctagccagcgagatggcgcgagctgcggcgctgcctgcagcctgtagacctccgggccgcgccgggcgagccagtgcgcgtgcggctggcggcgggcctccgtgagctgacccgtgggatgcggtgactgtaaggccggctgggatgtggcacatagcgaagccaagacggatgatagatgcgcgcgaagggcataagggccagagccagagagccaggaaaaatgaggggaacccggggagacagcatgcttgcacaagcaggcgatgcgccagccgtgtgcttggtaccctgaagcaaggtggacggcaagcccgcctaccgaacggaaacattgtgtaccttcccggctaattgaacaggggcgggtatgcacaccagacagcctgtacaatttgacacgccttcttccttcccaagttggaaggaagtcgaagaaattctacccttcatccttgatgtgaccttaccaaagaaacttgtgcgatctggattgccacacggcaga

SEQ ID NO: 698918 - DNA, 82 bp, Homo sapiens
gaggcaaggattcatgtcgtattgggggtggcgggcagagagatggtggacacgcgggcgttgattactgcacgtgaggaga

SEQ ID NO: 698919 - DNA, 694 bp, Homo sapiens
gaaccattgcgatggatatgacctcatagatatcacctgttccagctgagaaaagtaagcccatatgggtgcagtctatctttgatggtatctcaacagggctcctggtgctgaaggacttggggatttaggtggaccgctacattgcctaggaggttagtgaggaacccatctcggtaggcatgttgcggcaccaggggaagatcatgtacgtcggggaagtccgcagcgtcacacagaagcatatccaggagtggggcccattcgatctggtgattgggggcaaaccctgcaatgacctctccatcgtcaagcctgctctgcagggtctctacgagggaactggccgtcgtcttcaaagagttctaccgcctcctgcatgatgcgcggcccaaggagggagatgatcgccccttcatcttggtctttgagaatgtgttggccatgggcgttagtggacagagggacatctcgcgatttctcgagtccaaccctgtgatgattgatgccaaagaagtgtcagctgcacaaagggcccgctactactggggtaaccttcccggtataacaggcgttggcttccctgtgaatgataagctggagctgcggatgtctggagctggaggataccaagtcacaagtaggccatatacagtaattcctcgaagggacgagtcatcgacttctataagtc

SEQ ID NO: 698920 - DNA, 365 bp, Homo sapiens
  misc_feature (62)..(62): n is a, c, g, or t
ccagagtgccaggctgggaagactggagacaggcatcgaggggatggttggcaggggatggnttgaggggcaagtgttacagtccaccactccaggctccagggtccaggcctggcaggccgaactagtccaacccccgtcgccgtctaccccagagtaaaacccagtctttgctccagtgtcctgggtctctatctgacaccaacccaccagcctgctgactccaccagctggcccgaccgccctgcctttgcctcatctctgcacctacccacatggcctcctctatttttgacccagatgtccccctcacctgagtcccaggagcccttggagcatccacgttcagtgtgttgagtgacatg

SEQ ID NO: 698921 - DNA, 347 bp, Homo sapiens
  misc_feature (347)..(347): n is a, c, g, or t
tggaacatgacgaatagggatgacatggacggcgaagcttacgcgttcgcgcgtcatccggtggttgcgagaggcggcattgcaaaatgccgcagatgatgtgcacgtcgtcaacggcatacagaacccggcttacaggccaactgggggaaattttttcccctttttccccgggattcccgtaggcggtgcccggatcgtgatcattcatgttaacagaaaaacccggcagtctcaccggtgccttttccttgtttgcgggggtgaaaaaaaggcatcgtgctgtgtgagtaacattcgtaactttacgggcttaatgaattttcccggattgcgaaagttgggcn

SEQ ID NO: 698922 - DNA, 851 bp, Homo sapiens
caccccttaggatagatgtgttggaccccatgaagtactccagtcagaatcagccaaaagagaagtgggaggccatttctgctatgaagtcttaatgggatacgtttgaagacttcgactatggtactttcctgtcgactagatatgttctcagggctacatctgaggccttgacaccatctttgcccccacgatacaacttctttggacattgatatacttgcctccggtatccgggaagggctactatacatagagcctgctttattactcaagtgcttcaaggacaatacgttaggcgatgtacgttacatggaggtcaaacaactgtgaaggtagataaaatagtatgcctgaacagtgtgaacgtatatgaatgagaacattccaagtgatggtatggtagagtatatatgtgcagcgtgataagtggatgtaaggatacaatagagagtaaggagtatcaatctagagaaagactatcacctgacaatatggatggtagcaataaaggcggcacaagaacgctgtacaaataggaacatccatacctacaagcgtggtgtacacatatgcttatgtcacacggtatatcacggtggtacccgcgacatcttacgaagttcatgagctcatcctcgagactacaatgtaccacggagctacttgcacagacccctttggctacatgcttaattcgttgtacaattgtaaggatacgcagaaggacatctttctaatcttacagtcaggagctgctctggtcattcccttgtatgagactggtatactagactgttagtggggtgttaggtgatttttccatgatatctctgtttcttggctgacac

SEQ ID NO: 698923 - DNA, 165 bp, Homo sapiens
tttttgggtttccccccccccccccccccgggggccccggcccccccccttttttcttcccgccccaagccctggggggggggccgtttttaaaccccccctttttttttttggggggggtaaaaggccgggccccaaaaaagggggggttgttttaaattccca

SEQ ID NO: 698924 - DNA, 329 bp, Homo sapiens
tctggccagggtgatgtttcaacaaagtgagttctaaggtccatccattcaaattttaagcattttggtttctttaaaaaggggttgggtcatagaaaaaaattacttttaaacaggtttacaaggagtggggggagattgggctatttcacaacattcaaaacaggccaatcaggttgttcgcatattggttggtgtttgtgaaaggccctgttgttgtgctcactagagaggcttcggggcttggagtaggcgcctgttgtttgcccggaagatattgaggttcttaactaggtcctttggcgaaatgatggataatagccactgtg

SEQ ID NO: 698925 - DNA, 1136 bp, Homo sapiens
ggtttgcacttgcttgttgtgtcttcgcgtgcatgtgtagtgtgtctgctctcgtcctgcgtgaagtaaaacaaacaaagagagatgcactaaataagaagaaaagagaaagcaaacgagagctgaactgtatgttaagtgttgtcatgatctgttcgtcgccctgatatttccggtcgccctcgcgttggtgttcgcccctcacaagagggtgtttccggtaaggtctcttgcccgtccacccccccatcgaggtgccccgtcctccgcgttatgactgtgacaacgcctctcctgggagggggggacccacacacctgtggggttgcccccgctggtttgccgcacttggagggtgtttgtgcccccactaggggtgttcccgccaatgtgtgtatggtgttcgcggtcgtgcccgcccgcgaatggggtaaaactttgggggagcaccataaaacaggtgggtcttagcgggtgtcgcaccccatggagtatgtcgtcatattgaatgtcgaggccagcaactgtcgtaggtccaccctaaatgaggttattttaagacgcaagagtagtttgttccaagatgttggacttataaccaggggagttttcataagccagcgataatagatgatagtcaccggctttgccaggtggtcgtggcaccattcaatattaaggatctgcgcgcgttagtggccacagatttttaaagtgaaaacatctgcggtcatatggagtcgtcagtcgcccttgtaggtatgccccctctgtttggcccacgcacaacacacctcttgtgctgggtacgcagagtgaggtttgctggaatgtcatccaacgagtattacgggtgtgtattgtcctttggcccctctcctcatggttccagacacacgtgcattcttatatcgcccactcctcggtattctcttccccaccaccatctctcgtgcgagcagcggtgcttggccacgcaagggcgcaacccagggcgcgcgatagggggcgacgtcggaggctagcccacggcgccccaaggagtttccaccccactactactcctctctctacgagtggggcccaaagtcgagtgaggtcactcccctgtcacaacaaatagtcagaaaacacaa

SEQ ID NO: 698926 - DNA, 285 bp, Homo sapiens
ccgcagccgggcttggcggctgtgtggctgcctacgctgcacacgtcacactggctccgaggctccctgccagagtggtttgcaggatgagctgctggccacctgggtaggctgtgcacgagagaaggggcttgcatgcttttggaggtcgccgcataccactggagcgggcttgctgcgcacaggcgtacagcaaggccagagcaagctgtcctaccatgccttggccccctagtgtcacagagcctggccagggcacggtgggcaggtccccatgccaagccc

SEQ ID NO: 698927 - DNA, 539 bp, Homo sapiens
  misc_feature (325)..(325): n is a, c, g, or t
  misc_feature (383)..(383): n is a, c, g, or t
  misc_feature (401)..(401): n is a, c, g, or t
  misc_feature (419)..(419): n is a, c, g, or t
  misc_feature (431)..(431): n is a, c, g, or t
  misc_feature (440)..(440): n is a, c, g, or t
  misc_feature (462)..(462): n is a, c, g, or t
  misc_feature (496)..(496): n is a, c, g, or t
  misc_feature (522)..(522): n is a, c, g, or t
cagatcacctgaggtcaggagtttgaggccagcctggccagcatggtgaaaccccgtctctactaaaaatacaaaaaatcagccagtaatcctagctactcgggaggctgaggcaggagaatcgcttgaacccaggaagcagaggttgcagtgagccgaggtcatgccattgcactccagcctgggctacaagagtgaaactccgtctcaaaaaagaaaaaaaaaaagaaaaaaagactgcatatgactccccagtgaagccctccctgattggcctctgcagaaggcagcatgccgggctttggagtcagacctgcatacaaanccttgttttgccggtgtgaccttgccaagtcttcttccctgcaggacagaaggcggcnagctctccctgaactggnatctggctctttgcccanggttgttctgcncttggacancagcgcatgtgggactgtgccnttcagcatgagccctgtctgcgacatttagccanttccagatgacagaaagttgtggtancgcaaccctgaattggc

SEQ ID NO: 698928 - DNA, 637 bp, Homo sapiens
ccttgatgggcagtggcattctttgacttctctccagccgagcttccaggacaatcacatatccctgcaaaaatagcattgcatacatggatcaggccagtggaaatgtaaagaaggccctgaagctgatggggtcaaatgaaggtgaattcaaggctgaaggaaatagcaaattcccctacacagttctggaggatggttgcacgaaacccactggggaatggagcaaaacagtctttgaatatcgaacacgcaaggctgtgagactacctattgtagatattgccccctatgacattggtggtcctgatcaagaatttggtgtggacgttggccctgtttgctttttataaaccaaactctatttgaaatcccaacaaaaaaaatttaaccccaaatgggttcctcttgttctaatcttgtcacccagggaaaagggccgcccaaaattccagttatttatttccaaaatgtttggaaccagtataatttgccaaaaaaaaatgaaacttttctttttttgctgttcccccaaaaacaattcaaatgctttttgttttatttttttcccaattccaatttcaaaatgtttcaatggggctataataaataaacttcacccctttttatgatacca

SEQ ID NO: 698929 - DNA, 258 bp, Homo sapiens
  misc_feature (4)..(4): n is a, c, g, or t
  misc_feature (6)..(6): n is a, c, g, or t
  misc_feature (122)..(122): n is a, c, g, or t
actntnccactgcacttcagcctgggcaacagaacaagaccctgtctcaaaatagatataaatagagaatgagagagcacgagcctgtctgatctggagcttcaactagatgaatttttttnatgttcaaagagttattactggccagatgcagtggttcacacctgtaatcctagtactttgggaggccaagatgggtggatcgcttgagctcaggagttcaagaccagcctgggcaacatagcgagacccccatct

SEQ ID NO: 698930 - DNA, 160 bp, Homo sapiens
ctctattacaaatacacaaacatttacgtggcatggtggtgcgtgcctgtaatcccagctactcaggaggctgaggcaggagaatcacttgaacctgggaggcggaggttgaagtgagccgagatcacgccatggcctgacagtggggccgggccgcggg

SEQ ID NO: 698931 - DNA, 372 bp, Homo sapiens
  misc_feature (240)..(240): n is a, c, g, or t
ggaagtggcggggaatggatgtgttcggtgtgcttaatgggtacaaagtttctgattggcaagatgaaaaagttctggagatggatggtggtgatgattgcacaacagtgtgaatgtacttaataccgctgaactgtacacttaaaaatcgttaaaatcgtagaaataaacaaatgcagctcatatttaaagggaaaaaaatttcaagattaagccatgcatatcacaggactcgtctcntcagagatttacaagggggaatggcttgtatcatgttaagcgtaattttgttacgttgtgttctgggtttgtccagttgcagagagaaatacacaaatatgtcaacattgcttaaatgctaagcagttatgg

SEQ ID NO: 698932 - DNA, 470 bp, Homo sapiens
taggttatttaatttttttgtcagaagtagctataaaaaagccatatgtttcagagagaaattaccctgtattttgccatctctcatttttcagggcaccaaagctgcatgccccccagcagttagaagggcaagattgcattgaaggggtttcagacctctgaagtagtcagttttctcccatgtcttctatggtttaattgtaacataggtagtatgccttcacactggatcccgggggcatgggttttggagatgttattttgtggtgaattgtcatctgcagtattaaagggaagacatattcctgcacatcaccataccttgtttttaaagccagagtcattgtatgatttttattaccagaagtgctaacccggaatgtgatctggttaccttggaaaatgcaggaacttttatgaatgtactgtaaaataaaatgtgggctaattcccagaaactgaaaaaaa

SEQ ID NO: 698933 - DNA, 935 bp, Homo sapiens
gtggacagattatacccgtcctgtgtagcctgtgattgttctgggcacgatggtggtgaatacgtgctactcaaagacatggcaataatttgccagctctctcaggtggcgccagtgatttcgtatcctcagtaccttcagagtatccgtgcgttccatacgtgcacatcttccatgaatatgctctccctgggaagctggatggctactggcacttttcatgatatcagggagtgccttgatactgctgaagtgactgaacccagtttaatcgtgcagagcccagatgcttataaagcttgtggtacgaaagagtcctccatctgtcgcccaggctgcgcagtgcattggatgccaatcccggactcaactggatgttcgttgcctccgcagagtgcaagacaagtgtcttgatgccatcaagctctccatgagtatctgggattacaggggcccactcgagctgtggggctacgatttgggtaatttcacgtagagacggggtttcaccatgtggaatcaggctggtcgttgaaacgtccgtgaacgtcgggtgatccactgccttggtgtcctgaagtgttgggttaccatggcgtgagcggtggtgccccaaataacagcagctttcttgactacctggtggggtgaggggggctaactaagatccaggtaaggcttgcctatcacggaaaggagtcctgggaaggctgtcgtgcaccagaactttccgggcccgctgtgtccgtgccttcgaaaaccttacgggggtgcatcgctgcccggtatacaagcacgcaatcacaatctcgtctgccccatggcccacacgtatggcggcatattaggtgtccacgtggttagccccacccaagtctggaccactttgtaaaaaaacgctcacacgtaggctaaaacaccacaaacccaacaag

SEQ ID NO: 698934 - DNA, 461 bp, Homo sapiens
  misc_feature (321)..(321): n is a, c, g, or t
gtcaggctggtctcgaactcctgacctcaggtgattgcccgcctcagcctcccaaagtgctgggattataggcatgagctaccatacctggccaccttatttttcattctgccatcaaatagacacacagttttgtttgtttatttatttatttatttattttatttattttttgagacgagtctcactctgtcgcccaggctggagtgcagtggtgcgacctctgctcactgcaacctctgctgcccaggttcaagtgatcctcctgcctcagccccctagtagctggggattacaggtgcgtgctacctcacccagctnaatttttgtagttttagtaggagatgggggtttcatcatcttgggccaggggtagtcttgaactcctgacctcgtgatccacctggccttcagccacccaaagtgctggggatttacaggcgtgacacccacaagtgggc

SEQ ID NO: 698935 - DNA, 357 bp, Homo sapiens
  misc_feature (1)..(1): n is a, c, g, or t
ntgcagagagtcactcaattgcaatccaatgtacatgtctcagtctaagcataggtcttttgccaagttacaaaatataagcttctaactaacaaaaacgttagaatgtccacatcttaaattcaccgctagaggaatttcgtagagtatagccgatggaggcccctctcttctgaaagaccaagtctttagaaggataagtttatgcgaaagacagtgattagctttcaagtgacgccgttatctatgagatttatatcgcatgtttccacatctaaataggtggggtaaggtagtccataggcgtgtaataaccccaccgagcgagtcggaagcaagacgaggtttttgcctgcg

SEQ ID NO: 698936 - DNA, 1071 bp, Homo sapiens
gcagtgccgggcgccatggcaccgtggggcaagcgtgctggctggctgtgcggcggggtgctgcttgacatctcgggcgtgctgtacgacagcgtgcgcgggcggcggcacggccatcgccgtgctcggtgtgaggcgggtggccagactgacagcgttcccggctgaagagtgaggttctgcaccaactgagtctgcagaagtcccgggcagagctggtggtggcatgcttcaggaggctgggattttgacatctctgagcaggaggtgaccagccccgtggaaccagcatgcctgccagatcctgaaggagcgaggcctgcgaccatacctgcatcatccatgactggagtccgctcagaatttgatcaggatcgagcacatccaacccaaactgtgtggtaatttgcaggacgcaggagaaagcttaacttatcaaaacatgaataactgccttccaggtgctcatggagctaggaagaaagctgtgcatcaatatcactgggaaaagggcgttactacaaggagagctcttgacctgatgctggacgaaggtccctagatgaaggctctagatatgcctgtgggcatccaaaggcggaggatggaaggaggaagcctaactcctggaggttatacaaagataagcccatgaaaccgaatcggcagtggaagccaagcaagtgcgacaatggaaatgcggacgatatcgatggctacatcgaggaagataccacataagacgatggtaggaaattaagaaccgacatacacggtacagacgacgcatgaaatagtacaagggacacaaaaagaactaagcaactaaatctgtaatgtcaaggaataacatggtgaacgcttagacactacacagtaaaatacaaaagtagaacgatgccgcaggaaccgacaagaactaccaaacatatcacgaaccacttgcagacaaacaccacagcacaacaaccagatcatatatacatgaacaaacagaaaaacaagaaataaaagtagtaccagacaacaacaatagagaaagaaaaaaaagatgactataactgtagaaaa

SEQ ID NO: 698937 - DNA, 122 bp, Homo sapiens
gtgtctgcagatggtatggatccttaggtgggaaggtcacctgtcttatattctaggtaagattccatttcctggaactcatcagaaatgataaagctcagtgctggggaaatggatccatt

SEQ ID NO: 698938 - DNA, 142 bp, Homo sapiens
gttcagcagtctcaaccgattgactaatcaaactaacctcaatacaaatgataaccatacacaacgactaaaggacgagcctggatctcttagtactgagctatccttagagtcatttttattgctcactaacgtagacctc

SEQ ID NO: 698939 - DNA, 417 bp, Homo sapiens
ctccccccgacgggtgggtggcgggagaggtaagaaatggataggacagaaacgtgtggagatgttcgtggctgcaatctcgcaagtgtacggaagaatacagaaatctaaccgagaactttagaacgaaattttcaagtttcaccatcttaattctgtatatattccactatctcacatgtataacttattgtgtacaaatctgaggtcataacattcattaatgaatactttaatcttttatgcataaattgagtagctgagaaatagttctaaagaaacaattcagggctgggcgtggtggcttacacctgtaatcccagcattttgggaggccgaggtgggcagatcatgaggtcaggagatcaagaccatcctggcttgcacggtgacaccccgtcgggtggagcgggtacc

SEQ ID NO: 698940 - DNA, 573 bp, Homo sapiens
gcttgacctctgcttagcaaactgaggagaggggacgagaggtgttagagatattgctggggcaaggggaagtggcgtcaagcccccaagccaggactgcatgggaacaaccagactgtgatggccatatcagacccccgggactggacacgaacccatcccaacgcaaaaagcaaataaataaaacaaatatattaactctctcttcacagggagctggggtggagtcggggagaaagaggaacaggacctggtcctttgaagaagagagccaattccaagaaggggttaaaaatagaacatgtctcagaggccacagcaggttagacaaagtagcatatgtctgataaaggggggtgcggtgggtgagtggacaccagaacccagacttgaaacctgtgcttgattgagcaccctcagggcagacgagacaagaactgtgtatactcttcctacccccagccacataacaggcaaagaagcgcaacttaacacatgactggactgcccggggagcgaggcgggcacgaaaaaatgaagcactttagggtcaagcaactgagcaaacacctg

SEQ ID NO: 698941 - DNA, 275 bp, Homo sapiens
ctggacacatggtgaaaaccgtctctagtaaaactagcaaaaatgagctgggcgtggtggcgggcacatataatcccaggtaacatcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtaccgcgatatcctttctcaatcctgatttacctttagtgttacctttttccc

SEQ ID NO: 698942 - DNA, 400 bp, Homo sapiens
agaggatccacagtgagcggttgaatcctgtatacatgtgagcggttgcactcctgttgacagtgagcggttgcactcctgttgacagtgagcggttgcactccgcttgacagtgagcggttgcaatccgctagacagtgagcggttgcgctccgcttgacagtgagcgggttgaatccgcttgacagtgagcgggttgaatccgcttgacagtgagcggttgcaatccacttgacagtgagcggttgcaatccgcttgacagtgagcggttgcaatccacttgacagtgagcggttgcaagccgcttgacagtgagcggttgcaatccgcttgacagtgaggcggttgcaaatccgcttgacatgtgagcggttgccactccgcttgacatgtgagcgg

SEQ ID NO: 698943 - DNA, 110 bp, Homo sapiens
tctacacaggtactatgaacaccacacacaatgtatcacacatacaactccatacacatactaacggttaggcgtgcacacaccacacataccacacatcataaacatca

SEQ ID NO: 698944 - DNA, 423 bp, Homo sapiens
cggacccacagaattgctgctgagatgagaatggagatcacgcaaggaagagacctgtgggagaggctgtccctgacagcgagcagaagcccgtgccgacgtctgagggcaagtctagactgtcccccgccggtgagatgaagcccatgccgctgtctgagggcaagtctctactgctgttaggaggggcatgctgctgtcgcccatcctggcagtggccctcgggggtaccctggctctgagaaagaaataggaggcttttcagaagagcccgacagcaggctgtcaggttggagtcgtcttggctggactttgcccctccagcagctgtctggacctttgtggaacactctgggatacttggggacttctgctcaacatggcagtggcctgtccaggcatgttcggctacagtagggagag

SEQ ID NO: 698945 - DNA, 727 bp, Homo sapiens
ggcaagcggcgaaatggcgccctccgggagtgttgcagttcccctggagatcctggtgctgttgctttggggtgctccctggaggcacgggcggggaggaaggtgcggggtcatcacggacgagaagtggagcagaactgcgtggaaggacgacgtggatgatagaattttatgctccatgtggtggccctgtttgttaaaagatcttcaacgggaatgggcaaagttgtgctgaatggggatggaagatcttggggttaatatggcgaaagtagatgtcgagagagcagcagaggattgagtggactggtatagttcatagacttggtcttcctattattatattcattgtagaaagaatggtgaagtttaggagctatgagggtccacgggatgtaagaaggacttcataaaatttaatagaagtgataaatgacgtgggaagacgtatttgagcccgtgtcatacattggttggggtccagggttctgtgctgatgagtagtagtgtcaggactctttacagtatctatgtggatcgggggacttgacaataaatctactttaatggagagacctgggattggcagtgtggggggttcatataacggttatgctttagaaattctgtgttgcgggactggtatttaggactttgtatgaatatttgtggggagatgcctttggtctttaaaagggggaacaaagcgtccaattcccttaaaaat

SEQ ID NO: 698946 - DNA, 365 bp, Homo sapiens
actggtttgggggcttagacctagagattcaaaactggcttcacagccgagtgcggtggctcacgccaataatcccagtgctataagggaagcagaggcaggtgggtcaccagcaggtcaggagtacgagaccagcctgaccaacactggagaaaccacatctctactaacacactacaaaattagccgggggtggtaacaggtgcctgataatcccagatactcgggaagctgaggcaggagactagcttgaacctgggaggtgcaagtatgcacctgagctgagatcgcaccgaaacgcacagcccagagcaaaaaaagtgaaactgtgtctcacacacccaaaacacgcacaaccacacccg

SEQ ID NO: 698947 - DNA, 375 bp, Homo sapiens
  misc_feature (176)..(176): n is a, c, g, or t
gcctgcaggactggcagctatcggtcatgctatccactaactacattacattcttcacaaactagaaaactatttaaattcaatgggacgacaaagagctgaatagccagggatggccaggcaaaaggacaaagctggagacatcatgttacgtgactccaaactacactacaggncaacagtaacccatacagtatagtactggtacgaaaaacagacacatagacccatggaaccgaattatagagcccagaaataatactgcacacctacaaccattctgatcttcaacaaagctgacaaaaaccaagccactggcgaacaaagggactttccctccctttaataaatgatgctgggaaactggctaccatg

SEQ ID NO: 698948 - DNA, 920 bp, Homo sapiens
gatccgggggagcggaactgcaagaggaaaggctcggggctctctactggattctggccgcgctccggccgcgctcctctggattgccccgaaacaccgtggtactgtcgtgccgcagacaggaggcctggatatggtggagcgaatgggccgattccagcggatcctggagccctaggtaggaacgtcctcatccctgtgaaagaccggatccgactatgtgcagagtactcaaggaaattgtcacatcaaatgtgcccttgagccagaacgagctgtgaacttctcgagcgagtgtacactctggacgaattgcgcatgtagggtccttcataacactgggccttcattggagtccatcacaatggcaaggcctcacgcgtcgctgcacgagcacccctgaggtactgccgtccaacacgaggctcagctaccatacaaacgcaagtgaagaatcaagagacacccggcgacacacccatcgtcggtggcacacgaggcccatacacaggagaacacgcgggcagttcccaagcaacagggccaagcagctagtggggaatgcccaagtcaaaccagaggccagcacgaacacgcagggaggaagacggcgtgaccacccgatactgaaagcatcgagcgcgcccatcccagggatgcccacccctggagggaccaagaagcgccaagctgacacgacctcccaactgcacaggcagaagccgcgggcaacaacggagcccaagctccacggacgcatcacacgggagacccgcagcacgaccgcccacacacgcgcgacgagcagggggacaaagcccagagcccaaggctccggccgctcacgaagaacgacacagggcgcgaccagatatccacccggagacaagccaaacgggcacaacgcggccagcggagcg

SEQ ID NO: 698949 - DNA, 932 bp, Homo sapiens
gggagctcaaacgtgacggacctgtgatgatgcacgtgtgaggagatgccgtgtgcaggcagcagcgactgcatactcgagtttccgagcaggaacttcaccctgccctgctcagcccaggtctggtgcgagggcatgaacgagaagcggaagctctataatgcctacaggtttttcttcacatacctcctgcctcacagtgccccgccttcactgcgtcctctgctgtgacagcatcgtcacacgccacaggagatgctcgcctgggtgggtgtgacgataccctggcccagcttggagaacggtgcttgcacctgtacccggagcggtgcagtatctagcagaactcccacggaaagcaggaggttaccgatgtaccagtagtatcccatagcagtaccatcccccagtgaagactaccgattgctggccatcctaccaccacgggagcatgtctcctttcagtgttcaaccttggctgagagctgtggatgtctgtcagagccatgcccagtgtcgcggccattcagatggtcaccaaacagaccaccttggacacggtcgagcaagctaggtcatattctgcaccgacctggactggacgccaagtggtcgctgatcccaaacaatgaacacattatgtgcaaggcctctggcttgagcctaatctgactggctcgcgctgaccagctgactatcctcggcctggtgtcgcttgccttgtggaccggagttgccttggactgggcagacaccttccattttcacccctggcacagccccttccacaccacacgcctaacgactcccccaggaacaggacccgcattgttgaccccaggaaccaaccggttgccataaatgccccaactcttcacacacttcgtcgactctaccaagcctaactaatgacacctgcaagggtccctact

SEQ ID NO: 698950 - DNA, 930 bp, Homo sapiens
gcccggtcatcggtctccgaccaaatcacttgtcttagcagtgcaagactctttctcctgtgcgatttctcgtctgcggccagggtctgaaccgcgtcctcagccgtgcaccggtgtaaaagactctgccagtgatggactgtacacacagcacaataagcacgcgcattgaccgtacatcacctctgcctggcctatcacagagggccctttatagtaatgtgctgctgttagcaaagcgtggaaattgtacccgtaccgatgacttgcttacgcattgaatgcaagcagacgtactatgagtttggaggagggctgtaactactcgctgatgaatggctgaaagtgaatcacttggggaccgaggctccttcacttgccgtggtacactctcgtcacatacttcgctccgcagtggcccgtcccttggagctgggttcagatggatcctcgaactgtaaggcacctgtaaactctatgcattcgaggacatgtacctgcaagtatgtccaaccggacccgcctattttacttatcctatgtaaaagaagccatgccgtggcgcacgatatgagtccttcaatggcaatacggtaaacgcgcccattgtttaagtccataccccacaaatctggggctatgcgtaccctaccttcgcgaactatcccgcacttggacgcaaaacacctttgtctggagacgccaagaaccaattcccctttgcgagcaatcaagcagtgctatccttggtcggaaggctggtgcactttgcgacaagacagcggttttagactagcctcctacggcaacctgcttagtacgaatagcatttattgatcgccaacgatccgatcgttggacgcgcgggaatatgtcctacgacctgtaaccatacgtagacttgtgtaagaataaggtccacaattacaa

SEQ ID NO: 698951 - DNA, 126 bp, Homo sapiens
  misc_feature (5)..(5): n is a, c, g, or t
  misc_feature (53)..(53): n is a, c, g, or t
cttcntggatcagaaagcttgtcaatcactcatgtgttttgagtattcttttnatggtgctttgttgcttctgaactattttgaagagtccttctgtttcctcaagtatcaattctcctcctcttt

SEQ ID NO: 698952 - DNA, 378 bp, Homo sapiens
ccgcgacagagtggtgctgtaggtctacgcatatgggatacttcactttttccaatctggagatatgagatgcccaacaaagggatacttacattaagtgccatagccacacttgatcgcattggcacagatggagactgcagcaaacctgaagaaaagaagactggtgaggtagccacggggatggcctatagacccaactggctgctggcaggggctgcttttgagagccttgtgttcctcacccactgggtttttggagaagtctctcttgtatccagatgggcagtgagggggcatccacatccagggccagatcctaacccatttggaggtgcagtactgctgagcttgacaagtggattgatgcttccatct

SEQ ID NO: 698953 - DNA, 495 bp, Homo sapiens
  misc_feature (416)..(416): n is a, c, g, or t
gtggaaggcgatgtggctcccagaagcacaggtggatgtggaaccggcggggggcagcctaccgggaccttggtccactggagttctgagccccatttcctccccatcatcgccagcctctgagcacggggcaggacagcgccggacaggatgatggactgggatgggtacagccctccgggaagtgtggtgatgaaaggcatcggcggtcagaaggacggggacaggtcagccagtggcagccagggcagccgccacagtggaaggggaagatggtaccatttcccatgaatttaggctgtcagctgagaagaagcccacaatatctttactgggttccataaaagccaaaggaaaactttcgggtgctcctcaaattaaggggcttagattagggtcatgaacggaaattgggncaaacacagaaagaaagactcggggggtgaaaggggagggccaggcaatgtgctcacgttgacacgacagttttaaggt

SEQ ID NO: 698954 - DNA, 224 bp, Homo sapiens
agttttagtttttctagagacggtgcctcactttgttgctcaggctggtcttgaactcctaggctcaagcaatcctcttgcctcaacctcccaaagtgctgggattacaggtgtgagccactgcaccaggcccttattactgctttattgtgcatttttctgatagtgatgtttagcatttcttcttatttatctgttcaggtttccccttctgtcgtcttctc

SEQ ID NO: 698955 - DNA, 260 bp, Homo sapiens
tcaacacaatagcagtgtgcagaaacaaaatcctgggtgactaggtgtcatacagaagctgatggcatccaaagcaaatgaccaccaaggttattatcttctaaacagtataatagagcacatgcctcctgaatcagttgaccaatataggaaagaaatcttcattctgctatcccagagccttcagacttccaaaacaaccaagttaatcaacgagtttcttacgtctttctcacatatgtacttgcataaaactactg

SEQ ID NO: 698956 - DNA, 294 bp, Homo sapiens
taaggtccccctgagttgtgtcatatttagcttaagggcccccagagtgaacataagagcccaggctaaagccccctcttcctagtgccctgtcaccccccctgtcccttttcctgggcatctgttttatattttattccccgtgggcctcgttcttgtttaaaacccaaagaatctttaaaacgattcaccaatagtacttgagggggtccctccccccaaaaatattttccagtttaaaatccccctcctatagggttggctgaagccaaaggttttttaaaactatataga

SEQ ID NO: 698957 - DNA, 222 bp, Homo sapiens
aaatggaataataagcatacaaatacattatcaaaacccactgacacaacacatagactaccctatacacttgtcctataccctatgaggcctaattatcacaagctccatctgacctacgaccaaacagacctaaacatcgatcatatgcatactctaacaatcagaccacatagccctcgatagtaacaagccattctcatcacaaaccccctgaaagct

SEQ ID NO: 698958 - DNA, 1464 bp, Homo sapiens
  misc_feature (350)..(350): n is a, c, g, or t
  misc_feature (367)..(367): n is a, c, g, or t
ggtgaataagaaattctaggcatagtcacgctgacatagtcacacagagtaggagtcatgcagctgttctgaccgaaggtgatgtgatggtggtatgcaacgaggcctgaggtcagcaagtgcgaaatatgggcacatcaggcgagggacagggaacggtcttcgcagtctctcggtcgctggtccgttcgtcagcagcaggtgactaggactgtcgtgtcgattgctagggttagtttcagatagtgacttgcaccactccatatcacgatgtacacatagacacacgtaagattctagcatggaagaccgatggagaagtgtctcgtctagtcgctaaggaagtccantgtcctcgcggaacgantgcgctcgacaaatacttctcccaaatttcgtggatagttatggggcaataggacaggcattgggaacacgtctgcatacacactgagaacagagtagagacacgactaaatagcagggggcaacggagggaccttagtgtagcatacaaagactaatataaactaattatttccgcgttaccgtttagacagtaccacaagttgactctagaaggaaggggctctaatcaaaccgataggctagccccagggtcggttatcccgaagagccgcaattcgccgaccggtgggaaactagaccaaacgtgtcatacgcctaagcgaagatcacgtgcacgcgtgtggggcaacgcgtgcagtttgacgcaaacaagctataatatattccacattgagaagatcccattccattctcgagaatacattggtgccatcgaaacgttagatcgcaccccgtggggcggcttaagaggggaccccattccgggcgcggcaagcattacgggcttgggcacacgtttagcattcgcagggggggtgggcccggatagaagggaccggttttggggaccgccaattcaaggaagggttccccattttacaattcaaaaataggtcaatatggaaaattcatccaccgggatatagcgggccctttatccaaagcatctcaaaggatttcccccccctttcattccttccttttgcaaaaaaacaaaaaaaggaatttccccagtgggggagatccttcaatacaactagatgtgtccaaagggcttggttcgccaagagagggaaaaataatagcgcgccataggtggaaaaaagaggcaaggggttcaacaagtcccccaatcccacattaggttgtcctgtctcagcgcgagcccaatgaggagaaaccccaagaagggaagagagcacacgagcaaaaacgacgcgaaaaaaggccgtcagaggagtgatactagaagacctcccataggccctttgagagcccgggaggaaatgggcagacccactgaggagcacatagcggcgctgtgcccaacccaaaaatagtaggccccggcagagcactcttggaaagcagacc

SEQ ID NO: 698959 - DNA, 139 bp, Homo sapiens
ttgtcttaatgacataaatgtcaaaagcaatgatggaatacatgagatcaactagtaagcacttatcaccatgcctgcaacataactggaacttgataaatgcaacgtaatatctagaatatgatcatttctactacta

SEQ ID NO: 698960 - DNA, 339 bp, Homo sapiens
cgatcgccttagctcagtgatcctcccatttcagcctgtagagtagctgggactacaggtgtgtgaaaccacacctggtaattttaaagaaaatttttgtagatccttctgccttggcctcccaaagtgctagacttatagggcatgagccagcatggccaggccctggacatggaaaaatcttaagcaggccatttattaaaatctttcagtaaataattcaccgagcagctaagcccccaaccaaaaaaaagaagccggaaagagaccccaaaaagtgacttttctccacactccagggttccagtgctggtttagagtctatgtccggccacattt

SEQ ID NO: 698961 - DNA, 432 bp, Homo sapiens
gagcatcctgagtctaaatcagatggctggcaagactgtagaacaagtactgaacaatatgatcctggcgagaagaggcgcgatctcaccatagtgtctatccgaaacacggatactcaagaaaagatgctaaggtgcgcctagaggagatgtgctccaatggctgtaacgatgctagatacttcctagggtcctctacgcgcgtgcccttcaacgaggtgctctctgacctggtccgatgctataccatatcttgtgccctaagaggtcctggcttcgaccggtaccctcggactcggtccaatgtgataagcacgagatactgtgaccataggagtggtctggcggtcggtcaaatcagtcgcgcagtacgaatcttgtgagatagagagcctgggaaatagtataggatgcgtcttgaaggtcgtcgca

SEQ ID NO: 698962 - DNA, 923 bp, Homo sapiens
ccagactgtcggctataacttcatctactcgttctctttcaggactgggtgtctacttacggacggaacagtgtgttgtgatgctggagtggcacaccatgtgcgcccatccgtagcaagtacagattgtagtctagttccacatggcgtaccaatagaaggccgggagggattaacgcggtaacattgccagagtgctccatgagtcatcatcgaagcgttagaaggtaacaagctgatatcctgtaaacccttagcaaggtcttgtgcgtatggagaggcacgccagtcttccaactgccacagcaaagcacatatagactacagactcaacctattcggtgccccttgccctatcactcgatatcgcgtcatcgtctggaccgatcttgtgccatgtgatggggtggcagggttgtcacagcgcaagggttgcaggaccagagagcgtcgactcgcgcgaggtgaattcctaggcattctacgtatggaggccacttcatatgaggcgtggttgtcctcaaagcatcaacgttcacccctgaaaattgcccctatagtaagctgaagctcggcggaaagagctcgcgaaccatttcgggtgcctagtcatatagaagaattacatcgtcgaagagcgtctcaaggacctagacgatccagtaacgtgtgcctttaggcaggcacgcttgcagctgacagtcatgggagtgcgccttgatgcccgggtgggcttgctcaccgttgacaaacctatgggccatttgtctctaggccaatgggggatcaatctcgactaaggacgtaattgtattgcactggatgctacagtgtgcgataatccaggggcttgttggggcaccgagaattgccctgtcggtaagagtttctggctcaggctgttcgtacagagcaagaaacca

SEQ ID NO: 698963 - DNA, 492 bp, Homo sapiens
attcgcggccgcgtcgacgccagtcaacgctggaaaccaacgatctgacaccgatcctggcatcgatacctcagcagatcttgccgggcctgctgctggaagtgggtccaagtctgctgccggcgctggaagctgccctgaaatactccctggtcaggcagccatccttacgcggctgcaggctggcgggcacacccggtgcgcgccgcatgccattcagcgccaaggagacacagatcctcaccttgctcgtcagcggccagccaaacaagacgatcgcgcagcttgagacatctctgaaaacaccgtgaaatttcatcttaaacacatcttcgccaagctgtcggtagacaatgcgcacggccgccatcagtgcagcgttgcgcctcggtgttcttgattcctctctctgagccacccgcctacccattcggtcgacgcggccgggaattagtagtagtaggcgacccgggaatttcggcccgtacctgg

SEQ ID NO: 698964 - DNA, 226 bp, Homo sapiens
ccaacgataaaaagtgaacaaaggtctctggttttcctaggcagagctgtgtgtgtccctggcgtacttgcgattacgggagcggtgatgactcttaccgagcatgctgccttcaagcatctgttctacacaacagcacatcttgcacccgacccttaactccactttaacacctgacgctggacaacagacacactgtttacacgggcacgcacatgggttgcgg

SEQ ID NO: 698965 - DNA, 304 bp, Homo sapiens
cgcagccggtacgaacgggtgatgcggttggctacactggatgtgactggacgactgttactactcgggacccttccgacccggctgatgtttggtgcttaggatatgaatggctgagcggaggctgtaaaaccgggcactcggcttgggttatcaatactcgggctgaccatcatcatcgtgggactgactttggtggaagtccttggttacatgtcattattgcgtttccgacaagttataaagttgtcacttacccctcgggatagtttcccttggggtgtctctcctgaagactactctt

SEQ ID NO: 698966 - DNA, 388 bp, Homo sapiens
atgcactgcccctgcctctgcccggcaccccccaggcgtggcgccgctggccaggtggccctgaccaggcagcctccccacagctgtcccggcccacccgcttgtccagggcattcgcccaccccctgggcatccatgtgtctgggcccggggaccacaggtgtgggagctggtgaccccagaccccagaattctcagggctctacccccctttcctcgtcctaggtggccactggctatcaggagggctggaaggcagagctttgggccaaaagccaggccgttggggtccccccctcaagtttggagcccgtttccgtggtctgtaccagaggcaccggaggttgggttcctgcattaaacttcactgtgtgtttcctatctcgga

SEQ ID NO: 698967 - DNA, 625 bp, Homo sapiens
  misc_feature (247)..(247): n is a, c, g, or t
  misc_feature (253)..(253): n is a, c, g, or t
tcaggcggccgggaagaatggcggactttcagactgagcgtgcctaccaaaagcagccgaccatctttcaaaacaaaaagagggtcctgcggggaggaaactgggcaaggagaaagcctcccggcggttactacaagaaacatcggctcgttgggctttcaagaaccacccagagggaggttatgtggagggccacctacttgtgacaagaaaagtgcccctctcacgtggttaagtggtgctccantctcgnaggggcggactccctctctgtggcggtggttgcaccaagatatgaaatgaatatggcaggaggaacctatgggtgctatccgcgccggagaacttattctggcatctaactatcccgcagagttacaagccgtcttgcgagaaaggcggccacaagaaacttgttctggtgacactctgttcccccggtcttcgaggggcacgtccaggatcggtgacatcgtcacagggggcgagtgccggcctctgagcaagacagggcgcttacaaggtgctcaggtcaccaggctgccggcaccaagaagcagtcccagaagttctgaggcggacatcggcccgttccccacaattgaaataacagttattttctcat

SEQ ID NO: 698968 - DNA, 254 bp, Homo sapiens
ttggggggttttggccccccccccccccccccccatttttggggggtttggggggcccctaaagattttttgttttttttccccccggggggggttttgggggggggggggggcccccccttttttcccgtgggttcttggggtttttggggggcgggggggggggggggggggggggcccccctttttgccccccccccccccccccccccctttttttggggccggctttttttttgggggggtttttggga

SEQ ID NO: 698969 - DNA, 783 bp, Homo sapiens
tggaaacggagtcaatgtcacccaggctggaagtgcagtggcacaatctcggctcactgcaacctccgcccctgggtctccagcaattctcctgcctcagcttcccgagtagccgggatcacaagtgcgcgccaccaagcccagctaatctttggtgtttttagtagagacagggttccaccattgttggctagacgtggtcctcgaacctccagacccaggttgactccgcccgcctcggcctcccaaagggctgggattacaggcgtgaaccacctcgccctgccgcggccacatttttctcttttttttgagaatggagtcttgctctggttcacccaggcaggagttgcagtggcgcaatcttggctcactgcaacctcatgcctccggtgggttcaagctgttctccttactcagcctcccatgtagctgggattacaggcgtccgcaaaccacgcccggctgatataagtagtttagtaagaggcgggtttcaccattgtggccaggctgatctcgaactcctgacctcaggcagttcaccccgtcattcaagcctcccaaagtcgctgggattaagaggcgtgacgccattggcgcccggccaaccaccttttttcaaacccggtcatgtggtgtcccgggttggagtgtccttccccagggataaacccgtgggcacattcctttgaaattctgaaactatcccgggggaaagtcttgacataagaggatgccatatagtgcaccctcaggaatcccggtccttggaacgaaaat

SEQ ID NO: 698970 - DNA, 187 bp, Homo sapiens
acattccacttggcagttaaattacttgaagactgttgctagttgggaatgtatcttgtcactgattttagggttgcatctggaaaagacgaaaagcttcagtcccctcccaccaccagaaatgaacatgaaagcattttagctaaaagctacaccagcaaaatgtactcaggattcctcgcaatag

SEQ ID NO: 698971 - DNA, 508 bp, Homo sapiens
ggggctgacctagaggaccctcagtgagctttgaacatgatgtcaccaaagacaagtgtatctcaggcttttcttagtgaaagatactttcctaaggtagtttatagcaagattggggataaaaaaaagagttggatttatgggctggagagtcattatatacttttaactataggtaaaatttacatacctccagtccaataaatttagatgtatgcttaatgttctaaaagctctttgttccttgctcatccttgggcggaccagagaagttattgataatcagggtgttgctttctttgtggtaggacatcaccatgttctcatagagtcctgttaggaagcagaggacggactgctgtgtgtcactgtggagagaaaaagaccttgtgacgtccctgtcatcacaggattctagtatcttgttatgccagagatgtggtttgaaaacttgtttttatggacgtatccacaaaacattatgctctgtggaaagggcaccgcaaaa

SEQ ID NO: 698972 - DNA, 163 bp, Homo sapiens
cgtagtagggtggtggtcggtctggcacggtgtagtcgcgtagtactcgacaccgcacttgcacctcgcacggcgctggtgcacagcacacgtacgtgcacacacacgcgtgctgttgctgcacacacacacacacacacacacactctctctacagtgtgtg

SEQ ID NO: 698973 - DNA, 956 bp, Homo sapiens
ataattatactagcattgaccatctcacttctaggagtactagtatatcgctcgacatctcatatcctccctactatgcctagaaggaataatactcaatcgctgtcattatagctactctcatagaccctcaagcacccactccctcttagcgcaatatgtgcctatgccatactaggttctttgccgccgtgcgaagcagcggtgggccttagccgctacataggatctcgaattgcttccgaacacatatggcctagacgtacgtactataaactaaagctactccaatgctaatactaatcgtcccaactaagttatattagcgtaccactgacatgacttgtccaaaaaaacacataagtttgaatcagagacaaccaccgcacgagcctaattattagcatcatccccctagcatatttgtggaaccaaatcaggcaacaagcgctgatttagctgttcccacaaagcatttttactcgcgagcctccgaacaaacccgctctctaataatgactagctgtactcggtaccacctcagcaatcatggctagccaatgccatttatgccagggaaaacattatgacgatggggtggtctactcgtctagtataatcatccgatgaatctgcttctgtgataacgagtgcacagcccacagaactaaatcatattgaatatctctcagccgaaacaaattattcccacattggctatcatgaccccgatgaggcagacaggcggaacagctggaagagggagattacttactaatctaacctaagtagggtcccttaccctaataaatcgaataattaaactacgaagacctgcgataataagattaaaagacactatagtggcgagactttaaaactgagcgaaagatattaggaggtaccacaagctaaagaagaaactcttggcccatatagccagacgggaacccatg

SEQ ID NO: 698974 - DNA, 552 bp, Homo sapiens
  misc_feature (23)..(23): n is a, c, g, or t
gccgatggtgccctcggtcgatntgatgaacacggtcgctggcttaccgacctcgaggccgaggtcggtcgcggcatccatggtgaccgacgacgtgacgacctggtcgccgccgtccagcgtcaccttcaccacggccatcacggtgccgagttcgacctcggtgatggtccccctgagctggtttcgggtcgagagccgcatcgcaagaacctccatgtcgcaacggtcgggatctgcggtgagcgtagccctacccggctcggcccggaatggcttgggagacttccacttacgcgagcggacgggcctagtgccgggggccgagcagagctacggacgcatccacggccggttccacgattcctcggaccggttttccgtcttcgaccgcaagtgcggtcagctcccgcagcccgccgagcaggatcacggccagcggcgcggtcagcggaggaagctgcgcgcggcggaatccgggactggcgctcaggtcgatcagcaggctggtcagcaactgcagcccgcggcgctgcaccgggcgcgcggccg

SEQ ID NO: 698975 - DNA, 346 bp, Homo sapiens
  misc_feature (9)..(9): n is a, c, g, or t
  misc_feature (38)..(38): n is a, c, g, or t
  misc_feature (60)..(60): n is a, c, g, or t
cctggttanttcttgcaggtgaagcaagatgtccttcngggccgtctgcctgtccccgtnaacactgctgctcagctgggagcgtatgccatccagtcggagccttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccc

SEQ ID NO: 698976 - DNA, 183 bp, Homo sapiens
ccttaactgaacttactgccacggtgaacttgaactctgagatgcacaagaggagagtctgttttaacagctgcttggacacagaggccctagagttactactctcaagacagctggttctgtctctcttttcactgtcctattttttcaaggcccagctgtcaggatatacccactgaagtg

SEQ ID NO: 698977 - DNA, 217 bp, Homo sapiens
cctgacctggggtcagacccgtgggttggacccctgccccccccccaggaaccctgaggcctaggggagctgttgacccttcagtgtctgcatgtggaaagtgggctccttcccctccctcccagggctgttgtaaggggccctgttatccggttccaaagcccagggcttggcgcccccccctgggctcccaataaatgtgtttcctgttttacca

SEQ ID NO: 698978 - DNA, 486 bp, Homo sapiens
ctgtttgcgggcaacaactgttgcgggcctgggggttgcatgttctcctgaggatgggccctaccatttcaagcccccgcattgcttggttccacctcctgggccgggggtttggcccccaaagtgtttaggagagctttctccctagatcgccctgtgggccggggccctggaggggtgctttgtgttaataaaattgtaaggtttgcccccctcccctgttgccggcatgggggtagttttagccccccccccccctttgtttccagccccggaaaagggggtgctcaggtggaggtgtggggtatgcccctgagctcctgctttgggcctggtggtttgcccccacgcggcccctgcccggctgccccaaggggtggatgcctgccggtcccccagcaagcctggggactccggaaaattccccgggcttgggggatttttaatttttagggccatttttttttataaaaggggcctttggga

SEQ ID NO: 698979 - DNA, 320 bp, Homo sapiens
atcgcccaacaccatttgttgaaaaaatgatcttttctccattgaattgactttgtgtctttgtcaaaatcaattgacgttatgatgggctattctgatctccatctagctcgtgatctttgtctcttcacatacacagcgtgtcttgttactaacatagcttatagtaattctctctaaatcaggtagcacggagtcttccaactttgctttttcaaaaattgttttagctattctagttcttttgctttttcatgtaagttgtagaatcatcttgttgattcttttaaagaatatttgcagggcttttaatgggaagt

SEQ ID NO: 698980 - DNA, 248 bp, Homo sapiens; identical to SEQ ID NO: 546000

SEQ ID NO: 698981 - DNA, 922 bp, Homo sapiens
tgtgttcatttgctggattccagtgtagtgaatattgtcatagtgtcttaacgtctgagggaaccgtcgtggtgtgtcaattcttggggtaatactgatgctagaggaattataatggacgtctccctatacaattgcatcgagaccccgttctatggtagtctcgcaccaattgttcaccaagttcggtatgtttttaaatgtgccgtttttgagacggagtttcgcgtcttgttgcgaggctggagtacaatggcataatctcggctcacagtaacgctccacctcctagtcttcaagcaattcttcggcctcagcctaccgtgtagctaggattacaggcgcacgcactaccatgcctagctaattggttgtacatctatgtagtatagacaggatttcaccatgttggccaggctggtctctgaactcgtgacttcagatgtgccactcctccttggcctcccaaaactgctaggaattacaggcgtgagccaccgtgcccggccagggtactgcctgattaaagtggtatttatgatattggacaatgcccctggccacccagaaccccatgaacttcttacacctttggtggtgaagtggccatacgttactccccaaacacaacacgttccagattcagcctatagatcaagttgtcataaagatctgttacaggctcagttagcacatggtactctatggataaggatggtcaaccctatggaagagaaccccatcatgaaagtctggaaggattacaccactgaagacatccatcgttgttatagaaaaagctgtgaaagccatctaaacctgaaacagattcctacaggagaatactgtatccaatagtgcgtagctactagagaaaacgtatgcccagataatatgtgtacttcataggaaattatgatcc

SEQ ID NO: 698982 - DNA, 184 bp, Homo sapiens
tctctcaggtgcggtgagtagctccatccgacaggggcccagtcctcccacacagggcccagcccacctctccaggtcaccatgaatgtacgctcccatccacgagggcccagatccttcccacacgagggcccagccctcctctccaggtcaccccgtgaggggagccctaagggtaccgagc

SEQ ID NO: 698983 - DNA, 1173 bp, Homo sapiens
  misc_feature (263)..(263): n is a, c, g, or t
  misc_feature (383)..(383): n is a, c, g, or t
  misc_feature (434)..(434): n is a, c, g, or t
  misc_feature (596)..(596): n is a, c, g, or t
gccttctgcaagtgctctctgccttcacgcttgcttcctttgggagagaaccttcctctgggttgtctcggggattcaggaaggagcccaggagcacaggaagtagagagagagacaagcatgttacatctgcaccatatctctgctttgtcatttcagcgatgctgtgctgccatgcgtatgcgtcgcctgtactgactaagctttgggcaccgatcagtcttccatgcgacgatttcctgctctcccagaccgcaacatcncttctgtctgactaggcggcatcgacgcttcggcagttaggcgtgacagtttgcgctggctagtaggcaagcaagctacgctatgagcgacatcacggaagatattgaaccgacctttgnacgcatggtactgcgctgtgtagaggctgacgcacaagcaacaatcgtcgntagccgcgatcgtgttgatggcgagccccaaaagacatggatgccagccttttcgctcaacgtggcgagtactagcccatgctcgcggacgtcagcggcatcgagtcttcacacgacagtttgagcttacgctgctgcttgctatcgagctcggcagccggnacgctatacctggtagagctcgtctcgcgaaccaacaattgacgaacaaacttcttcgcgaacaacactagctgcacacagcacgacaagcgcctatagcgcgactgcgcacctccgatctcgcgcccacactgcgccatcctgcgcgctcctccgacacctcgtcgcacgctcacccgcaagtcgcacgtccactctgcctcacgcgactccgtcgtcccactccactcccgcctctctgagcccacttgtccgtacgtgatctgccctttcctcgctttgcatgcgcctgcattcgccgccgcggctgcgggacactcctgcagagcaagggcgtgctctaagccctgcgagacacgacgggctcacccttccgtcgttcccacggtcctggcccttcggactgccactcagcactcggctaaccactggaacgctcagcgacaccttgactaacccgtcctccctggaatgcccgcgccatcttggttcagccccttttacggccggtcctacctccctcgacaagcgctcgtattctgcagcgtcgccccgaattcggtccctgcccgatgac

SEQ ID NO: 698984 - DNA, 211 bp, Homo sapiens
ctaggagagaacagagagcaacgctccaacactggatctaggcaatgatttataggatgtaacgccaaaggcacaggcaacaaagaatagacaaattggactgcatgaaaatttatttatatttatagagacggaatctgtgctcgtgtcgcccaagccttggtctcaataacaacaaccaaataaacatgaaaccaaaaaaccctaccct

SEQ ID NO: 698985 - DNA, 257 bp, Homo sapiens
aacatctcggctgtactccaattttaaatgggacataagctcggggtagcgttgagtgtagccgtccgtggcatgcgactgccttgcgggccattttgggtagccagaactggcgctgagagatgaaccgaacgccgggcttaatgcgaccgcatggctacactcatcagaccccagaacatgtctcgtttgatatagacgtcaggcacggtatcgatctcaggcgaaccattggtaggcgcagcatatagtccacg

SEQ ID NO: 698986 - DNA, 806 bp, Homo sapiens
atacatatatgtagaccttcccgaaatgccattctcaattttattttatgggctccaaacaaaaattatctgggttaataaggttatctattaaagcccccagaatctcagcactagatgtcataaatatgaaatagtaaacaacaaggtcacttgcacaacatgggtatttaataccctcagctggtgttcttcagaagccatacagaactaggaaaggtaagaactagctatactattgcagatatacctgaccactcacaactgtacttctatagcagacacctttgttaaaactgaacacagcattcagctttattgattgagtacaaactgctttagctgtttctaccctaagtcattagtcacatcatgtaccaggcaacatggcacaaaaaacaaatgctggctataaaatagtgaataatatcaagcatgcaggctagaaggaaggcataacaacgtcccactgcatcataaagcgaccaccagcaacacagccaatacctatcggtacagactatactacactagagcactagccaaggataccgcaacttgattagcccgcacacttgattataacagcaacttacgaactctctagggcacaacaattgaaaataggaaactaagaaatcccgacattagataactagagacgacaggcaaatatactggtacacatccttatcaaaggtaaagtaaggaaacactaactcatcagtagcagacatccatactaaaactaggacacttgaatctaatggtaataaaaactacatagaagctcaacccaaccagac

SEQ ID NO: 698987 - DNA, 370 bp, Homo sapiens
gaaatcaggaggcacagaacacactctatctcaaaaaatacaaaaataaaaaaaagaaaagagcattgcctttaagaaaaggaaagcctcaattgctcttcctggcacacagtagatgctcaggaagtatctgtggaatgaatgaatgaatgaatgaataattgaatcattgcgtgaacaaagcaattcttgggcaatcttgctaaagggcaggctccctttgtggcttgttttctgtctctctttccctgacttatgaaggaggaacaggacggaaccggttgtgtgtccaggccttctctttggtgccccgtgggttccttggtggccgtctgtatcctctgacagaggtagggtattcatgtgccct

SEQ ID NO: 698988 - DNA, 927 bp, Homo sapiens
tgttctcgccctcgtgttgcttttcgcgtttagtgctccgtcgggagggttttgcgtatccccgctctggtggtcccggcccataatttggggccccgttccgggttgctctctcctcctgggcgcgcttttacctggcgtgtgtcgctatagcgtcgcagctcactccatcgtttgcgtcgccacttctacggcctctctttattctcgctccgggcagaatacgcactcttcgatttctgctagggctgcggttatgaagcctcgatggtgtgcccctctgtgctcgtgttggatttcgcccgcgtcctcttgactaccctccttcaggtccgctggactaggtgctgttctcctattgtctggatccggattagcaaattttgtaatctaccccctggctcctcagcacccataatttttgtcctcccggaccaccctagcgatatccacgccctcccctcgcaataccccccaagccaggaagtactcattcccgactgcccacatgtgtttctcgacctacctctccatcaaatccgttaatagagggcctcgccccgatgttgtaggcatactccccagatttcagcatatatgacccccctcttctctgctattccactcctccccgcccttcgactgtcatttcattgtcgcgcccgtctcgcacgctcactcctcgggctgtgttgactccaaaagccgagcactcgacgcccttcttggatgatctagtggtagtgggcgtaggccactacgtcctgtgctcgactttgccacgcgcttcatggcacgccgcgcagaggcggtgaggactggtatgttcccactcactcgctgtgactattgcttcgtactcgaggcctgttctctctgctctgattgatagacctagaatataatttcatggtgctctccgcggga

SEQ ID NO: 698989 - DNA, 749 bp, Homo sapiens
ttaagtacacaatacagtatgttaactatagccacagtgttgtacagcaaatctctctcacctatgcatcctgcgtaactgaaactctgtgcccattgaacagcagctcctcatttcctcccccatcagcccctggcagccatcattctactctctgcttctgtgagtctggctattttagatcccttatagaagtggaaacgcgcagtatttgtccttctgtgactggcttatttcattgagcataacgacccccaagtttagccatgttgttgcttatggcaggatttccttcttttttcaggctgaataatatttccttatatgtatatgctgcatttttaaaaaccctttcatctactgacagacgtttagattatttccacatcttggctattatgagtaatgctacaacgaacgagggagtgaaaatatctctttaagatcctgatttcagtttttttgaataaatacccagaagtggaatgactgggtcattcatatggtaattctaattaaacatagaaattatttttattttttgagaaaattctgtgctgctttcacaggggttgctccgttacctattaccatggggccaaggtcccattctcacatttggcaacggtatcgggtgggaatgacagctataatggccggctcagcaatcgactcgaaaagaccggctcaaaagcgccatatgtcaccccgaaacgccaattgggcaacacccaaacatgcccgccact

SEQ ID NO: 698990 - DNA, 122 bp, Homo sapiens
  misc_feature (60)..(60): n is a, c, g, or t
tgggcacgagacgtagcgtaaatgtatgatccttttcaatcgatggactgaagttgctcnccttaaggaagcgtgagttctcctggcagtgactagctgtgtaggcaaactgtttgtgattg

SEQ ID NO: 698991 - DNA, 400 bp, Homo sapiens
gagctggaagcttacaccatatcgtctgcaggaacagccaggggaggttcagctgacgctcccaaggtagctgatccccaccaagcacacaggaccagctggagaacagatcatagcatatgctattacatcccaaaccatggggttttcacactttaccccaggcatactatccctaagaagaaccctggcacatgtaccaaacaacactacctgcagaccgactgccaccactttctttcccgcccttacctcccaccttcattacaccctccccccaccccccctccttccccccgtctcccccccccccccccatctcccccccccctctcccccccctcccctcccacccacacccccctcccccccctcaccgaccccgcctcccccatcctcc

SEQ ID NO: 698992 - DNA, 163 bp, Homo sapiens
aatcaatgtgaactcagggaactgaggaagcctgaacctcatatttggtgttacggtaagataaccgacagggctggtgaaagtcaccagatggcagaagtctaaaggaagatggaaatgtctttcaagcgtctccaacaaaccctcaacagacccgtgttcc

SEQ ID NO: 698993 - DNA, 288 bp, Homo sapiens
  misc_feature (16)..(16): n is a, c, g, or t
  misc_feature (31)..(31): n is a, c, g, or t
  misc_feature (47)..(48): n is a, c, g, or t
  misc_feature (60)..(60): n is a, c, g, or t
  misc_feature (74)..(74): n is a, c, g, or t
  misc_feature (76)..(76): n is a, c, g, or t
  misc_feature (79)..(79): n is a, c, g, or t
  misc_feature (105)..(105): n is a, c, g, or t
  misc_feature (129)..(130): n is a, c, g, or t
  misc_feature (133)..(135): n is a, c, g, or t
  misc_feature (140)..(140): n is a, c, g, or t
  misc_feature (166)..(166): n is a, c, g, or t
  misc_feature (176)..(176): n is a, c, g, or t
  misc_feature (232)..(232): n is a, c, g, or t
  misc_feature (262)..(263): n is a, c, g, or t
  misc_feature (265)..(265): n is a, c, g, or t
cacgtgaagtcagccngcaccagccgaaccngcgtggaagatctgcnncaaccgttatcnttgttcgtgagttncntcntgcgtttaaaatgagatgcgagagcntttagcataccgtgtaaatatggnnggnnnaaaantaaaatactattggaagtgctttcanctcagccgcntcttagctattagttctttgtgttgtcttatcaaagtttaatggatacagttccgnggttgttgatgtgtttgtgtgtatattcgnntntataaagatggtagtaagtcggt

SEQ ID NO: 698994 - DNA, 292 bp, Homo sapiens
atatcaccagatagtcaacattgaaatcagactgattatatattctttgcagtcaaagatggagaagttctatacagtcagcaaaaacaagactgggagctgactgtgactcaggtcatgaactccttattgccaaatgcagacttaaattgaagaaagtggggaaaaccactagaccatgcaggtatgacctaaatcaaatcccttatgattatacggtggaagtgagaaatagatttaaggcactagatctgatagagtgcctgatgaactatggatggaggttcgtgac

SEQ ID NO: 698995 - DNA, 210 bp, Homo sapiens
tttaagtgaacaggccggctaatttttgtttgtttgtttgttttgagacagagtctcgctctgtcgcccaagctggagggcagtggcacgatcttggctcactgcagccttcctctcctgggtttaagtgaacacgctggctaatttatgtttgcttgagatggagtctcgctctgttgcccaggctggagtgcagtggcatgatctcag

SEQ ID NO: 698996 - DNA, 305 bp, Homo sapiens
gccatgcgaagttgacgtctacagacatgtctatggctgctggcatggactatagggatggaaccacacagagaccgcgagacctgtgtggctgccattgtggcggtacttttggaacctgggcactatactgagtatagctgtggaggagaccggctgtggctctgctgacactacagctgaataatggtgatgaagtcatacgctctatagctgcaaatgttggagattgacagagtacagacggattgtatgcagggcctttcaaggatactgtttaacgatgacgattagtttcgagactc

SEQ ID NO: 698997 - DNA, 274 bp, Homo sapiens
tcggccctgcatcggccctggggtaccatgtggcctctacttctgtggccccctgtcccccagacccttccccttgtttccctggttgcctctcttgccccttgtcctttagccccccgacccaaaagggggtggggggggttttttgggagaaagggagccaggtcattggagggcatgggttggcggggggggggtttggggccctttattttggcttttcccccccgggggccccggcggcttccaaaaaaaatttatttttttcacggga

SEQ ID NO: 698998 - DNA, 312 bp, Homo sapiens
  misc_feature (20)..(20): n is a, c, g, or t
  misc_feature (109)..(109): n is a, c, g, or t
ggtaagacgggtaaggtggntacaagcccagagatgagcacatgtaccgatctcaaccccgacaatctgtcagggcggtgatgacctggaccccaactacgtgttgagntcgtgggtgcgcacgggccgaagcatccgtggatcctgcctccccccgcactgcagtcgtggggagcgccgcgtcatcgagaagctcgtggtggaagtccctgtccagcctggacggagacctggtggcccgatactacgcgctcaagagcatcacggcggcggagcagcagcagctcatcgttgatcacttcctctttcgac

SEQ ID NO: 698999 - DNA, 244 bp, Homo sapiens
caaagggatttttaaattaattgcaaaatgtgcattagctattgacttaaagtgaattgccttttgtatcctgattcccaacacctattcctgttcagtattttttgtcttgaaaaaaaaagtttatgtttgtaaagtcaaataaaaggttatccccctttttagtaaaaagttttagtttggggctgttaataataatttgctaaaaggccttttaaaattttttataaagggtttttaccca

SEQ ID NO: 699000 - DNA, 227 bp, Homo sapiens
gtatgagttggggggtctgtatcttagggcagcctcctagtgggcagcttctagtgttgcagataggtccctaacccccaggatgaccccgtagtggaatttcattgacatctgagtgagtggggactagtgtcaagtctagcccccaagtcagactggaccccagtgactctcaggaaggagggcacccccctaccgtgtgaaagatgtgcaggggctttgtcagt

SEQ ID NO: 699001 - DNA, 247 bp, Homo sapiens
ggagtcaacccagtaaggcggcactgaggagatctagggtgatgccattgggccactgaatgttcttctcatgcattaagcttctataaaaactcatttgcactggactgtcatctcattcttgttacaactgtataattactatgttcacatccaaccaaactggttagctagcgaaaaaccgtgcaaatctgagttgttacgtagtctattttgctccaacgtcatatcacatacattggtggat

SEQ ID NO: 699002 - DNA, 536 bp, Homo sapiens
  misc_feature (105)..(105): n is a, c, g, or t
gcagtgctttgagccctaggattcatcttctttttcacggtaggtggcctgacgggcattgtattagcaaactcatccttagacatcgttctacccgcacggtantacgttgtactcacttcccctatgtcccatcaataggggctgtatttgccatcataggagggttcattccctgatttcccctattttcagggtaccccctaggccaaacctacgccaaaatccctttccctatcatatttggcggggtaaatttaacttttttcccccaaccctttttcggcctatccggaatgccccggcgtttctcgggctaccccgatgcataccccccatgaaacatcctatcatctgtagggtccttcatttctctaacagcaggaatattaataattttcatggtttgggaagccttcgctttgaagggaaaagtcctaatagtagaagacccccccctaaacctgggggggctttttgggtgcccccccccctcccccccctttgaagaacccgttttcattaaattttgccca

SEQ ID NO: 699003 - DNA, 393 bp, Homo sapiens
ggtaatggtggttttcttcattgcattcagatggatacatctgtcaacgccgctaatcaggttgtttctgttggtgctgatattgcttttgatgccgaccctaaattttttgcctgtttggttcgctttgagtcttcttcggttccgactaccctcccgactgcctatgatgtttatcctttgaatggtcgccatgatggtggttattataccgtcaaggactgtgtgactattgacgtccttccccgtacgccgggcaataatgtttatgttggtttcatggtttggtctaactttaccgctactaaatgccgcggattggtttcgctgaatcaggttattaaagagattatttgtctccagccacttaagtgaggtgatttatgtttggtg

SEQ ID NO: 699004 - DNA, 147 bp, Homo sapiens
gcagtaaacggggttttcagacccagagcactggagatgcagtagtatcaagaggaaatgagcaagggtctggtggcaggtctgggaccgacagcatcccccgtgtctgtggggcctcccctagacccacattccaccttgccaggt

SEQ ID NO: 699005 - DNA, 678 bp, Homo sapiens
tatatacaggatgctcagccagcacaaagctgtggtgagattgggcccaagtctccgactccagattccaaaccacattaaaaaaaaaaaaatcaccgggcagacggcctatagctttaacagtctcggtctccccttcttcacatccttccgggggagaaaagttggtggaatattaagtaaatttggattcaatagactttttatttttttggtaaagatgatgggggtctggctatgctggctcaggagggtctggaactcgtgacctcaggtgatcctcccacctctggtctcccaaagtggctgggagtggcagtgggtggtggaccttgggctcactggcagctttggactccctgggctcaaatggctcctcctggagcctggactagctgagaccacgggctggtggccatcatatccagctaaattttttattttttggtagagacagaggtctcagtatggtggcctaggctagtcttgaaattctcgggctcaagtggatcctcccacctcagcctcccaaagggcggggattaccggtttgagccaccacgcctggtggactccaacttttaatattttttaattttggccactttttttttttttggggacagagtctccttctgttggcccaggtgtggggtgtcgtgggcccgaatttggccc

SEQ ID NO: 699006 - DNA, 294 bp, Homo sapiens
ggacccggtagcggggaatgaaaccagtcacggacaatctcaaaacgcatgctaagtgggcaaaaagttgattgtatttactgactgtaaagagaaaagacatcaatggccccacctgccttgattgaagaccctgaggttcctgctgctgaggcacacacatctgtgtataataatggagtcaagccagggcctccccctccacaactaggtatgctcactgtttccagctttcctattccatcccttcataggatctgggagtctcctctccttctagctgccaaagataat

SEQ ID NO: 699007 - DNA, 105 bp, Homo sapiens
cacctattccctgggcctcccaacagtgctgacactttgatctatggacttctagcctccataactgtgtgaaacagttccctaaaataaatctctctctgaaca

SEQ ID NO: 699008 - DNA, 824 bp, Homo sapiens
gatcgctcgctcgcgggaggtgcattgcagggggccgtgccgggcgccatcatggacgaggactagtacgggagcgctggcctgatgtgggtgcgacgaggctgacggcggccagctagtgaggcatgattctggagaaggagaggatgatgcgggaggttctagcaatgaatgcctgcataaattttccagccggtggattatatcatggaaccctccatcttcgacactcttgaagagcgtattttcaggctaggatgggtctccagagaattgtgtatccaggctcttatcttgaaaactacacgcgcgtgtgtgcccgagaccttgtgaaacctttgctaggacccgcatgttgggctcagtttcaagaccatgggttggttgagcccagtgccagggttcaaggaacacttcgtgtgcataagtcaccttgacagaggtctcgcgtgagtcaagacattctttgagccccccgttaaacaagcagaaatttcgtaattgctttttaacctggaatgggataagggagaaggactccccaggcggtgggccttggcaaaacagtaattgactctgacggcaagtacccaagggtgggcctggggtgaacacttttctttataacttaaaaaacccgtggtcgttggaatatgccccgccaattcccgagaaactagggattctgaattggcttggaaagcttttcacagcccagtgttacagggcctttcattttccgtgtgacgggccacgtggggtaacccattgggcgggaatgaaatccaaccaagattggttgttcccacaaggggcatttggcc

SEQ ID NO: 699009 - DNA, 174 bp, Homo sapiens
tctggaaagactgccgagaagagactcagaatttctatttcctaaaaatgtacacgagtattgaatgtacattcaccgtcttctcttctgctccctatacatctttaacatgatccattactggaactttctttctagatgtagggtaacccatcatttctgtgcccatttcaa

SEQ ID NO: 699010 - DNA, 144 bp, Homo sapiens
attgtgtggagctgagcgcaagacgacttcgtggcgtggggggcccgggttgcagtgccaagggcacaccctgcatgtgtagccgggctgatgaggccctgtgctgctgcctgcggtgagccgcgtggggtgtgcttggcgtgt

SEQ ID NO: 699011 - DNA, 111 bp, Homo sapiens
gccccttgatgatgggcggatctttactaatgcccggcatctttactgactgcgcggcatctttactaatgggcggcctctttactaatgagcggcatcttactaatggcg

SEQ ID NO: 699012 - DNA, 397 bp, Homo sapiens
ttcatcataggcaccttcacggtggtcacctggtccacgtggtagtcctcttccacggtgtcattgactgcaaagggtctgtcccatttgcctttaaagcagatgtaattcccttgagtgcccttctccacgtaatcgctgatatgattcttggcctcttcggtgtccccatagttgacagtgaagccttgtgagtggtccaactttttaacatccgcctgcatcttatccacgagcttcaggccctctctgaggaacaggccattgccggtggtcagctggagctggctgtctggcatggttagtggtatggaggagttcctggaagccttcatggttctgagcctccggaatctgcgtgaggttgaaatccaggccctcaaggatttcttcgtga

SEQ ID NO: 699013 - DNA, 167 bp, Homo sapiens
tactatctctacaaacccatcacacatagacattggaacatctattacctattatttctggcgcttgagctcggagttccctaggctcagctctaaacctccttattcgatccgagctggtccagccaggccaccttctaggtaacgaccacatctacaacgttatc

SEQ ID NO: 699014 - DNA, 166 bp, Homo sapiens
tttgcttgcaggatccctcattaccacacagtctgtaagctttccccatatgttcgtagctagttcctacaaactttcttactgtggtttcaaaagcttaatgccatccaataaacgagcttactggaacatgttcctatttcatctcttttatcctactaccaaa

SEQ ID NO: 699015 - DNA, 151 bp, Homo sapiens
ttcactgtgcgtgctgaccatgtaagcccattggcagggtaccaaagtgatcctccatcttatatgaacatcagactgagtacctagaatgagaggcgggtcaaagaactcgtgcagaagcgttctcagttcataggctatcccatcaccc

SEQ ID NO: 699016 - DNA, 165 bp, Homo sapiens
ataaatattagaagcacaaacaaattgcacgtgtgtaaacaaactgtacaatgattgatgaagatgagggaaggtggtttgcagcactccagaagcataatacgtcatcctgactggtggtgaatggagagagcaggcatcttgtaagacatttgcggtggtata

SEQ ID NO: 699017 - DNA, 353 bp, Homo sapiens
caggcatgtaccaccacgcccagctaattttgtatttttagtagagacggggtttctccatgttggttaggatggactcaaaactcccgaccctcaaggtgaatcgccccgcccggggcctcccaaaggtggtgggattaaaaggggtgaagcaattttcctgggccaagatcttattgttttggaagggaattttccccccttggttgggaattcttcccggttgcaacttaaaaaaagattttttttggttccccccctccccacacaaaattggggaattttaaatagagggcccccccccccccctttggaattttttaaaccaaaattaaaacgcgcttttctttttg

SEQ ID NO: 699018 - DNA, 90 bp, Homo sapiens
  misc_feature (1)..(1): n is a, c, g, or t
ngagacggcgccggctcagatctcgagacaggtgcaaccgcgccaaccccctctacctccgcgccctcgcacccaggaccaccccaacgc

SEQ ID NO: 699019 - DNA, 375 bp, Homo sapiens
agaatagctgaacctgggaggtggaggtggggtgagccgagatcgcaccatagcactccagccggggcgacagagggagactctgtctcaaaaaaaaaaaaaagaatagggggaattataagaccaatggcaaataagatttattagtatattggaagtataaaagggtggtctaatatttaaaagggtataatctcacttatttactaccaaccctatgagataggcataatattcactttttatagacacacaaaggggggtaaaggtggtgaagaaactggcagggaagagacatttaagggggcagaaccagaatccaaaggccgggtctctcggatcccaaaaacaaataccggcctctaggtcagttcg

SEQ ID NO: 699020 - DNA, 1139 bp, Homo sapiens
  misc_feature (7)..(9): n is a, c, g, or t
  misc_feature (380)..(380): n is a, c, g, or t
  misc_feature (433)..(434): n is a, c, g, or t
  misc_feature (477)..(477): n is a, c, g, or t
  misc_feature (479)..(479): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaagtaggtgccgaaaggactggagaaaaggaagggggttatgggaagagcccaaagaaaactcggagacttgggggaagattttaaaaagtgtcagtgnatgaccacattgcacaagcaacatactgtgaaagcctggcacagtttctacanntggatgacataccacattgttaatcagaaataaatggtttcgncngggcgtggtggctcacgcttgtaatcccaaaactttggaaggccgagcgaggaagatcacttgaggtcaggagttcaagaccagcatgggcaacatgatgaaaccctgtgtctactaaaaatacaaaaattagatgggcgtggtggcgggcacctgtaatcccagctactcaggaggccgaagcacgagagtctcttgaacccaggaggcacaggttgcagtgagctgagatcgcaccactgcactccagccagggtgatagagcgagactcagtctcaataaataaataaataaataaataaataaataaataaataaataaatggtttcaattaagtagctataatgaatattattcttaaaccatgccattctggaaaaagattgaaacaatggaacagggtcattcaggaagcttctgtgatacccctctatagactcatagatcaaaaaaaaaaaaaaaaaaaccacaagacccttttccttttctgaataaaggccactcaacgctggtattctgggaattgtccagatgaggatgcacacttcatgcctttggtggtattgtagccaatgaggtttatccgaggtgtgattattgctaattgaaaacttcccaacactccgccatgatgacttgcaatatagtaggcattggc

SEQ ID NO: 699021 - DNA, 109 bp, Homo sapiens
ttaatgttatctgccaacacatcagtgtgtttcttcgtttctcaaaattatgcaacaacatttactgaacacttcagaaagaaagacatgtccctgtcccgaatggact

SEQ ID NO: 699022 - DNA, 2052 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699023 - DNA, 223 bp, Homo sapiens
tcgacccaaaataaaattctaaggcccccagcaaccatctgaatggactccttccttggccacggtgctcttaaaatttaacttggggccgggtgctatggctcacgcctgtaatcccagcactttgggagactgaggcgggcagatcatgaggtcaggagatcgagaccatcctggctaacacggtgaaacccagtctctactaaaaagtcgacgcggcacg

SEQ ID NO: 699024 - DNA, 398 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699025 - DNA, 1812 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699026 - DNA, 1941 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699027 - DNA, 1665 bp, Homo sapiens
gcggaacccatacggatggctgaagtgctctctgtattttttcctatttcttttacatttttccttatctgttgctttctgctttccatgtttccctacttccatctttgtcttctccattcgctcccagatttttccccatctgtttccctctcttcccatccatgcctccctctatcctctgattctcacatttcctcctacatttgttttccacattcctgtttttcttcccactgattcttctcaccacccattcccagcattttgatctcctataactcagaactttctgtcctgcagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699028 - DNA, 294 bp, Homo sapiens
gagcttaggtgatccgcccgcctcagtcttccgaagtgctgggattataggcgtgagcaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaaggggt

SEQ ID NO: 699029 - DNA, 131 bp, Homo sapiens
  misc_feature (88)..(88): n is a, c, g, or t
gggcggcagctgcgaggctcggagaaacaggcgccgcgggctccgcgcccggccggacccgggcccgagatcatgatgctgccgctcncgccgccgtcgtggagcgagaagcccggatagacgccctttct

SEQ ID NO: 699030 - DNA, 1339 bp, Homo sapiens
ctacatgctctccacccacttactgtggcataaatagtactcgatgggccctccgcggtggttgttaaaatagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699031 - DNA, 125 bp, Homo sapiens
ggagctcggtaccctgagctgatcatggtgaaatcctgtctctactaaaaatacaaaaattagctgggctcggccgtgcgcaagtgctggatggggagctgctcaaccgctacctgtacctgtag

SEQ ID NO: 699032 - DNA, 186 bp, Homo sapiens
tccaacgcgcctcttggtggtggtggtgatcccagacaagcgctcgttgctttggcttcgtgacctactccaatgtggaggaggcggacgccgcattgctgctcgccccatgccgtggacggcaacactgtggagctgaagcgggcggtgtcccgggaggattcggcgctgttggggctcctctag

SEQ ID NO: 699033 - DNA, 1998 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699034 - DNA, 1561 bp, Homo sapiens
taacaggaaaggagatactttagatatcgtcgacccacgcgatgcgcctttctgctaagggtccctgatgatcacctcatccaaggaagaacaaaaacttatagcgacttgcaaataagccagccgtgaagttgctctacaagcagaagtaacaacaaatactcatataccagcaattctgacgacacatatgttgcaacaaacattgaactgtttgatcaagctgtctctgcgctttaacggcaagggtcctgttccataaaggcatgttattggaggatgaaatctgctgctggtccttattatggtcagaggacggaagattgctgaagtctgattgtacctccatcgtctatgccactgagaagaaacagaccaaaggtggagttacccgaagacccggattatatgcaggagacacctgcaaccatatatagctagtatgaagagccacaaggatggaacaggaggaccctgaccaatagacgcatccatgagacggccaacacggacgggcacaagagagaagacgccatcaccacacaccatggacgaaggaacaaaggaagcggagagcggaatcgacgccgcggtagacggcaggatccaacaatcaaaggcggcactgatagacacggagacccagacatacaaccagaagaagccaggccaagaagtaccacgacagcaccgcacccatccgtacatacacacacagaacacccacaaaaatacaccatgaccagatgacaacacaacactacgcaatcccatgatgatcagagacatgaccaacagagacaccccatatccaggaatacaccccattgaggaaagcacctgggcatgacataaccaaaaatggaaaccaaacgacaaagactgacatataaatgacacgggaaacaataggaactgggacaaaaagaggcaacaaataagcaaagcgaacataggacaaccacaagagaacgcaagatgaacaccacaacgaaacggactagcaaacacagaacaacaggaagcatacaaaaggacaacaccagacaaagacagaaacacatagaacacaccagatgaggaaaacaacacaactagggcaaaccaccagaggacaccaccaacacgagaaaacacacaaagagaccaaccgagacgtaaaaagaacacgcagaaaacaaaagaacaaagacaaaccacaaagagaaggaaaccataaaacaaacagcaggagacaacgaacaacacgaacgagcaagacaaagagacagacgaaaagacacgaaagagcgcagaaagacgagaacaacaagaggaaaagaacgataaaaaagagaaaaaacaacgaaaagaaaagaagaaaacagataagaaaagcgactgaagatacaaaagagaataagagaagacagaggaaaaataaacagcaacaaaacgaactaagcataagatagacgaaaatcgcagaacagcagatagacagacaataaggagacaagaaagagaagaacacacatccggacgtctcctcgactggacatggcacaggaactagaggaaa

SEQ ID NO: 699035 - DNA, 145 bp, Homo sapiens
  misc_feature (117)..(117): n is a, c, g, or t
ctcctccacacagcccttgtagtcctcacggcatttagccgtcgcttttgtaagacaggcacaggtgctgatgctctcaggatgggttgcaattaaggtgacaagcttgtcttcccnttaaaggtccctgataatctcaaggtgt

SEQ ID NO: 699036 - DNA, 1754 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 699037 - DNA, 589 bp, Homo sapiens
  misc_feature (7)..(9): n is a, c, g, or t
tgggggnnncgaaggggggggaaaccttaggctaggtacgaggctgggtgttgcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaaggtaagtgaccactctctctcccaaccacccacctccagtcctgtgaaaattgcccacaatcaccc

SEQ ID NO: 699038 - DNA, 243 bp, Homo sapiens
ccccgctcggtcggtgggcacttccatgacacggacctcgcggttcaccaggcctgcagggatggagaccttccagatctgggctgctgtggtggtgccttctggagaggacgccgagatacacgtgccacgtgcagtatgaggggctaccccagcgcgtcagcctgagatggaagccggcttccctcctcaccatcctcatcgtcgttgcttcattgcttcactggttctcattaggagctg

SEQ ID NO: 699039 - DNA, 196 bp, Homo sapiens
  misc_feature (54)..(54): n is a, c, g, or t
ggtgacggagtcaactttgtgggcaatcaatcaatcaaacatgctatctcaggnagctctaataaaaactttagacaccaaaaatcagaaagatcctggtggacatcggcgtacgccacatcatacagaggtacaatgcccaccccatggaaagaaacggaaatccataaacctcccaactcgccccatggctcct

SEQ ID NO: 699040 - DNA, 120 bp, Homo sapiens
gaggacgcatgccaagacgaagagaaccagaaacgatgccaggacctcggcgccttcaccgagagcatgttgtcttcggtgcccctaacataccacaccctaactgcccactcaaagcgt

SEQ ID NO: 699041 - DNA, 697 bp, Homo sapiens
  misc_feature (7)..(7): n is a, c, g, or t
  misc_feature (69)..(69): n is a, c, g, or t
  misc_feature (88)..(88): n is a, c, g, or t
  misc_feature (131)..(131): n is a, c, g, or t
  misc_feature (145)..(145): n is a, c, g, or t
  misc_feature (160)..(160): n is a, c, g, or t
  misc_feature (188)..(189): n is a, c, g, or t
  misc_feature (231)..(231): n is a, c, g, or t
  misc_feature (256)..(256): n is a, c, g, or t
  misc_feature (277)..(277): n is a, c, g, or t
  misc_feature (332)..(332): n is a, c, g, or t
  misc_feature (336)..(336): n is a, c, g, or t
  misc_feature (352)..(355): n is a, c, g, or t
  misc_feature (363)..(363): n is a, c, g, or t
  misc_feature (377)..(377): n is a, c, g, or t
  misc_feature (383)..(383): n is a, c, g, or t
  misc_feature (395)..(395): n is a, c, g, or t
  misc_feature (399)..(399): n is a, c, g, or t
  misc_feature (419)..(419): n is a, c, g, or t
  misc_feature (429)..(429): n is a, c, g, or t
  misc_feature (440)..(440): n is a, c, g, or t
  misc_feature (443)..(443): n is a, c, g, or t
  misc_feature (556)..(556): n is a, c, g, or t
  misc_feature (558)..(558): n is a, c, g, or t
  misc_feature (572)..(572): n is a, c, g, or t
  misc_feature (578)..(579): n is a, c, g, or t
  misc_feature (583)..(583): n is a, c, g, or t
  misc_feature (589)..(589): n is a, c, g, or t
  misc_feature (591)..(591): n is a, c, g, or t
  misc_feature (603)..(603): n is a, c, g, or t
gggacantgtcccagctgccacctagactcggagctccatccaaacctccagcgaagacatcccaggtngggtgaatcttccagcccngggggtggaggtagtaaaggccatggccatgcagaaaatcttngcccgggaaatctnggactccagggcaancccacggtggaggtggacctgcacacgnncaagggccgattccgagcagctgtgcccagtggggctcccangggtatctatgaggctctggaactnagagacggagacaaaggccgntacctggggaaaggagtcctgaaggctgtggagaacatcaacagtactctgggcnctgntctgctgcaaaagaannnnaagcgtgnggatcaggaaaaangttganaaatttatgatngagntagatgggaccgagaataangtccaagttnggggccaatgncancctgggcgtgtccctgggacgtgtgtaaggcggggagcagttgccaaagggggtccccctgtaccggccacatcgcagattctcgctgggaacccttgaacctcatactcccnanggccagccttccantgtganncacngggggncnccatgctggaancaagcaggaccaggcaggaagtgcaatgagtctggcatgctgggagcccgccccgtacagggagggccatgcgcctcggagccgaaggctgaca

SEQ ID NO: 699042 - DNA, 1462 bp, Homo sapiens
  misc_feature (323)..(323): n is a, c, g, or t
tctcttttacctttttaaatggggtctcttcaaaacttcgtggtgacaaattttgtgggctcaagttgtgttctccattataaaaagatccgtgatttcttaaacaacttaattaactttaaaacgtgccacacgcaaaacagaaacccaaaggtggctccacaaaacaatttcctccttattccttctcgtaagaggcgtttcaccgaagtgctatgtgctctcactccatgtacacgcgagctcttattctacttcacttacacactataagagtgcgccccaagtgtaacacacaagacgagctctcgtggagacacccngcttcttctccccaccccgtgtcttataaacagagtgtggcgcgcgtgcgcgacggctattccacgcgcgctctaccctatctctccatttttatacccctctctcgtggagcccactcccgtggggcccagccaccctgtgcgcgcgcccccttgcgccccgaccctctctcgaccccagcccctttctcgtgtgtctccccaccgtgccatatgtcggagtgacacaaccccccagcgccgacaacacgtgactccgcgaccctccaatctatcccccgccacacgagccaaaaaggccgacaacccaaaagagcgggtgggcaccagcctcctgaacacagaccctcttccaaaccaccacatgtgggcgtctttgcccgagggaaaaccgccactatcgtcaccccccttggggcccgtgcctctcacccgcgcatctcctccccgcacctttcacgggcgcccccttcttctcccccggccctcttctaccccccgagaccggggggcgcactccaccttctttctcccccttctcagccctccggcccacaacggggccccacccatcgcgcgggacacaataaacctcccgtggcctcccccacgtactaaggacagcccagggaaacagccccaagcggggcgccgctgacccacacacaagcaggggggggccatgggacccccccggaagtagtcccaacaaggcacccggagccatgtcaacaacacgcaccgaccccctccacaaccacgagcccaaactgcaaactcacagcaaccccaccgaaagcgcggccgggcccttcaacccccccccactcaccgttgaccccaattatgagacacccccgccgcccgcgctcctcacaacaccctcgcccgcacaccagcactctcggccgccccccgcgccacaccgccgaggtcgtccgccaccccgcaccaacccacctcccgacgggcacacagcaccccccgcgcgccccaccccgcccacccacggcgccgaaccacccgcccggcgcacaaaagacacaaacaacagaacaagacacaggtcacatacaggcaccacaaaaacacacacgcggagaaacacctaaacaaccacaaccacacagcacatgcaa

SEQ ID NO: 699043 - DNA, 224 bp, Homo sapiens
gttcgtaagggctgaggatttttggtccgaacgcttcctgcttcctgacttaacgtgttcgctctcgccagaggaacaagtcggtcaggaagcccgcgcgcaacaacatggcttttaaggataccggaaaaacacccgtggagccggagtggacaattaaccgaattcgaataccctaagaagggaacgtaaaatcttggaaaggtgtgtgctgattgataaga

SEQ ID NO: 699044 - DNA, 860 bp, Homo sapiens
  misc_feature (201)..(201): n is a, c, g, or t
  misc_feature (384)..(384): n is a, c, g, or t
tgcgaacattgtgctgcgactggtgcggagcgtgcgggccctgttctgacacccgtgctcgcggtcccgttatcccgccgcggccctgcccgaccgatggccctggcatctggggcgtgggcgccgtccgtagctctgtcgacgactggatccggctcgtggctcttcggttgcgtacactttcgcagagaagacgctagntgtgtaatcaacggtaaattgcgcgttggagacagtgcgcgagaatcaagctaattcttgcgacaggtaagcgttgggtagattgtatgctatctattgctagatctccctgaacgttgggtacaaaattgatagcaaacatagagtgagcgttggatgcgtatctggatagctgtgaaagcntgctaagtagaacgctctatttcttccttttagttcagggagggatagtacagcttgaacacttacattggagaaagctgcgttgactgggacacatagttccatgtgagctctgggtagacgcgaatagttcttagtatactcgagacgactgcgtgttggtctgaatgccaagacttgatcgtcttgaggtaagccttgcagaacctagagtgaacttactgacgtgaagaatcttatgacgagaatactcatatattctacttgatggatgtgagaaaatggaatctctctatgataaacctatgtaatgagttatacgccaaggccatgcagaagtttgtctgtacacttacgtggtggattagaacgacttgagactttgagactttaagtagtaccgatggtggcccaaatgatcactgttaccatcttggtactgatgagagttgccttaactttctatgatttgatta

SEQ ID NO: 699045 - DNA, 377 bp, Homo sapiens
  misc_feature (48)..(48): n is a, c, g, or t
  misc_feature (84)..(84): n is a, c, g, or t
  misc_feature (134)..(134): n is a, c, g, or t
  misc_feature (240)..(240): n is a, c, g, or t
tatatatgcataacttacatatccaaaatgtatatattttgaggtatnaaaagtacgtgctcaaggtattggtcactcctcaanttgttttccttgaaacaaaatgaaggtataaatatttcagccgggcgcgngtgtcacgcctgtaatcccagcactttgagaggccgaggcgggtggatcatgaggtcaggagatcgagaccatcctggctaacaaggtgaaaccccgtctctactnaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagt

SEQ ID NO: 699046 - DNA, 303 bp, Homo sapiens
  misc_feature (32)..(32): n is a, c, g, or t
  misc_feature (48)..(48): n is a, c, g, or t
  misc_feature (177)..(177): n is a, c, g, or t
  misc_feature (183)..(183): n is a, c, g, or t
  misc_feature (218)..(218): n is a, c, g, or t
  misc_feature (285)..(285): n is a, c, g, or t
tcccccccaatgtcctgccttgatgaaaaatnccccacaatcgccccnggggtcctaccttttcctgcagtccttgtgtagatttgggctgcccacccccaaaaccccaaagggatgtctgcccatggagtacacccacccacgccccggtactgagaagtattttcagtgattcgncccagnccagatttcaacacatggttcccatacaggaaggnctctctgccccaggctttatccaaactttatacttggcataaggtgcaaggtaatccagagctatgngcttcaataccctgtctc

SEQ ID NO: 699047 - DNA, 110 bp, Homo sapiens
ccccccgggggttttttgcctgggggaaggggattttgatggaaaattttagccctggttgctttttgttccccgcccctggccctaaaagcctttttgttggatgggga

SEQ ID NO: 699048 - DNA, 369 bp, Homo sapiens
  misc_feature (26)..(26): n is a, c, g, or t
  misc_feature (28)..(28): n is a, c, g, or t
  misc_feature (32)..(32): n is a, c, g, or t
  misc_feature (74)..(74): n is a, c, g, or t
  misc_feature (107)..(107): n is a, c, g, or t
  misc_feature (153)..(153): n is a, c, g, or t
  misc_feature (202)..(202): n is a, c, g, or t
  misc_feature (255)..(255): n is a, c, g, or t
  misc_feature (315)..(315): n is a, c, g, or t
  misc_feature (320)..(320): n is a, c, g, or t
  misc_feature (349)..(349): n is a, c, g, or t
  misc_feature (363)..(363): n is a, c, g, or t
taagacctccccacccccgctggggncngtgnggtgctccagtccggaaatgaaggaatagcccgaggaccggntggggtttatttaaactgttctgtgtgggtctngggagggagagcaccttaatattattggggttggttggggtggggnaggatctcagccataaagtgccagtttgcgttagttctcactgtctccntggtctgtgcatgcccgtgctctggggatgcacggcggcagggtgggggaggnaggttcctcgcaggtctcagcccgggacagggtcttgcaagcagcctcctgggcaagtcngtaanggttgcggcgtgatgtcttcaataaattnaggttttatttggnaaaaaa

SEQ ID NO: 699049 - DNA, 110 bp, Homo sapiens
tagcggagtgtgcagctactcggagctgaggcaggagatgcttacccggagcgagtgtagtgagcgaatcacgcactgactcagctggcacagatgaactctgtctcaaa

SEQ ID NO: 699050 - DNA, 391 bp, Homo sapiens
tccaattttttaaaaaggaaaatttaaatactggggcttactggggaaatatttcagtgggtgacccgggcgtggggggtccccctgttccccagcatcttgggaaggccaaggcgggtggatccacccgaggccaggatgttcaaaaccagcctgggccaactatgggtgaaacgcctggttatcttattaaaagacaaaaaattagctggggctgtgggtgggtactattcgcctgtataccccagctaacactgggaggctgagagtcaggagaaatcacttgaactgtgggaggcagagtgttcgcatgtgagatgtgggaataacgcagcaccaattggccctcccaagcctaggtggacaagatatggagaacttcttatttccc

SEQ ID NO: 699051 - DNA, 701 bp, Homo sapiens
  misc_feature (231)..(231): n is a, c, g, or t
  misc_feature (253)..(253): n is a, c, g, or t
  misc_feature (313)..(313): n is a, c, g, or t
  misc_feature (375)..(375): n is a, c, g, or t
  misc_feature (395)..(395): n is a, c, g, or t
  misc_feature (420)..(420): n is a, c, g, or t
  misc_feature (438)..(438): n is a, c, g, or t
  misc_feature (440)..(440): n is a, c, g, or t
  misc_feature (469)..(469): n is a, c, g, or t
  misc_feature (522)..(522): n is a, c, g, or t
  misc_feature (524)..(524): n is a, c, g, or t
  misc_feature (538)..(538): n is a, c, g, or t
ccacgcgtcgccgggccgaggcgatggctgccctgggcgctcctcagccctggggtcctggtgcggaccgggcacaccgtgctgacctggggaatcacgctggtgctcttcctgcacgataccgagctgcggatggaggagcaggggagctgctctgccctcacttctgtctggtgctgggtcctgctgtctactcgctgtgtactcatggaccctggtagtgaatgtgcnccccagctcaggaggagctcanagagacagacagcatggttctccagcatccctcttcgggctgaatactgctggtgctgcngcctgaggtcggactgcgtgagtgcgcgttgcgtcgccgtacgacacactgccctggatggngaactgtgtgggagagcgcnacaccactcttgtggtctacctggngctgcagctggtggtgcntntgtggggcctgtacctggcatggtcaggnctccggttcttccagccctggggtctgtggttgcggtccagcgggctcctgtncncaccttcctgctgntgtccctctctcgttggggccagctgctcctcgtctcgcacctgacctggtggccagaaaccaccacctgggaattcactcttaaacggatggctaattcggcagggccgacccttgacgggctgacgaactgccacttctgggtgcccggccgggaccttgc

SEQ ID NO: 699052 - DNA, 317 bp, Homo sapiens
  misc_feature (144)..(144): n is a, c, g, or t
aaaaaaaccccttttttacccaaagcccccgggtgttaattagccccggggtttttttaaaaccggaaaaaaaaacttttggtgggggggggggtgggaggaagggatgggccccccctttttggggacccctttcaccccccnggggggtttttttttcccccccccttccccaggggaaaaaaatttcccttttgggaaaaaaccaaagcccaatttttcccttttttttttgggttttttttgggtttttaggatgggcctttttttttttaaattttttatatttttaattaaaaaaaacccttttttttgga

SEQ ID NO: 699053 - DNA, 269 bp, Homo sapiens
tagaggataccgtgatgttatacccaacactcgggaggctgaggcacaataatctcttgaacctaggaggtggaggttgcagtgagctgagattgtgccattgctctccagcctggtgacagagggagactctgtctcaaaaaaaaaaaaaaaggaaaggaaagaaaaagaagaaaaaaatattctccacggcaaccttggggaggcagattactatcactcctcatttagggacgactgaggaagtgggagtgcttcagagaggggca

SEQ ID NO: 699054 - DNA, 341 bp, Homo sapiens
ccccaaattttttggggggaaaaaaaaccccccggggtggggtagaacccgggggtgttttttttgtttttcccccccccaaaaagggatttacccctggggggaaagcccttgggggtttttttaattccgggggttttttttccccccccccccccggttaaaaccggggaacccggaaattttttgggggggtttttttttttttaaaaagggacttttccccgggggggggaaaaagtttttagggtttccgggggcccaaaaaaaggggccccgggcccctttacccccccttttgtttttttttttgggccctaaaagccccttttttttgggga

SEQ ID NO: 699055 - DNA, 278 bp, Homo sapiens
  misc_feature (54)..(54): n is a, c, g, or t
  misc_feature (77)..(77): n is a, c, g, or t
  misc_feature (101)..(101): n is a, c, g, or t
aagaacctcaggtgttacatcttggcgagccagacaggagactccagaaaaggntcaaagccatcaagctacaaatnatcttacaaatggaacctcaaatnagctcagctcacggcttctaccgaggacccctggttcaacccgctggtccctcaattaccctagaaaattcccctctggaggacaccaaactgcagggccccttcttcacccctaaccagcaggaagtagccagaacggacttgccacacggttcccaacagcagttgggggtgtcc

SEQ ID NO: 699056 - DNA, 1028 bp, Homo sapiens
  misc_feature (695)..(695): n is a, c, g, or t
  misc_feature (706)..(707): n is a, c, g, or t
  misc_feature (713)..(713): n is a, c, g, or t
  misc_feature (715)..(717): n is a, c, g, or t
  misc_feature (738)..(739): n is a, c, g, or t
  misc_feature (742)..(742): n is a, c, g, or t
  misc_feature (756)..(756): n is a, c, g, or t
  misc_feature (761)..(761): n is a, c, g, or t
  misc_feature (764)..(766): n is a, c, g, or t
  misc_feature (768)..(768): n is a, c, g, or t
  misc_feature (774)..(774): n is a, c, g, or t
  misc_feature (783)..(783): n is a, c, g, or t
  misc_feature (785)..(785): n is a, c, g, or t
  misc_feature (790)..(790): n is a, c, g, or t
  misc_feature (806)..(806): n is a, c, g, or t
  misc_feature (809)..(809): n is a, c, g, or t
  misc_feature (812)..(812): n is a, c, g, or t
aagggctgctcagaccaaggagagaggagcctaaggtcagcggaggacttggaggaggtagcgggcctggctgagtctctttctaaaagccgggatggggcagcagctgagctgggaagaggcggaggcggccggggagatggatgtggcggagttgcaggagtggtacaagaagtttgtcgtggagtgtcccagtgggacgctcttcatgcacgagttcaagcgcttcttcaaggtcacgggcaatgaggaggccagccagtatgtagagagcatgttccgagccttcgacaagaatggggacaacaccattgacttcctggagtatgtggcagccctgaacctcgtgctgaggggcagcctggaacacaagctcaagtggaccttcaagatctatgacaaggaccgaaatggctgcatcgaccgcctggaactcctggacattgtggaggcgatttacaagctgaagaaagcctgccgagcggagctggatctggaacaccagggccagctgctcacgcccgaggaggtggtggacaggatcttcctcctggtggacgagaatggagacggccagctgtctctgaccgagttcatcgagggcgcccgtcgcgataagtgggtaatgaagatgctacaaatggatatcaaccaggctgctggatcacgcagcagaaggcggagaagcgccatgntctgagagccnnggaccntnnnggcccaaatccctcaagatcnnccnggtcccgggttctngcggnggnnngntggtgnacctgtccngnggggnggacccgaagggccancanggngcgaactccacggggtcaaaactctttaagaaacctactggtgggcccaagtactggccagtggcctgggaagggacaaggaagggggcacacaaataggagccaaaaggccgagcgaggtccacgtgaaagacgtaaagcaggggtagcaacccccactcacacggaggagacaacgacgacaagagcgcaaccacggaggggtggcccgacaaa

SEQ ID NO: 699057 - DNA, 141 bp, Homo sapiens
agtgctcatagatacctctacagacagaatcatcctataacaggatcacaaccttatccctctgtactatcactgtaccccctaaatttcctaccctctgaacctgacctcttgcctacctgccacggtgcgttggaccaa

SEQ ID NO: 699058 - DNA, 411 bp, Homo sapiens
atagcctctagcttgcattggcacttctagctcagaagattcttcatccagtaatgagcgggtcacacgaatgagcgttaagcttctctgctacaggtgcagggttatgccctcacatatctgccttctcccttgcggccaagtgagatccgatgtgctcaaaggtgtgagtccgcattcttagacttccaaccatgtgtacttgtccagaacagcctgaatgtggctccggtagtcaggttgctccacagtcaggttcttgaccgctgtcttcggcatcatatgctgtgcatcgttcaggtgcggggcaatgttctcgcacacccgtttcctctgttcctcatagagcgcgttcacataatatgcgcgcacgtgagcaacgttctcctccttgacagtgttaaatctccg

SEQ ID NO: 699059 - DNA, 108 bp, Homo sapiens
gcaggtcaaaagacccttatacttttatgatgccactatgcttctgccagatgctttggagcagggtgcttctgggctggagctttttgacccttctgtcgtcttctc

SEQ ID NO: 699060 - DNA, 604 bp, Homo sapiens
ccagtatagtcctcatatagaaaagatctacataggtatgtacaatgagcttataatcggttaaatatttgatatgatgcaaggttgatttttaatcaaacttctatttctcagtggaaaatgctctcttcatcagaggtggtagagtttcccctacatcaaacatcatgaccaagaggtgggtctatggagagaacaccaatcaggtatacggcccgtctgattataatattcctttgaaacagaacggctcccaagtatatctggtaatgctccaaaaatagcccctcccaaccaggccacacaattagactttggcaggtggagtatgacttcgaaatgtcttagtgccaagtgcttatttatatttgggtttatctaccaaataccttattcctgcaagcaatctgtggagaactcctggcaacatagaagtgccacctatgactaccaaattctctgctagttgcttcctggtgtctatcggacactgtataagggaatccaatattacagtggcaactgattgctctgcatcatacttgtcaaaaagactttccacaagtgaatctctgattgatccaaggctctgtaaatctctctc

SEQ ID NO: 699061 - DNA, 247 bp, Homo sapiens
ttagacatggaatcaacacctaagtgttcatcaatagatgaatggatttttaaaatgtggcacatatacacaatggaatactattcagccataaaaagaaatgaaaaccctgtcatttgtgacaacatggatgaaacttatagacaatgttaagtgaattaagccaagcacagaaggacaaatactgcatgatctcactccctacctggaaatttttaaaaaattgatttttagaaggagaatagta

SEQ ID NO: 699062 - DNA, 103 bp, Homo sapiens
tccaccttactaccagacaacctatagccgaagccatttacccagataaagtataggcgatagaaatagaaacctggcgcacatagatactagtaccgcaagg

SEQ ID NO: 699063 - DNA, 479 bp, Homo sapiens
gaagacttctatagagtccctttctatagaacttaattacattagtcaggagacacccagaaagaaagagcccatacgtttcaatcttaggcataataagcttgatagatcttcagaaaaatcccttttaccacagaactcccccactggaaaggattctgatagaattgatgtcagccctcacaaatgacgttgactgcctgctggatttctgttgactggtccggagtctgtactgcaagacccttgtgagcttccctagtctaagagtaggatgtctgctgaagtcatccatcaggttgaagaagcacctcatacagatgagaaggagatgctgctctttttgtgccgggatgttgctatagatgtggttccaccttgtgtcggcgaccttttggatacttttacgggaaagaagtaagctgtctgtcggggacttggttgaactggtctaccgagtgaggcgatttgaactgctc

SEQ ID NO: 699064 - DNA, 113 bp, Homo sapiens
aaaaaagtatcagctagggatgactctggaggatgagtatcatggttgggaggaaggattttttttaaatgtaaatgacccccatttaccagcccaatcaaagtcccttaagg

SEQ ID NO: 699065 - DNA, 867 bp, Homo sapiens
gatatctgtgcccacatgctcacagcagcattagtcacaatagccaaaaggaagaagcaactcaagtgtccatcagtgaatgagtagataagcaaaatatggtatatacaatagaatattattcagccttaaaaaggaaggaaaagctaacacaatgctatggtatggatgaaccttgaggacatgaggctaaatgaaatcagataatcacaaaaagacaaataccgtatgattccgtttataaatgaggtggacagagtagtcaaattcatacagactgtattaagccattcttgcattgctatgaagcagtacctgagactgggtaatttataaagagaataagtttaattggctcacagttctgcaggccggacacgaagcgtggggctgcatctgctcggcttctagggaggcctcaggaagcttccgatcgtgacagaaggcaagtggggagcaggcatggcacatggcgaaggctggagcaagtgagagaaagagtggcgggggaggagccacacacttttaaacaatcagatctcatgtgaactcagagcaagagcccactcatcaccaaaaggatgacccacgccattcataaaagatccacccccatgatcttatcactcctaccaggccccacctgcagcatttggggattacaattcaaccgtgagatttgggcaggaataaatattcaagctatatcagagaccgcaaaaaagaaatggtggctttccagggctgggaagaagggaaatgggaagtccgtgtttatttagggaccaagttccggtttggcagattgaaagagtctcaagatgctggggggatggtggtcacccgtgtatgttttactgggaaatt

SEQ ID NO: 699066 - DNA, 724 bp, Homo sapiens
  misc_feature (14)..(14): n is a, c, g, or t
  misc_feature (276)..(276): n is a, c, g, or t
  misc_feature (339)..(339): n is a, c, g, or t
  misc_feature (350)..(350): n is a, c, g, or t
  misc_feature (384)..(384): n is a, c, g, or t
  misc_feature (435)..(435): n is a, c, g, or t
  misc_feature (446)..(446): n is a, c, g, or t
  misc_feature (480)..(480): n is a, c, g, or t
  misc_feature (483)..(483): n is a, c, g, or t
  misc_feature (675)..(675): n is a, c, g, or t
  misc_feature (716)..(716): n is a, c, g, or t
aaccacaaagatgncttacttctatcaaatgatataagaagtgaatatgaactcttatagtgacaaaatgtttcattgcatatataacaaaattatacacaataatcctgtcaattataatgttactaaatcttgtgcccccaaattactaagcaggagtatgtaaaattgagaagtctaacgtatgacacgcttaactgatctctaacaagcgtttggagtgcaagaacattgaagagttcaaatctgaccaagatgttgatgttgcgataaganaattctctgctccccacctctaagttgccagccctcctagagctacctgtggagcaacctgcncagatacatcnaacatggagacagcactcgaagtagaattataangaagatcatcgtccatgttcaacattattataaccctacattttgtgcatntagtgtaagtntataagcatatcaatattaaaaagcaagccagcngantttggaattcatccaatccaaatgcggcatcgttcaataccatccatgatgctgcttacatgtctcgatcccacttaactatcttgggctgtgacaaagtcacatggttcacacggcagcgtatactcatctcttttcagtgggggtgaattcagtgtagtacaaaagatagaaagaccagtccttgctganagacaagtctgaatgctccactttttcaattctctctccantcttcagt

SEQ ID NO: 699067 - DNA, 657 bp, Homo sapiens
  misc_feature (397)..(398): n is a, c, g, or t
  misc_feature (403)..(403): n is a, c, g, or t
  misc_feature (406)..(406): n is a, c, g, or t
  misc_feature (410)..(410): n is a, c, g, or t
  misc_feature (416)..(416): n is a, c, g, or t
  misc_feature (428)..(428): n is a, c, g, or t
  misc_feature (438)..(438): n is a, c, g, or t
  misc_feature (446)..(446): n is a, c, g, or t
  misc_feature (465)..(465): n is a, c, g, or t
  misc_feature (474)..(474): n is a, c, g, or t
  misc_feature (493)..(493): n is a, c, g, or t
  misc_feature (507)..(507): n is a, c, g, or t
  misc_feature (519)..(519): n is a, c, g, or t
  misc_feature (568)..(568): n is a, c, g, or t
agaagggtgatggaggtggcgccagcggcgtgcggcggcgtgtggtggtggcagctggtggcggtggcagtggtggtggcggtgtgcgtgtgtgcatgcatgccggccaccagccccccaagagaacacaacttctgaggcatgtgcctgccccagggggaatgcactggaccctgagacgactggcgatgatggaatgtggctcctgacacacatgctgaggaatgagctggaacacatgccatgtgacacatgacgctggatgatgtgggccttgcagtaagcagcctgacaggagcaattggccaccatgcatgtgtgaatgtggcatctgctgccccagtgcctcaatgcctgggcacccaaccctggatgccaccccccagctgggtacaanngaaanctngcancaggcngcctcctccccnaacgcatccnagccagtnccatgtcctctgcaggtgnagttactgncctactccttccccatganccctccctgtctgnactgcccaggcnagagggtagagcacaggggtttccccatactacctcccctccccagganactcccaggcttgggttttttctataggtttggcggggggccacagggaggggaccctgacaataaagagattggatcccaacctgttc

SEQ ID NO: 699068 - DNA, 289 bp, Homo sapiens
tcaatcatcttgtctagtgcatattttttttatttttacacccaagtgccttatccccaagatcaatgtcctctcagcagatggccaagttttcttgtgtagttaaaaaagattctcccagaatgggcatttagacagtgccaggggaaccttcaaataatatttttccattcacaagaggagataagcaaccatatgagggagaggtcacacgtgtattcccctctcatcccagaaataggccttggccccattaaatgtgtggtggaatgccgcagaacaggacaca

SEQ ID NO: 699069 - DNA, 189 bp, Homo sapiens
ccgggcccctgtgcgtgcacaggtctctgttcctacccgcgaaactcaagaatcattcaggaccatctctcttctctctccacattcttctccctgggtaagcttctgcctcatccacagccgcagattatcatctgtctatcgacaacttctcatcttcatctctagcccagacctgagcaagccagg

SEQ ID NO: 699070 - DNA, 267 bp, Homo sapiens
agtcaggtattatcagatcaccctccaggacctctacggcggcccgcagctcacggcagcgtcatggtccaccagtggcagcagatcatccacgacaaccaccctctgtcctggctccagggcgtctttctggatccccagctcagccttcccgtactccagggaataggagcccactgagtgcgggctggcagcttcccccgctttcggattagcacgcagcccagtccaagctcctgggccaggtaggggccaaagaggaagcct

SEQ ID NO: 699071 - DNA, 1497 bp, Homo sapiens
  misc_feature (626)..(626): n is a, c, g, or t
  misc_feature (629)..(629): n is a, c, g, or t
  misc_feature (636)..(636): n is a, c, g, or t
  misc_feature (648)..(648): n is a, c, g, or t
  misc_feature (678)..(678): n is a, c, g, or t
  misc_feature (689)..(690): n is a, c, g, or t
  misc_feature (714)..(714): n is a, c, g, or t
cggccacgtggggagtaggcccggtgggggtgcgcgccgccgcggtccgtccctcctcatagggagagtgcatggggttgtgcggtcctagccgggtcggccccgttggcgccggcggtggcattcccgggaaaggggattacactgaggcgctggggccgccggggtttttcgtgctccggaactcgcctaggtaggccctccgctccgggtgggggacgtccaagggaccgagttggtccccagccactcttgaggggcaaggagcctcgaaaaaggtttgggttggtggtagacctggcttggacgaagaccggccagagggggactgtgaagcgaggagaagacgtgagggaaggtaccagccagaaccaagttggggtcccttcgccgagccggggttaaaaagaacctcctgacccacccccgccccacctacccctgagcgagccccacagggggtgaaatggggccgggaaacatgggcacagccttgcgcccggtgagacgtgtccctggcgaatccccgagtgataagcagccccctgcgccactcctgggccttcccctactccgccaagcaaggtccctcctcagccagttagttatgggattctcccccctgnccnccagganatctttgttgtnaaaaatatgttgtttcccatcaaggtcatnttctgtttttnntttttttttttaattctttttttnttccttctttcctctttttttcctctctctcctcctaatacacactttttttagtaaggggaataccatgatgtcgctctagcccggcccctgtagacgcgaccccggggcctgctgttaaaaccactgtagaatcgagagcgggagctgttgtagttggtggtcggcgcgtacggctcgtggaaacccggtcgtgttgtcgtgttgtcgatcctggtctgttggttcgtttgggatcaccttgatttgcccttcctctaaatagggactcatctaaggccaaggaagtgcctcactgactctttgtctgagaactctatatacgcaaacctttggatggccactaaatttgtcacacagtatggtaacacggttgactgaaccacagccatgaaagtgagcttcagctctctgctgttgcaccatagtcacttgccaacatagatggaaccggcatcagctcatcttctcctcaatgacatgatcgcgggccagcattgcctggaggtgactatattcatctgcttctctacctcgttctgtagctcctttagcttctcagcttcttcctccatctccctgacgcttgatagctcagctagcggtcctcaatggcgcgtcccggtcacctcgaccagtccggctcctcctcctcctcttggctgccggggctcccgaaccagcccagggcccggagctccgggggggcgcggggccggggcggctcctcttcgggctcgggctccggctcgggctccagcagcacgtcctcaggctcccccc

SEQ ID NO: 699072 - DNA, 624 bp, Homo sapiens
aaagactaactagaattccaaaaaaaaaaaaaaataaaaaaaaaaaaggggcaatataaaaaaaaaaaaaaaaaaaaaaaaaaaaaataaaaaaaaaaaaaacaaaaataaaacaaaaacaaaaaaaaataaaaaaaactaaaaaaataaaaaaaacaaaacaaaaaaaaaaaaaaaataacactcctccccccctatcccccttcccttttaaacctccccattttttacccctcccccccattttcccttctttttccaattttcccttttacgcttccttttaacattcaccttccccttttttaacaccctttacctttcaaaacccctgccttacccaatttaaatccctttctaaaaattcccttttttccaatcttcgctataaccataaaccccctctcccctctcccctttcatattccccaccctaatttccaattgaacatttttaaccttttatttttttataaatctccctttaaatttttcttcaataatatatcccccaactgcctttcatctttctctcatttttaaacataatcccctttttacacactctttctccaccctcaaatccctcacctccttttacggactctcccctttcctcctccg

SEQ ID NO: 699073 - DNA, 366 bp, Homo sapiens
  misc_feature (295)..(295): n is a, c, g, or t
ggtccccaatggggttcctttaggaaggacacaccagaaattgggcattgccccttcacccaaaatgggtttcggcaaggtaaaaatccccaaacctttttttggtggtttcttcaagaagaagaagctgggggagccccccccccaggaaggggggttttttgccccagaaaaagagaaatttgggttttcggggcggggcaagtttgttcaaaaagctgggggctcccaaattttcccaaaaatcaaaggttttcctcgggtccaggggtccctgggatttgggtttgttttnacgaagggaatttatcctcccaaatgggggttttaaatgttttaaggccctaattaaataggtggctccca

SEQ ID NO: 699074 - DNA, 1368 bp, Homo sapiens
  misc_feature (497)..(497): n is a, c, g, or t
  misc_feature (500)..(500): n is a, c, g, or t
  misc_feature (507)..(507): n is a, c, g, or t
  misc_feature (519)..(519): n is a, c, g, or t
  misc_feature (549)..(549): n is a, c, g, or t
  misc_feature (560)..(561): n is a, c, g, or t
  misc_feature (585)..(585): n is a, c, g, or t
gatcttctgtcatcccccatggctgaaaacaggctttacgcccggtaaggcttgcccactctgtcactggctgctcacatgccgctctggacatgatctgtctggccacaggaagattgaaagacattcgatccccaggagctgaagtattctctatgacaactgataactttttccctgacattaaccggattttgtcctcaaaagcgccccagtcattttaagttactcagaggatttccattcctctatccacttgagcccatttaggagattccacccatccgaccagaattgatgactgctccttgagcctgaggtacatagccaatcccgatggcccatatccattttctggtccatccgacactaaggtctgccccggtgctgctgcagtgccatacaatcctcccgctggcacatactcacatattctttgtttgtctgtagaaagtgtgcccaggaccatgttcatagacaagtgttctcccccctgnccnccagganatctttgttgtnaaaaatatgttgtttcccatcaaggtcatnttctgtttttnntttttttttttaattctttttttnttccttctttcctctttttttcctctctctcctcctaatacacactttttttagtaaggggaataccatgatgtcgctctagcccggcccctgtagacgcgaccccggggcctgctgttaaaaccactgtagaatcgagagcgggagctgttgtagttggtggtcggcgcgtacggctcgtggaaacccggtcgtgttgtcgtgttgtcgatcctggtctgttggttcgtttgggatcaccttgatttgcccttcctctaaatagggactcatctaaggccaaggaagtgcctcactgactctttgtctgagaactctatatacgcaaacctttggatggccactaaatttgtcacacagtatggtaacacggttgactgaaccacagccatgaaagtgagcttcagctctctgctgttgcaccatagtcacttgccaacatagatggaaccggcatcagctcatcttctcctcaatgacatgatcgcgggccagcattgcctggaggtgactatattcatctgcttctctacctcgttctgtagctcctttagcttctcagcttcttcctccatctccctgacgcttgatagctcagctagcggtcctcaatggcgcgtcccggtcacctcgaccagtccggctcctcctcctcctcttggctgccggggctcccgaaccagcccagggcccggagctccgggggggcgcggggccggggcggctcctcttcgggctcgggctccggctcgggctccagcagcacgtcctcaggctcccccc

SEQ ID NO: 699075 - DNA, 931 bp, Homo sapiens
atgccgccaactagatactaccgtatggcccatcataattagccgcatactcgttacactatggcgctcagtcaccgcaagctaaaaatatgaaatgacaaacgtaccagctactgtcaccatcatacaaagcccattaacgagaataaagaagaatgaaaaaaattgaatggtctggggtgcagaacattggcgcgcacgaggaaatgtatttagagacccaaattggtgaggggtgggagggagcaaggaggaattcttcggaggatagtggaggaaccaaaggagggtggtcgtgatggaaaggcggggagatatgacaggggggggtggttttaataggatttataatgacgcccggcggtgcgcacatacagagggggcgtttgcgagacactgctcaggaatcgtgtccccataggaaagacggaacgcggggacctcttaaaccaagaggctactggccataagaaagtgcacgaacttactaatgtaaagcaccacccctcattgtggaccaaccaaggaaccttaatggccggaagcccccgaggttgctgcccggccctgaccacaggggattggtcacagccaggtacagggcaactttccagttaccccaagaaattgcgtgaggcttttaccattcaaccaaggtgatggcatgttgatatgaaccgaatcttgttgggaacctaccctaccgtggaagacggcagttgaccaaggagattaaggggaaaacggccccacaatgctacggggccggtggacatgttcgcctaacccgaggacaatcgtaacgcccacttctcggaccgtgtttacagagccttccagagaggctcccttgaaacctggtctaatgaatcctaatttcctttcttcaacccttctttaattgtcctcgatcataagacctcagtctcaa

SEQ ID NO: 699076 - DNA, 127 bp, Homo sapiens
  misc_feature (37)..(38): n is a, c, g, or t
atagcaggttgtttggttacttcaagcaaccaaagcnncatggctgccggagacagtgatacaggcagcagcttcatgagatattgcagtttaatccagtcatctacaagcacaatctgcccatcag

SEQ ID NO: 699077 - DNA, 255 bp, Homo sapiens
  misc_feature (73)..(73): n is a, c, g, or t
cccagagacgcttggggggctgagaaaggggataaacttccttgccccacccagggggagtggtgggccaggnctgggggcgagttccctgaccccaaaagggatcccagacacatttctaagtcgtctcagaaaaatggcatctggttgagctcatgcctgtaatcccagcatttggggaggcggaggcaggcggcacatttgcagctcgggagtccaagcacagcctgagcaagatagggagacccccccatc

SEQ ID NO: 699078 - DNA, 244 bp, Homo sapiens
ctttttttttttccccccccccccccccggggggggccctttttttttttaaccccccagaaaaggtttttggcccccccctttttttttggaggtcccccccccgcccccttttttttttcccaaccccccggggtttccccgggtccccaaaggggaattttttccccccctttttttttcccttttttgaaaaaaaaaacccgggggttttttttttttccccccttttttgccctgggga

SEQ ID NO: 699079 - DNA, 987 bp, Homo sapiens
tgtattcgttcccaggtccaaatgggcgcaatctggggagctagtcaatcaagtaagtcctgtccgcgcgggtgtccaggggtacatgcacttgaggccagggaaccttcaggcaatgggattagtgcccgtcggcttctacaattgccctcatggcggacaaacatgaagaagatcatcctctcgaacagccaagctctttcttggaggaccatggttaagaaaccccagagctctggaagacacggacttgagccggctctacacagcacacatccctgatgcagactttgatcgacaatcgctgactgaggaagtttcacggctataacctccctgaagggaatactactgaggaagaaagttgcatggcggtacctgcacagggatttgtatgttcctctcactgctggtgtaatggcagctgacgagtccgttggtgcaatgaaacgtcttcgtaaccatgtccaataatctccgttcagagaaacgagagaacagtcaatgatttgctgcctgcctctgcatgggggccatcattgggcattctatgagggctctgtgcttgttcccctcgagcccctgagcatggatggataagctggtggtggagtactgccaacgcgcatttgccaatgggagcgtaacaagttgcaagtgctcgtgacacggagcaggtggaggccagaccatggagtagaggcctccggactcatggcacgctccagcagccgctcctctggaagctgcgtccgcctcaccgccctgtattcaaggtctcccatctccctcgagtgacctaggatgctgacgtacacaccattcagcagggggcactccaccatgcacaccatgtgctcggagtaggcagcatcttcaatgggagctcacaggctatatgtttgtgcacttagttacaggttttatccattgcagttgttaggcatggtagacaagtgacagagttcttgccctctgtataccccc

SEQ ID NO: 699080 - DNA, 356 bp, Homo sapiens
tggatgctgtcggatgtccaggcctccaggaaccccagcaggcgggtacagtggttcctgcctagtatcccagcactttgggaggccacaggggcgtatcacctgaggtcggaacgttccgagaccagcgtggtcgacacagtgaaaccccatctctactatcaatataaaaattagcctagtgagtggtgtgcgcacgtctgtaatcccaactactcatgacgcctaggcaggagaattgcttgaaccccgggaggcggcagtctcagtgagccaagatcacgccagcacattccagcctgggccacagggtgagactctgtctccgataaaaaaagaaacccaagcagttggga

SEQ ID NO: 699081 - DNA, 204 bp, Homo sapiens
taaatcattgcgtattgactttttattattaattactgttcataatttgtttaaaccaaaagacatttcacacagacaaaattctaatgcatcccatgtaaatgtttacatccattttattccttactcgactgtaagacttatcatttaactttaaatttttttttttttacatctcaaaaatatatgtgcaataattagagc

SEQ ID NO: 699082 - DNA, 710 bp, Homo sapiens
agcccatctacatggaactcaacagcaggcagaattaattatggtgacagaagtcataacggtgggccgggtacactcctgcagtcccagccactcaggaggccgaggcaggaagatcccttgaacccgtgaggtcaaggctgcagtgagctgtgatcgtgccaccgcactccagcctgggcgacagagcacaagcctgcgctgcgacctcataaaagaggtcacttcttaacagtaggtgtaggtgttagctgaaaataaatacaagcaaaactttttgggttttagaaaaatgttccacattttgatttgagtggtagtcatatgggtgaacaatgtgtaaaatgtaccaagtatacagttagatttatgcattttactgcatttctattgaagattatgttcaattttagaaaataaaattctggaagaaaatatgactggaggccaaaagcctttcaaaaatttgatttataaaagtacctaagataggcaacaatgacacaacacacatgtcacagggaatcccagagaaggcttccgaagtcatgtggtactgaattgctatgactgagaaacaaggtctcttgagatataacagaattgacgcatatgctgaatgcgcactctatggacctggggggtaaatcaactcagaatagccgacactgagacacagtataatttccggttttaagatataatacagc

SEQ ID NO: 699083 - DNA, 855 bp, Homo sapiens
ccacgcgtcggcagcagcagcaccaatggcagcggtggcgagtggcagcagtggcccaaaggcaggagcagcagacaagagtgcagtggtggctgccgccgacaccagcctcagatggcagatgacacaccaccccccgagctgtcggaacaatgagcggtatcataccgtgagcccctcaacaagatgcctgctgcctggtcccgccctgcatctcccacatactcattcttatttggcagcagatggtggtagttggcggtggcagcatgacatgggcgcgagagtctcgctgacaaggccacatgcagtgcatgcagaccgctgcctccactgtattggccaatcgggcatgacctggctggacggccatgcgcggtggacaaaagcaaccctacctcaaacgcacaaaagtcgcgtgctgtggccagacctgctgcagcacaggcacagagccgggccacggcagctggcagacgagggacagcctgacgctgcagccagttaggcccacgtcccaccgagattcctgaagcgcgtggtgcagcgagcatagtcccggctgctgaagagaagggagggattgcatggccctgcactgacaatggaagggctgtggcaggtgacagaaggcacctcaatggggccagtccgaattcacccctaacatgggccgctacacacaaataaagcacaaggccgtcttcaattcatgaaccccccgagcaggatggaggtacccgtggccagagagacgcgaccggaaccagggcgcggccctggcctgagataccaccaatgcacagggaacaagaatgcccacaggacaatccagaatcacggcacaaagacagc

SEQ ID NO: 699084 - DNA, 334 bp, Homo sapiens
  misc_feature (9)..(9): n is a, c, g, or t
attcgcggncgcgtcgacctacatatggccagccagttttcccagcaccatttattaaatagggaatcctttccccatttcttgttttagtcaggtttgtcaaagatcagatggttgtagatgtgtggtattatttatgagggctctgtcctgttccattggtctacatctctgttttggtaccagtaccatgttgctttggttactgtagccttgtagtatagtttgaagtcaggtagcgtgatgcctccagcttaggtcgacgcggccgcgaattcaaggaaaaggaggagggcccgcgcaattgggaacgggacctgcaggcagtgccatc

SEQ ID NO: 699085 - DNA, 592 bp, Homo sapiens
gaaaggcgcacgatgcgcgtctgaccgcgactgtggaccaagttgatgacacctcattatgttgtgcgctgtagcaaaccccaggctcccatcacaggtcacatgaatagtctattcgccatcagaatatggtagcagcacagaactcaaccttcctgaaactgcaaagtcggtcacgctcagtaacttgcaacctggtgtccagtataacatcactatctatgctgtggacgaaaatcaggacattacacctgtcgtgattcaacaggaaaccactgtcaccccaggctcagattcagtgccctctcccaggtacctgccgttggcggaagttacagacgtgagggtcaccatcatgtgaacccgcctgagagtgcagtgaccggctaccgtgtggatgtgatccccgtcaacctgcctggcgagcacggatagaggctgcccatcaggaggaacacctttgcagaagtcaccgggctgtcccctggggtcacctattacttcaaagtctatgcagtgagccatgggagggagagcaagcctctgactgctcaacagagaagcaaactggatgccgcactaacctccagtt

SEQ ID NO: 699086 - DNA, 105 bp, Homo sapiens
aatagatataaatatgcattctctttcagctgtatgtcttaaattattcttgaatgtactgtgatgtcaataaagctctttagttcattttttgttaaactcttg

SEQ ID NO: 699087 - DNA, 430 bp, Homo sapiens
  misc_feature (4)..(4): n is a, c, g, or t
  misc_feature (20)..(20): n is a, c, g, or t
  misc_feature (64)..(64): n is a, c, g, or t
  misc_feature (99)..(99): n is a, c, g, or t
  misc_feature (420)..(420): n is a, c, g, or t
  misc_feature (422)..(422): n is a, c, g, or t
  misc_feature (426)..(428): n is a, c, g, or t
tgtnccccagagccaacagnaggcagattcacaccctcactctgcagcacaagagattgaggtnaggccctgcacccccgccccagtgagctgaagggnccctggcatagaaaagctgaattgagaggcctcagtgagttgggcatggtggctcacacctgcaatcccagcactttaggaggctgaggcaggtggatcacttgaggcccaggagttcagggacagccctggttaacatggggaaactctgtttccactaaaaaattcaaaattagctgggcgtggtggcacatgcctgtaatcccaactactcaggaggctgaggcaggagaatcgcttgaacccaggaggtggaggttgcggtgagtcgagatcgcaccactgcacttcagcctgggtgagagtggactctgtctcatnancttnnntt

SEQ ID NO: 699088 - DNA, 267 bp, Homo sapiens
  misc_feature (1)..(1): n is a, c, g, or t
  misc_feature (20)..(20): n is a, c, g, or t
  misc_feature (27)..(27): n is a, c, g, or t
  misc_feature (33)..(33): n is a, c, g, or t
  misc_feature (50)..(50): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (80)..(80): n is a, c, g, or t
  misc_feature (105)..(105): n is a, c, g, or t
  misc_feature (119)..(120): n is a, c, g, or t
  misc_feature (123)..(123): n is a, c, g, or t
  misc_feature (128)..(128): n is a, c, g, or t
  misc_feature (137)..(137): n is a, c, g, or t
  misc_feature (142)..(142): n is a, c, g, or t
  misc_feature (151)..(151): n is a, c, g, or t
  misc_feature (154)..(154): n is a, c, g, or t
  misc_feature (160)..(160): n is a, c, g, or t
  misc_feature (184)..(184): n is a, c, g, or t
  misc_feature (200)..(200): n is a, c, g, or t
  misc_feature (211)..(211): n is a, c, g, or t
  misc_feature (218)..(219): n is a, c, g, or t
  misc_feature (235)..(235): n is a, c, g, or t
ngaacgcgcggtgtctcggngcctctncgcgcnggaagatggcggaacangctaccaagtccgtgctgttngngngtccnggtaacatttgtcgatcacccattngagaagcagttttnnggngactngataaccgntcganaacgatgtnagnggatcngagggtagacagcgcggcaacttncgggtattagataggnaaccccctggnctacccnnggccagagctgtcatngcagaggcacggcattcccatcgaggcacgtt

SEQ ID NO: 699089 - DNA, 116 bp, Homo sapiens
ctctcaaagtaaaagaaaaaaggccatgcttgtccagctctggggctcacttagcctgggggttggctcagtaacatgatacgctctgtactcagcctggttacagagtagaccct

SEQ ID NO: 699090 - DNA, 254 bp, Homo sapiens
  misc_feature (223)..(223): n is a, c, g, or t
gacgctatcaggcgagggccatagtgaaccatacctattcagttccgcggtcagggccgaagcccatgggacccagggcccgattaactagggaagccggcaatgcgaacggggaaccaagggggccgcccacctagcccgcaacccccccatggaagggcccgccgagagcccactgcacacattccaacagcacaacaagtcccttttgtattattttgtncccccacccgccccgccagccaccccgccct

SEQ ID NO: 699091 - DNA, 1570 bp, Homo sapiens
  misc_feature (1570)..(1570): n is a, c, g, or t
ggacctcgcggcaggagcgggattaccggggatcacgggacacccggcacggggacacgggactacaacgttcccggacgaacacggacacacggacgacgcgtgggactacgtaaacacgacgacagaccgcggacgacagacgtgacgacggaccctaccaacgacaccggacggaccagggggctgcccgcataggtccacgagggggacgcggacaacaacaggcacagcaaaacggacaaagcgatgtgtagagggacgcggacaaaggacagtcacgcaccgatgagactagcgacgcacactggagaacacgtcttaaatgacaagaccaggactcttctgatactgggacagtgaccacaacactatgccctacattcacaaccacggacttggatcacatattactaggtaccagatccccatgggaccttatactgaacggaaacccgttgaaaagacaaacacctatcagcgcacgattataccatgggtgggataccaatttgaaccttacaggacaggaccagaccaactgggaccatgtagcaatacctatacactcttgaacagccagttcccacacagtacagacactgacactgccattatcataccagaggttggttattgcaatcgccattacacaaagctatcccttggacaaacacacagactaaatattggaccatttgcgaaacaacactatggcacccagaagtgtgggaaacaggggcccctccaaattaggatacccgtatgtggcgaccaacacactacatacctattacctacctagccagggaaatcattgagtctggacaagtgtcctgtagacacactcccccaaaagagacataccctaccagagcaagagaccttgtccccatttaacacaagtaagcaacatcgtatcggccagcccacgggaatcagcacggaggaccggagagacacatagtggaggcgactggacagcgcacgagcaacaacaaataactaccagtagacacagcacagtgcgcgcaacattaccacacgcgactaacagacggacacatacacacaggacaaaactaaaacaagcaacaccagacaaacacggctgacccgacaagacacggcactcggaggaattatcaaaaccaccacgagagtgagggatcggaaccaccacacaccggtgcaaagacatgaacacgacagacacggacaccgcgcccaacaccggcacaaagcagcgggcgataacccggaggaccgccccagcacccgagggagtcacagagcaatgcccaccaggcacgacagtagccaccacacaggcaagacaccacaggagtacacaccgacatgagacaaggacacaccgaggaaggcgaacgacaacgagaagacgagagaagaagtacacagacgcaccaagccgcagcagcgcagcgacgacccacacgacgaagagcaagagaagtagcataaaaagacagaacgaaaaacaacagggagaacgcgaactagacaaagagagagaacagacagtgaagtaacaaaaagcagcacagcn

SEQ ID NO: 699092 - DNA, 265 bp, Homo sapiens
  misc_feature (114)..(114): n is a, c, g, or t
  misc_feature (204)..(204): n is a, c, g, or t
actctagaggattccctttcatttaggccaatcttctcatgctcatctgattgggaagttcatcagatttaagttccgaagtcctttgatcagcagactcgtaaaattggggtnctattgctccaacagtcataaattccccatctgctgtcctgtatgtcgtatagaagggtgctccaacatccaacatgtccagtcctcgangtgcttcccacagactcaagtttcgtgagttttccacataagataactttagtattgcttg

SEQ ID NO: 699093 - DNA, 356 bp, Homo sapiens
taatcgagctcggtaccgtattgggctgtcgtgctgacttgagaatgtggcttcctctgaggcacaagcactgcgggtactcacccatctcaacgagctgcaatgccgcttgcccaggcgattggtggtcacttggcttgccttgctgccaatttggacatcagtagaactgtcagaatgaggagatcctgaacagtctcaaggtatgtccgtcctgggggtggataccaggccaccttcacccttgtccaaaaatgtgaggtgaatgggcagaacgagcatcctgtcttcgcctacctgaaggacaagctcccctacccttatgatgacccattttcccgcacgaccgcccaaaa

SEQ ID NO: 699094 - DNA, 975 bp, Homo sapiens
  misc_feature (64)..(64): n is a, c, g, or t
  misc_feature (529)..(529): n is a, c, g, or t
  misc_feature (908)..(908): n is a, c, g, or t
  misc_feature (948)..(948): n is a, c, g, or t
agagatttgcggttgctgctttccttatttgttattttgtcttggttattataatttttctttnttcgtccgtaccgcgttctttgttttctctgatcttttgtttgttttttattgttatatgctttttttttttctttttcatattaagaaaaaccgagctaggactagaccaacgagccaccaccacttcacccccccgccccccactccatacacccccctaccaacatacaagagagataaagaacaactagagaaacacagagacgcgaacataccacaacgacctacaaatacgacacatacccaacaatattttaaagttcatcagtgccctctgccgctggtggcgtcgcgctgcgctggcgcgcgctccctctaccagcatcgttaagtggtccacttagtttgttttgtagttcagcgtatatgatttcacgcactaagcaggcggagtgtttcgtcgcatgtgctgatgaccgtgctcgtctcatacacataatgggcgtcatggagagcagctcgnggatgtgagagagcgcggtagcgcggagatatgagcccgcggcgagaggggtacaaccacacaacgagaagaccggacctgaagtgctagcggatcgaataatctacatcaggccctagccgcacatcgaatgctgaggtcgcactatcagctcgctcagagtcgtgatggttgccaaagatcgcatttatgtattcggcgtcggcgcgaggaagcgtgttcttcatgcatccacacacagtcgagcggtgtacccgaggagtgtaacagatagagagatgattcctcctcgcgctttcatacaacctacgaactacgccttcacccgcactatcatccagtcgtactacatactactcctgatctcgacgaggatatntatcgtatgtcgtggtaggtgtttcgaaggagcgcgtgtntgatcgtcactgcatgctctctcgccg

SEQ ID NO: 699095 - DNA, 335 bp, Homo sapiens
tgaggatccctcgctattcatcggcacccaatggatgcatgcagtctctcaagtcccgaggctccgtgcatcgacacagtttgcctggcatgacatttctactgttgcctttaccattgagggtatccagtatctccgtgatttccttcatctgcccccggatattgtgcctgccaccctacgccgtctccgtccagagactggccggcctcggcctacggtctgtagggtgagcgacctgcgagactcacaagatgtgaagctgacagagatccctacacgaccgagtgctcgtgtccacctgggtgtcccatgaatagcgagggtaccgatct

SEQ ID NO: 699096 - DNA, 1603 bp, Homo sapiens
  misc_feature (457)..(457): n is a, c, g, or t
gaactgtggatagcaatggtgtgatcacagtaaagacctgacttcacgggcctcaaaggaccctacaggattgagagggagggtgagaagcaggagctgtgggaatagtatctgatcgacaagtgtttacccgccactgcgcagccagtgcaggagagacggatgccgagtgaaacgcgtcgaagttgttcaagggatctattatggccggatcaatggagtatctcgagcagctctcgtaggcaccggacttgtggagatgaactggtgcaccagtgttggcccttcacgggcgtcatttcgtaaatactggcagacgtgtcgtgtacacggacgcaaacggccttatagagatactgagctagagtcgtcctacggtcgcacgtctccttttgataggaagttggcacgaacctagttcgacgttggttccaagcacccagtcgattccaaggcnatggtcgctctcagagtaggtaacgaggagggacacttgcaaccaaagcgataggtccacttgggcctggactgggcactaaatgggtggcttcaactttcatcgcttacgctcaattgcaactggttgatgacacgcgctttactttctccttcgcagtgacgggagttgacaattccttccttgactgccaacgtgccccgggcagtgttgagccatagtaggacttcgtactctggttgaacgcgcttctcgtgcttcgacctgtgggcaacttcttcttggagcaagaagtgttagcgctgcttgctgagaaaggggctatattcgatgggcattgctacgagtgtggctaggtcgctggactcacattcgcaggggtctccaacaaacaactccttggaacaaggtcttccccatcgttggggaaagaacccttggttgggaaggtcgtatgtgggccaccgggttggggctttgacatgccttaggaacagcaatgggtattcacaccaagttcgtggctggagtatgcttcctcggggcacaccttggcagtgtgatacccttcataccggtaattgttaccggggaattaccttaggggaagttcgcatatcacatggggggtggcaacacgtgccttgtagtgcccggtgttttgtgggcacattgcgggcaacacaggtatgtacacgatacagggtgcgacctggatgaacacactttaccaggcgttttgaacaattggtctgtgcggcacagtctgcatgtgccctttcactggaagagtctgatagctcctcccgtgtatgtacaacaagcgagtaccgatatgtagggttgagtaccccggcctgacaagtgggataacgcacagggggaggagtcccagtaccacaaacggggaaacagaggccaacccgagcaacacaaggaagcacaagtgagcagggcccgggaaacaccacaggggagacataataggccccgtgagaacaccgggcgtgatataaatcagaccggtggcacaaagaaacgacagcgaagggagtatacagacgagaacaccagccagcatagcacgaagcactggggtacgcacaacaaggaagccggacacgaacaacaggaccacactaacag

SEQ ID NO: 699097 - DNA, 355 bp, Homo sapiens
  misc_feature (252)..(253): n is a, c, g, or t
  misc_feature (270)..(271): n is a, c, g, or t
cgtatcctgacatgatgatggaccccccgatttgttacattacacgaccaatatctcgccactatagaccatcttacacagcgacatcaaggacacccacatccccaaatatgcatgcgcctatgaccatcgagcaggccgatgcctactgacttcgagccgcccagcacccaaaacagcagagacctcagaaaacacgtaatagagcaggacactgcaaattaataaacgcatgctttacacattaccccnncctccccctccccctcnncccctgcacccatgaacaagacttcgaaaattgaacgataaaccccaaagagatccaaccttcagacccttgaagaaccccggg

SEQ ID NO: 699098 - DNA, 425 bp, Homo sapiens
ggggttattgtatcctgcaagaggagcacctctttggtctaacttgattaccacacgatgccccttttccttgaggatgtttcagagcagctttccctgtctgtccatctggtagagggtctcgtgcaaaaggatcacacccccaatgctctggttgatggacctgtccacagagaagaggatttctcgaaagtgccggcggttctgtccagtgttttccccgttgatcctctccaggcggttccccatggtaccatcagattcatgggcagccaggatcgcctttccgtgggcaacaatgctatgggcaatttttgagagctccttgttctgctcctgggtgaggtctggcaatcggtgggccatggtgccaggtagctcgcgagagaagagtcgtcctatatatcgaaagctgtgggtgaggc

SEQ ID NO: 699099 - DNA, 169 bp, Homo sapiens
tagaggatcctttcaatcgcatgtattaatcagaggtacatgagcaggctcactcatagggaataattgccaacaaacacttttgggaagcctgggaccatggctctcgcaggaatctgtgacatctccaggccatcatttgagtcctgccttctcaaagtacttgtga

SEQ ID NO: 699100 - DNA, 256 bp, Homo sapiens
agcggggaacaatcacttgactcctgagctcaagtgattctcctgcctcagccttcccagtagctgagactactcgtgtgcaccactgcgcccacctaggctctgatcctaacttgctataggctacttgtgtggcctataacctatagctgtttttttgagatgtagtcttgctctgtcacccaggctggagtgcagtggtgcaatcctggctcgctgcaacctctgcctcccaggttcaagtgattgtcccgct

SEQ ID NO: 699101 - DNA, 113 bp, Homo sapiens
aggttgtgaacccctccccccaacttttcatgttttttaaaggcattttggttttttaaaatctgtacagcaaaagcaactttttctgtcaaataaaaatgagaaatgcagga

SEQ ID NO: 699102 - DNA, 172 bp, Homo sapiens
tcccccttcccttattctccaacacttttggaaacactctttttcccgggcaaaaaacatagagaatacatttccccccgatccccatatcgagtacctgttctcgatcaatctccgcatgttttcataaaaaaagttttcccccacatcaaataagatacacaaacataca

SEQ ID NO: 699103 - DNA, 328 bp, Homo sapiens
ggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtccca

SEQ ID NO: 699104 - DNA, 503 bp, Homo sapiens
catatgcacctcagctctggactaagccagtcaagaaggcatgaataaacctcttcctaaaacaaaaatgatacaccgctatatcactattacaatggttaaaatccaaaacactgattatcacccagtcctggaaaggatgcaaagcagaaggagctcttgttcattgctgctgggaatgcaaaatgctatcagacactctggaagaaagtttggcagttacttacaaagctgaacatagtcttatatacaatccagcagtcatactcctagatatttaccctactgatttagaaatgtatgtccccactaaaacatgcacacgaatatttatagcagctttattccttatcgccgaaaaccagatgtctttcagtgggtgaactgatatcgtacatccgtacgatggaataatattcagtgattgaaagagaagtgagccatcaagccacaccgaggcgtggatgaatccgagatgcagactcctagctgaatcatctcta

SEQ ID NO: 699105 - DNA, 145 bp, Homo sapiens
acactcctatagcaacctggtggtcccccgctcccgggaggtcaccatataagatgccgaactatagtgcggacacccgatcggcatagcgcactacagcccagaactcctggactcaagcgatcctccagcctcagacctcccg

SEQ ID NO: 699106 - DNA, 290 bp, Homo sapiens
agctactgctgagccatgctaacaaaactaaacctttcactttctttaatagtcaaaattaccattcatgaatcattgtcataacaagtgcattcaagtacattaccacttatttcaaatcacaaccaccaattttgaacacaatccaactttgaaaagctgccatcaagttttttttttcaatccctgcattacatttctatttattcactgtggtcaccatgaaaaattgtattttcagcagcactactcactgctccaatttcttttttcaaacacacaacacacaa

SEQ ID NO: 699107 - DNA, 590 bp, Homo sapiens
tagcatcttctcaattggacagtacatctgtggacaaagcagtacctgaaacagaagatgtgcaggcttcagtatcagacacagcacagcagccattctgaacgagcaaagtcagagtctcgttgtaaaaacgcgtaatacaaacaaagagaatcgctgtttcatgtgcatggaagaaagtgggacttactgggtttgaattgccggtgtggaaatgtttactgtggtgtacacctgttactcagatgtacacaattgctcttacaattacaaagccgatgctgctgagaaaatcagatagaagaaaagtccagtagattgttggtgacaaagatccaaacatgatttgaactcctgctggaatacaaaattcttgagcatctgcaaactagaaattgacttgaggttaattgttgaccatagctcatggggaatgtagagcagggtatcttgcatgctcatcggaagaagtagatattggatatgggtatagattgagaaaatgagtctgaacgatttatttccgtggcaatgctctgtggctagatggagacttaaactttacaggtattatccttttaagatcagtg

SEQ ID NO: 699108 - DNA, 302 bp, Homo sapiens
gaatcatgaagtattcattaaacgtaacggaacacctgcttgagaagctgactgcattgcactgggcggtgcttttgggagcagacctcctgagggtagaaggccgctcaggtttattcctgccggagctatggcaccagggttacagccgagcatgggggttgaactactcatcagagcctgtgccccacagacagagcccactacattgatgatgataagttcagcagagtttgccatgacctggagggccgctggtctttgggatgagctgccgcgtgataggacatctgacgaaagca

SEQ ID NO: 699109 - DNA, 709 bp, Homo sapiens
ccaacaggacccacaaattcctggagaaagccgaagggctctgtaaaatcagtggtgtgattggtccctaccgagagaccgtggactctggtagagaagaaagtcaatgagataaaagacatccgtggcccagagcccagcagcggaaccacgtgaaaaacattggcattctcttcgaggaggcagagaaactaagccaaagatgtcacagaaagagatggcgcaggtagaagtgaaattaactgatacagcttcacagagtaacagcacagctggagagctcggcgcactgcaggcagaagcagagagccttgacaagaccgtgaaggagctggcagaacagctggagtttatcaaaaactccgatattcagggcgccttggatagcatcaccaagtatttccagatgtctcttgaggcagagaagcgggtgaatgcctccagccacagaccccaacagcactgtggagcagtctgccctcacgcgagacagagtagaagatctgagtgtggagcgagagtctccgttcaaggagcagcacggaggaacaggcacgcctccttggacgaacgtggccggcaaaactgcaaagtctcgacctgtcggctggttgcacagatgacctgtggaacacctccagggctgactgtgctgaaagtgaatggtggtggcccaaactgcagaactgacgaaggagagcagaagtgt

SEQ ID NO: 699110 - DNA, 405 bp, Homo sapiens
atggaatggaatggaatcaacccgagtacaggggaatggaatggaatggaatgcaatggaatggaatcatccgtaatggaatggaaaggaatggaatggaatggaatggaatggaatggaatggaatggaatggaatcaactcgattgcaatcgaatggaatggaatggaattaacccgaatagaatggaatggaatggaatggaacggaacggaacggaacggaatggaatggaatggaatggaatgcggaatggaatggaatgtaatggaatggaatggtatgcactgctataatcacctcatgaacattgtgttatagaccactctagtagtctaagtataacttacctgccggtcactttttgccgttacggagtttgatcttacccgtcccgccccctct

SEQ ID NO: 699111 - DNA, 341 bp, Homo sapiens
gaaaaaagaaaagaagaaattggggttaaaaaacaccgtaataccttacccatccttaacccatttttaactgtacagtcccagtagtgttaactgtatgcatattgctgtgccacagatatctagaggcttttcaccttacaaaactgaaactctattacccactgaagaacaagttcccattttcccctcacacagcccctgtttctatgagtttgactacttttaatacctcatgtaagtggaatcatacaatatttgtcatttggcttatttcacttagcataagtccactaggttcatccatattgtagcatgtcacaaaatttccttcttaaggc

SEQ ID NO: 699112 - DNA, 192 bp, Homo sapiens
gtgcgtatggctgttacctcaactggctgttacctacaactggctgttacctacaactggctgttacctcaatggctgttacctacatggctgtcacctcaatggctgtacctccatggctgttacctaaatggctgttacctacctggctgtaggttggctgagaatttaaacatgcccgcaacaaatcca

SEQ ID NO: 699113 - DNA, 696 bp, Homo sapiens
gcaagatactctaatcactacattgcttattctatataaactacccataagcctttaacctttaaagaaaaatgaaaaaggttagtgtttgggggccggggtgaggactgaccgcttcataatggccagtacgtctgagctgagatatgtttcaattaaacctttcgatatttctcaaggccctattctctgctgtctccccctcccactaccccgatcctttggctgaagctacgtgcggaaagataatggggcgaattctggccactcccctgtgtgaccctgccttcgagttttccttacacagttagtgcatttccttgtgttaccacgcatggggaagcaaaacgcatggcctcaagaatgctagcctcgtaccgtgagcgtcctgcgtgtggctatgcctgccgtctgactcataggcatagttgcgtgtgccttcttagcattgaatcccgcggtgtcgcacgttctttgtggcagtagcgtacggaaagaaccggtaaaggacgttccttgcgcagtagagaggttgggaggataagccatgactgaatgacacaaggggtaggacgttgtggaacgtactgactttgagcaccgctgatcctcccagttgttgctcacacaggtgtctcggcctccacgtgtaagatcacgatgcctggccctcatcgttcaagaggctatcacccg

SEQ ID NO: 699114 - DNA, 435 bp, Homo sapiens
  misc_feature (335)..(335): n is a, c, g, or t
cacgacgtgcggcttgacggcgcatagttcgctgacttcaccgatggtgaaatagcgcttggcgggaatgggcggcaacgtgatgcgctcgctcgatttatccgacatgcaatggacggacgggtttcaggccgggccggcggtggttggagtaggatggcgcgccgacttggcgcgcagcagcagcatacagactggccgcgggcgcggcaatggaccgcgcggctgtccgtcgtcagctggggacgccgggcgcgaggccggcgcgttcctccaccaggctcttgagcttctggctggcgtggaaggtcaccacgcggcgagcggtgatcggnatgatttcgccagtcttcggattgcggccgggacgctgcggcttgtcccccaactggaagttgccgaagccggacagcttgacgctgtcgccctgctcca

SEQ ID NO: 699115 - DNA, 496 bp, Homo sapiens
atttttttatcaggttaaaatcaaaggccttaattgtatgtttgctttacgaagatccaagggatctgttttttatttttttcattccagggccttaaaaaagactaaatttttaaagacagttgtggtgggatcaatttttaataaccaaaaagtatgtttcattgaagtttttgaaaaataaattatggatccctgtttacccctgctccaaaggaaaaggtaaaaatccacagttttttcaacaggggaggttaaaattttgtccatctaagtaggttgcatttacaaaaaattactcattttaaaaaaaatttgttatttaaagggggattaaatttttttaaacaaacatttaaaaaaaatagaacggctttgtattttcccttagcatttaattttataaacattgagggttttttaaacaagatatttattataaatttagattattatggataaacctagaaataaataaaccagggtaaattttgga

SEQ ID NO: 699116 - DNA, 422 bp, Homo sapiens
  misc_feature (227)..(227): n is a, c, g, or t
  misc_feature (238)..(238): n is a, c, g, or t
  misc_feature (245)..(245): n is a, c, g, or t
  misc_feature (288)..(288): n is a, c, g, or t
  misc_feature (398)..(398): n is a, c, g, or t
tttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctnaggtgggaggntcatttnagcccagaggtagaggctgcagttagccatgatcatgccactncactctgggctgggtaacagagtgagatcctgtctcaaaaattaattaattaattaattaaaataaactaggtaaactttggataggcagtagatatttttgcccacctnaggagggactcagtcaagctgttt

SEQ ID NO: 699117 - DNA, 165 bp, Homo sapiens
ggatctgcaggtcttctgtctaagcctggcatcaccacaggtatgccctgctgcttctcttcatcagtctgagaaaaatattcttccgaaatgcgtgcgcccactcgatgcagtcactgcaggggtcggcagggattggccacatcagcacttttaatcagcatt

SEQ ID NO: 699118 - DNA, 164 bp, Homo sapiens
  misc_feature (151)..(151): n is a, c, g, or t
ttgcatggaattaaaaaactaaaaaagaaaaatatatgcatgtctcagactcttatttaagcaagtctctacaggaaccccaatgacaaccaaagtaaacacaaaataagacaccactgggaggaaatattagttactcacacctacagcntacaaaaatgtta

SEQ ID NO: 699119 - DNA, 349 bp, Homo sapiens
ggtaactgatacgatcgagctctgacccccgctggccaatgcacatatggcaaaagattttcttcattttttttttttgggaataatgggggtgcaaaagtgaaagggggggggaactctgggcacttaaggtggtcaagagccagggaatcaagggtcacagatatccacacggcattggagagcacagaaacctagaaacacaaagttgggagtagggtggtcattggtccggaagtacggcagagccttccgggccagaagaaacagataaactaagctgtctctgcataatcaagggatatgcagtgtgggtctgacaaggtgaagagacatcctatggcctcag

SEQ ID NO: 699120 - DNA, 250 bp, Homo sapiens
tagggggtctgctgttcgcacatccctccagcactcaggtcaggttcagcacagtcgggtcttgagtgcaccacacatcatgttgtgtcagcagttccagtggcagcagtgcgtccatcatgtgtgttccctcaggccagcattgtcagtggtgcaggtgtgttatcattcatcggcatgtcggcagtccaggcccggcatgtcagcagtccagggagggcatccctttcagcagtctgcacctgccagg

SEQ ID NO: 699121 - DNA, 423 bp, Homo sapiens
ccctcagtgtttagtatatctttttatatcatcacatatatacttttccaccgatgtgaatagaatatctggattaccgcaacaaatgtagtataagatctgctttgtttatttagaccaatgaaatttctgataaagcttgattatagttcatatgtttaaataaggagggtttaaatgttagtattatataataccttcttgaaggtgtggtgcttatttccctagcactatgtgcaagatgccgtcattggaaatgttcaagagaaagctatgaaacttcataatgcttctaattctgaaatggtaaatactctagtgtatattcttcaaattagacagattataaaaatggtgatacacgtaattagatgaaataattataataactagcattgcatttataaactcatttttacaaaa

SEQ ID NO: 699122 - DNA, 965 bp, Homo sapiens
cgatggataagtcttagtccgccgaagggggcttagccggacaggaatcgctaatcttaatgaataagtcgtatatagaccagatagtgattccccggctgacgtaactcaggctgatgaaccacgtctcccggacgtagataccaggcatcgccttcctcttcggtcgaatcacatcctggcttaatcagtagcttaaaccatgtgtagccagtgttacttaccgttcctgtcacctgtcgaaggaccatttaaactgaacctgacgtggtcgtactaccagaatggtatccatcacaccaccggctccgtgctgaccacgccgccggttgggctgcgtctgtatggttacgagtggggacctcgcgaaatgagacccggtagtagcgctcgccggttatcccgtggaccatgatagtaaaatttaaacatactcgctctcaccagcctgcaacgccagcctggcggggggcgaaaaagcagttcacattccaccggtcggggtgcgcaattcactgctgcccgggcatatcatagcaactgatggcaatacggtatatccgtgcgcctttgttgtaattcacatacacggtttgcatgacaaacgtgcaagctcgtgacggcaggcgaaagagtcaggattgggcgacccgaaaatcggacctgtgtcaaaggtggccgggcagccataacggaacccggctgtcaaggaagggcctcaggtcaaagttacgaccacagtggctgaaccatggaatactctctgaagggctggatacagcacaacaaagacgagaacaactaacgaaaggagggaaaggcgtaccaggggatccgaaacatgacgcggcaaacctgaggcccaggaggagagaataagcacgggggacacacacgaaagagcctaccgcggaaaccaccgcgagcagtgacccaggggaaagacagcaggcgggcacccacag

SEQ ID NO: 699123 - DNA, 327 bp, Homo sapiens
  misc_feature (67)..(67): n is a, c, g, or t
  misc_feature (104)..(104): n is a, c, g, or t
acatttcattaggggaagtagtaggaaataagagctctagaatcaaaatcagggaagcagcatggangacccttgaggacattatgctaagtgaaataagtcanccataagaagacaaatatggggtgattccacttctatgaggtctctaaagtagtcacatttatggaaacaaagtagaatgttggttaccaggggcctggggaggggaatggaaatgagttttagttttgcaaagaacagtgtgaatatacttaatactactgaactatacgctgaaaaatggtgaagatggtaaactttatgtcatgtgtttattaccacaat

SEQ ID NO: 699124 - DNA, 382 bp, Homo sapiens
taatgcgctgtacaaattcgcgtcatcatgcgtggtgaatagcccttgccctgatgcgcgtgtcaaccacgacggacatgatcaccacattcggcgcctcggccgaatgccctaccaactccttgaacgcctcgtctgacatcaccacatcaaaggcgcagccgttgttgataaaaacctgcgatttcgctgtctgcttccagaatcaggaacccttgcgggtactgggcaatacgcgtcgcggatttttcccagggtcgcggcttcgtcgccttcgtaggcggtggtttcgatttgaaagcagcgggcggcgtcggcggggcgagcattgcgcaagggtcagggtgggcatgggtatttccggagcagttccacttaaggc

SEQ ID NO: 699125 - DNA, 935 bp, Homo sapiens
gaattcctgtaatggctgcttcctagaaggtctgctgttgcactggtggctaccatcttaatgctcagtgatccggccgctccaggaagggaaaacttgcaagtgagatagaaattactatatattaccgagttctatgggaagcttcagtcaatcaagattcataacagcatgacctgtcagtttgaatgaccatggttgtcgctgtagtatcctaattgatttgctgtttttggttgcttgcctggttgtgattagcagtaaaaggcaggaagatgcgatatcgcccattctagtgagggtgtggtatctcgaggcacttacttgggtatttgtgcactgattgtgggtgtatattgtcaggagcacgaatataatctggacatgatggtggacatttcgaatatggggcttaactgaggtcaaactctcgattcacatgaagggtagacttttgctgcgttaatgaggctaaacccttggagattttggtgtgttgagaatggttccgaggaatcagtaaataatagggagtctaacatattgcattgtgtgtgcagtgatgtgggagtaaggatgcatttgtaaattggggaagaaaaatgttttctggtaggcaaataaatgcaggggaaaaatgaggctataattggtaggtgaggtagtcaaagaagtgagatgggtggattaacaggtgagtaatattataatcttagaattctctcaagcatgtgagttgggaggaagaaggtgtgggcagaatttggggagtaccagggggaaaaaactggacctggatgggcgcgggcttaaaaaatggggggggtcccaggaatattttggggtcagaggcggggaggattttcttgcgaattgaaagaggtggctctggtgggaaatggcaaaaaattggagatgtggcaacaaacgggcaa

SEQ ID NO: 699126 - DNA, 243 bp, Homo sapiens
  misc_feature (87)..(87): n is a, c, g, or t
cctgccgagttcctcctcctcctaagggaaaccttttcgtttacaggcattttaagcagccgcaaggtagatcccgccagtctagtntcttttcaagaatgagccttttcccccagtttcctaagtttaaaattcactgtctttcaagcagaggaccagccaaaccagacacgttgggcacagaatctcacgcctctaggctggtgtacatccattacccaggcagcatccattgatagtgaa

SEQ ID NO: 699127 - DNA, 910 bp, Homo sapiens
  misc_feature (806)..(806): n is a, c, g, or t
agagaaccaaatgtcagagttactagaccaaatagtggttaaaacctccaaaggaagtaatgtaatcttattcataatgggattaacagtattttgaggacattcatttcaaacactacctcagttactatagagtataaaaatctgtggtttaatccctcaaaagttaacagtaatttttttagtggtcttacacacacacacaccccctcccccatgcatcactatccctgtaccctcaccttggtcatctatcctgcaaataaggcttagttagtattggcctgaatgtttggtgtctgtgttttggtctctcttttgtacggtgacttttgaaaaaattgtgtttgtataccttatcatactctgcctaatttacacttacttgggggagatacatcagagctatggtggtgcaatcagtactacgtaaaaaaaaaaataaaagagcctacgcgttaaagtagtatagggcctaattggggtacctccaatagacttgccccatggaacgggtcctagatgacattttcctccgggaagacaactcgtctcggcaaatagtgcaaaccgttttgggcggacacaacatccacagtgccgaggcccaagtgttggttaaaacatgcaacgctgttcgcacaagattatttatttactaacacagacaagatggcaccggatgtgaatcatcacggaagactaagaaaatgttatttggaggaagaccgccctctattgaatacatgaagcagttgttcccggccgtatgacttaccccaaggtaatttgccaacagcggccgntctaaaagactcaaagagaataaaccttggcccctataaaaatgcgggcaacgggacaagaaacggcaactcggggcgcaccatgaacacttgtgccgacatta

SEQ ID NO: 699128 - DNA, 337 bp, Homo sapiens
tgagacagaatgtccctctgtcacccactctggagtgcaagggcacgatctcaactcactgcaacctctgcctgccaggttcaagcaattctcctgccctagtctcctgagtaactgggactacaggcatgcgccaccatgcctggctacttttttttgtatttttagtaaagacggggtttcaccatgttgaccaggctgatctccaactcctgacctcaagtgatccacctgcctgggcctcccaaagtgctgggattacaggtgttagccaccatgcccggcccataatggtaatttttaaatactctaaaaactgacccatcatacaaatgct

SEQ ID NO: 699129 - DNA, 531 bp, Homo sapiens
gcataaagtcaatgagtcatgtcgtatgtagtggcagaccgaacaaaataggactaaaatttttcaggggggctatctaattagggtagaaatacatttcaggtttccatttatggagcaaagccaaaactggcagagggtagaagcgtgatgtggacgcaaaaatagaaaatatcacttgatactttaggttgaaagaaaaagatgattgaggcaatggggcacgcctgctctgtctgactactcttgactcctttggcttcttagtgttttcaccatcctaaccactgctggccagtcccgtcacagctgccctctgctacctgctgcgctatatgtttggccactctcatgttcacatgaatcgtacaagacattaactcatgaagtcaaaggatactcatcaggtggcgaacagctgcacacataatgcacagctccacagtgacatataacagtgtgttcaaatacttcagacagacccttgccacttcgatgacaccaatcaaggacctgatccatgaccaacaa

SEQ ID NO: 699130 - DNA, 476 bp, Homo sapiens
gctttaggaatgatgtaacttggcaaagaaatcctaagtcaaaatttttttgatgataatctcagatcaactgagaatgatgccaatcaacccatgaatgtaatgtgtttcacatgtgggattctataattagtgcttactaatagaggtttcttcaagttactgaaatgagtttacaaactttaggtagctcaggaccctaccctcatgtatatgtgagatttcatttttataaatgccactgtcaaagggtcagatgttgctttttattctcgttgctaggatggtcaaaatcaacattttgatggttgtgttgaacagagcagtccagtcagatttaatccagtcatattaggatcatgccattagagaacagttccacaatcttttctaattcctcttttgtttctggatcataattaaaataatataggaacaaccttattaataaagcttgaattagtttgtctgtaaaa

SEQ ID NO: 699131 - DNA, 358 bp, Homo sapiens
cccactgaaccaatgagctgggactacaggcacatgccaccacacctagctaattttttgaatttttagtagaggtgaggtcttgctatgttgcccaggctgggaattgaacttctgagctcaagcaatcctccaagtttggcctcccaaagtgctgggattacaggcatgagccaccgtacctggtcttggcaagcttctttactgcaccctgttttatcagcagtctttgtgatctgtgtcttgtgaaaggagtcctggtgaactcctatctcataatcatgtctcattaggcccacctaccaatactgttgcattggggattaagttcccatcacatgctcattgggttccgatg

SEQ ID NO: 699132 - DNA, 613 bp, Homo sapiens
  misc_feature (175)..(175): n is a, c, g, or t
ggttggaaggcggggatagtgctcccctctcccttggtggaagggcacagaggggcatttccccaccttgtttttatcccggatggcaaccgtttcttctcaggagcccgcaagaatgttaagctcttgtgttgggatctccgccagtttggttacccattgtggtccctgggtngaaaggtgcccaccaatcagcgcatttatttcgatttggacccgcccgggcagttcctagtgagtggcagcacaagcgggcccgtttttgtttgggacccggacgggcctgccaataatggaaacccggaccctgtgttgagttttttcccccaaaaggattgccccaatggggtgagcctgccccctagcctcccttttttggccattgcctccggtcagggtgtgtttcctgagcccacaaaaagtggggacaaaggaaagaagttggcccttcccttgttttccagggcccaggtcccccttaaatgtcggcttcagctttggtggtgtgggggggggccaaactccagcatcccttatgttccccagggcaaaaaagggcagggaggaccggagggaggtgtgggtgagttaaaataaaaaggtttttttgtta

SEQ ID NO: 699133 - DNA, 231 bp, Homo sapiens
gccgggcgggggggaaaaacttttttggggttttaggggacccccccaaaaccccgggggcaaaattttttttccccttttgggccccaaaaggggccccaaaaaggtttgtccccccccaaaaaaaagggggtccccgggtaaaaaggggaaaatcccccccctttttttcccccctttttttgggggcctttgggccccggagaacccccaccgggggggggcccttga

SEQ ID NO: 699134 - DNA, 117 bp, Homo sapiens
gggggtttttttttttaacccaaaaaccagggggataaatttttttttgcctttttttttggaaaaaaccccaaaaaaactgtggggggggttaaaaaaaagaatttaattttttta

SEQ ID NO: 699135 - DNA, 222 bp, Homo sapiens
ggggacacccaacaatttttccatttctgcagagggaaactcagatgtccaaactaattttaacaaacgcattaagaggtttatttggggacaaggcccgcagtggcttttgccccaaaaagggggaaggaacaagggggtagatgattttttaggagggagggagttctcttcggtgttaaccataagcaccttcagctgtactagtgccattggaataat

SEQ ID NO: 699136 - DNA, 804 bp, Homo sapiens
  misc_feature (1)..(1): n is a, c, g, or t
ncaggggccatcgaatgtgaatgcacaagggagtatcacaaatattaagtgataattatctgacgagcctacactgaccagaatggagcaggggaataatgcatatctcacttctgagcccacgggcaagcagtctcaacaataaccaaaaaatgtgactttacgactggtagtgtggttctgaagtaaaaatattctcgccaggaatcaaaatttgccatgaggaaatacttcactgctggagaagcacagttgcgaagctcatcttctttattgatcatcatcgaagcaattgcaccatcattaaactcaaaagaagttcctccatccacaaccatacaggcatcccaataacgagaacgaacacaaaccctatgcggaaggaaatatctcattaaataggaatagttgtcttaataggttattgtaatcctggatcttaacctagcagatcatttggcctccattttaaaaatcaagttgttctctggtatgagaaaattagtcactatgtaaatatatgggtatattatgaaggtctcaaaacgttcaggatggcaccattcgctcaagcatttagcattaaagaagtgccgacctgactgaactcacaggctgttttatatgattaaatgctgaatactaacattacaatataaagattgaataagagggttactattttgatggaaatttggactgaaatttttaccttagttacgcatttcagagagtcgggtcctggaataatgttactgggtttccccaattatcatgcccattcaccgaaaaagttatgacaca

SEQ ID NO: 699137 - DNA, 836 bp, Homo sapiens
gacccctcgtcatggtgtacatatgttgtgagtaatagagcgactgaccatctctttctccagctatctgcgtactcgaccgaatagttcagtagaaggctggagcgactgagacggcaaaaggtatcgtacctctgctatgatgacctcgtaataggacagcgtgagagcttgctggtggagcggacgactgtggttagaccccttggacacgccttcacttgagcgctcccgaatttccatatcgctatgtaggactctgcattagcacgcaaagggcttacaccacgcattgtaaggtcataagagatcggttattagctcgccaatagggacgcagtggtcactagccgtggccccaccttgacgatttatgcgggtccaatgggcctttgtttaataaggcaaccgagtcggtccgtaaacccttgtccaggtaaagagggaaacaaggacgaagaaacactcaaggcctctccgtgtattgcgtgtgccacactgtgatgggtgactgcacacaccctacgtagaagggcgcctttctcttgaccacatgtgctggtcaacttatggatagataagaagagagaatgcacgaaaatgaaacgtggaaattaactagtctcagtgtgcacaccccttgcatgcatggcagtgacattaaccatgttttggacctttcccgaccgattgcgaatgagagaagcaaacacaagatagccatggctgaccaaggaggacaagatcccagcccgtacaccattgaaagacctaacattgccttcattccttgcacagaaaacacagaatgtagcatatgtgtgtgcacgacacca

SEQ ID NO: 699138 - DNA, 124 bp, Homo sapiens
  misc_feature (9)..(9): n is a, c, g, or t
actgctcgnctctgtgagagtgcagatattctgccgttattagagctcagagagatcatgcgagccttactgagagtcagtccgtctgactgcatctctcttgtactgtacaggtctgtctgtg

SEQ ID NO: 699139 - DNA, 764 bp, Homo sapiens
tgatcgtcgtgatgtggtgcttgtgggtggttcacgcggcgacatctttgggtgtgttggtgctttctgtgccctgtggtggtgatgtgcgccttgtatggtgcggcttttggtgaggcgcgtgtgtccagggggtgtgggagttttggcgggttttccgtgggtgtgttgtttgtcgcggcttggtgcggtgcggcccgtttgtggggtgggcggctgggggcgtgcacttcgtggggttgtcggctgtcgtgttgccgattcatggggtgctcggctctcgtgtgattggtatggtgtcgcctcctttgtgtcctgctggcttggtgcgagggagagccccgtgtgattcgcgtgtgctgtgggcagcgagccgccgcgttgcggaaggggtggttgctacccccgtgggggggttgggcctctctggggggcgtcccccaggtgtgggaggcgaggtttgggtgctccctctgggggggtttcgttctggaagacttgtcttagtaggtggagtgtattgataggccggtgtggttccaagatggacatgatgttgtggggtaggatataagttgtgccgctgcgaggtgtaggagtgttgggtagtatttgggagccccagagcggtccgccccaagatgttgtgacgaagtagggagaatgaagaccaatggtcgactttggggccccaacaacgaggtgagcccacgagaagaggtgccacgtgcccccccggtccctccaaaaaaacccccaaaaga

SEQ ID NO: 699140 - DNA, 80 bp, Homo sapiens
tgcgagatctgggacaaccccccgggtactatgggatatctggggccaagggacaatggtcaccgtctcttcagcctcca

SEQ ID NO: 699141 - DNA, 125 bp, Homo sapiens
ccatgtcgggcatatttgccattgatggggcatactgccatgtggggcgccactttctaattggcttggagatgctgcatgtccaagcaaattagaaagtgggccaaaaatgggggtaccgagct

SEQ ID NO: 699142 - DNA, 284 bp, Homo sapiens
  misc_feature (10)..(10): n is a, c, g, or t
  misc_feature (51)..(51): n is a, c, g, or t
cgcgggctgngctggagccgcacacgctctcctcccatgttaaatagcacntttagaaaaattcacaagtccccatccacaaaaaaaaagggagaaatttgtaaaatttcagggattaaaaatcccctttgaacaaaaaggaacatttgctggcctgggggggcatttaaatttctatagcaccagtgattccttccccacccaacccataaaatagatgtagcacctttggtataaaagggggagccgtttccaccctgccccaatccttaccaaaaaccacc

SEQ ID NO: 699143 - DNA, 151 bp, Homo sapiens
agataacgtcaggtaccagtagagtggcagcgctcgctagaaaaagatacctagaatatcgtggaagtagacatatgtaaactcgtatacaccaggccagaggcataggaaccagtatataggagaggctccagcaagcaccaggcaacag

SEQ ID NO: 699144 - DNA, 153 bp, Homo sapiens
  misc_feature (119)..(119): n is a, c, g, or t
gggcaagctgagatagtgaatggggggctggccggctggcccagaccaggccgaaccggaccagacaggaagcacaagcgcgaggagcatcaccttgtcctcgttcactctgctcgcgnactgggaggcccccgtaccccgacttgatccaag

SEQ ID NO: 699145 - DNA, 1020 bp, Homo sapiens
ctatcatcatcttgatgccaaaatttggtggagacagccataggaaattgcataacatgtcatgctatattattcttgttatgatcttcttctataatacatactcataccattacttaataacagttaaccagtccccatagaatttgacaagaattgctatgactgaaaggttgacgaggtcctaattaaaaactttagtcaatggcagtattcataacttagactgaaaatgcagttctgtagaggtaatcttcagagttatctgggaattatatacactccaggactatacacaggatgatggcatgcagcattcacaatgtctgtaaggttactgtgaagagcaatcagcggtctaagaacagcgttaccagtatgggaccctgtacacaatacccaagtcccgtcacgtcacggctcgcgtctatgcaaccaattgttagagacccataactatttaacacacggggtagtctgaactaacattagcaaatacgacgcaagttcgttatgcctgtgcgcaccacgcgttactcacaccttttaaaggttgggacgttatcaacctgggccaagtcactccacaactggtagaacaagacattttacaagaaaattacaaaagctacgggggtacccaaaggtttacatgggtattcaagatccttaaacaacaatatttcggtcgcacaataattggtctcactcacacacgaatagggcttggaagcgatttcgaccaacaaaaaatgagtgatcactacgagatatgaacgcctatataaaagagtaccgtaggtatttacaatggttggttgcaatagacagattgcaaaagattcggaaacgtgagagatatggaaaacatagagtagtcaacttaagaagaatagggaggacatagtacaactagataaggatacataatagcgaagaaaaggtaatacattttttagacattggacaagatttagaaaagtggtacaaacaatgaatagaataattagaagtaatctc

SEQ ID NO: 699146 - DNA, 196 bp, Homo sapiens
gtgtgaggatggagaagagagaccctggatagaatctgaaggaacctggaagaaaatctgggcatggggcacacacctgtagtcccagaaacttgggaagctgaggtaagatctctggagctcaagaggttgaggctgcagtgagccgatgtgccagtacactgcagcctgggtgacagagcaagaccctgtctca

SEQ ID NO: 699147 - DNA, 1021 bp, Homo sapiens
tggaaaatttttttttttccaaaaaaaaaaacccccaaaaacacaaagtttctccccccccccccggggggggatatgtgtgggggggggggggtgttctgttcccctctcccccctgtgggcccccgccccgtgtgtgtggtttggggcaccacaatggggggtttgtggggttagtggcgcgccaaaaacaataaagagtggtgtggcggtgtgtgtgtgttgtgtggcgagagagaacagagaggtgtgtgtcacaacaccggcgcgtgtgcgcgagagagcgcgcgcgcgcgagaggcggcgagagagcgtgcgcacacgagagacgcgaggctctccacgtcagaagtgtggtgagacacgaccccccgacgagagaggagtggtggcgagagaggcgccgcctcttctctcgcttagacaacctcatttgttgtctgttgtaatggtcgggcggcgagcgtccttcatcaaccaacaccccaccggccgcagcggtagatgaagaccaccaccttcttatctgttggtggtgcgggcccccctctcatcatgagcgaggagaggacaataaagagcagtcgtcttctgttgtggtgtccagagtactgtcgctgtcgtagagacgagaacagtagtagtcgaacacccatacttgtagaagaagacgcagaagtagaagatgccgccgccccccccaccccaggggcgcggtgggagggtggtagctctcgcttggttggtggcgtgagagcaatgcgaggagaagaaggaaaaatctatcctccctcacactggtcggcctcgtcaaacactaatattcattcatttcttcccccctcctaccatccatactatccagccagcttgctgattgcacacacaatgataagcacgattgaaatgaaacatacctatcgtacaggcacggataacaaatacctttcaccgtcagaccgcatcatacaataattcattatttataagctacatcgtaggatccctctcccctccgcca

SEQ ID NO: 699148 - DNA, 736 bp, Homo sapiens
  misc_feature (73)..(73): n is a, c, g, or t
ctttttagtctgggctggcacatggcatccagactgaggatacccggaacttatgggccacgtgagccatggnacggacgctaggcagcccggaagcacctctcggtcggatcatgctggtgggctgcgatcactcaccggatcaactattgcaaataccacccatgctactttgggaaagttgctatgaatcattaccacttaaagaggaaccagagcttgtgcccaactgtaaaccttgacaaatggcggactctggtcagggaacatacacagctgaatgctgctaaaaacaatactggcgctgatcccatcattgatgtggtgcgatcggactactacaaagctctgtgaaaggaaaagcttccaaagcagcctgtcatcgccaagggctaattcttcatgagaacatctgacgagaagattaacagtgtcaggggggaactgtggtctggtggcttgaagacacatggagggagcttgatttaaggctaacctcttttttcggcaggggcaccattgaaatcctgagtgacttggtggggcccctgagtcgcagacaatttagaatcaagcaagcttatgctttgagacgatttacagcttacttggccattggcgctttgagagagcatgtaaattcaatggccggtgtttaaaccgggatgctggggaaaccctggggtatcccaatttttcgtttggggggattcccctttgcccattgggtgtttga

SEQ ID NO: 699149 - DNA, 205 bp, Homo sapiens
gggactatagttctgataccattcaattacgagtgctctcatgtttgacaggatgggggggacagatgtctattttgaaacaaggcagatggtggtgcagaatagaaggcagcagtagtgaacagagcaagaggtagctttcagttgacctatcattaggcatgcccttttgttgtttttttgcaaccggatagtagtagtaggc

SEQ ID NO: 699150 - DNA, 326 bp, Homo sapiens
  misc_feature (22)..(22): n is a, c, g, or t
ggactaagagatgagaatgccnaaggtcagtggcgttgggtggaccagacgcccattaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaccaattagaataaggcagaatgtacgtgcgtcattggaacacagaaaacatgctggttcatacag

SEQ ID NO: 699151 - DNA, 317 bp, Homo sapiens
gcgtatgcacaacctagggtcagttttgcaggtgtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcctacaataattgttcattattgctctcaacttggggctctccccaacctggagacccttcctta

SEQ ID NO: 699152 - DNA, 419 bp, Homo sapiens
gcatgccaaattcaggtctctccaccacattgaagaacaggaacctggtagaagatgtaaaaataagtccactcttttcatttatgttccatataaacttatatggatctactctacatagtcatatgctttcaaaactttacaggataacaaacaaatggtgtccatcagaaatctggaatgtaatccccatctctgtcagtagcttgctgtaggactggtttacatcaaaacctgtacattatttcctcattaataatgtatccctgttctgtgtgcctgcacaaggtgtcaaataagcaacaagaaaaaaaaatggaaacctttccatgtgttcagaatacccatggataaatccatctgaatgtatctgaagagctgggtaaagagccgcccgggttgccaagagcagtaatgtg

SEQ ID NO: 699153 - DNA, 938 bp, Homo sapiens
  misc_feature (300)..(300): n is a, c, g, or t
  misc_feature (595)..(595): n is a, c, g, or t
  misc_feature (623)..(623): n is a, c, g, or t
  misc_feature (632)..(633): n is a, c, g, or t
  misc_feature (668)..(668): n is a, c, g, or t
agcaagagcccatagaagatgacaccgccgtagtgcaccaggaggctatgaggaacacgtactgccactcctcccgcgtcttgtgcttggtcattgcacccacgatgatggggcacaccatcccagacagtgtgcccacgccattggaaatgcccatcaagatgctggcatagcgaggggcgatgtccaagtggttcacgttaaacccagagatggcaaagccactgaagcccacagccaggaccaggaaggagatggccacgcccttggagtgcgagtatccgaccaccagcagcagcntggcttccatcccgaaacccccgcagttcatgagctttcgcacgttggtagtggacattatgtgacgactgcgcaaaaagtcagcgatctggcctccaatgggtacgatgatggtcatgacaaggtgaggcagcgccgacaccagccccaccttgctgatctcaaagccgaacacttcttcaaagtaggcgggctgagagatgaggagcaggtagaaggtccagctgcggcaaaagttcgcaacgatgatggcatagacgggcatggacgtaaagaagcgcctccaggtgtgttnaacttcgtaacagggttcatgagctggngctctcccnnatggcatcctcaatgtatttgcgctcccctcaganatgctggggtgcatgccggtgactcataggagacaagcaaccagaacaggtaccaaaagatcccgaagctgccatagacatagaagacagaactccatcctgaatactgcacaaggaccccagccaagggcatggcaaccaccgccccagcataggaaccgcaaaaggctgtcgttgccagccgactccgttctaagggaggggcccatttgctccagatgccatggccaagcagggtatgtgaccccctccaccaatccctgaaggatc

SEQ ID NO: 699154 - DNA, 107 bp, Homo sapiens
tagctgcttgacggaagttagcattgctcagagctgaatggccgctacatcagcaacgaatttaaggtggaggtgaatgtaatccacacggccattcaacgcctccg

SEQ ID NO: 699155 - DNA, 191 bp, Homo sapiens
aatgttggaaaagaagggggaaaagaagaaaataaaacccatgccgtgaatccccgatgtttcctgaaagaactcttttagatgaaatccttctacccaaagggcccttaattttttttttttccctgagtaaaagcaagaaattttttcctttggaaaaaatatatatattaaaaacccccttttagagg

SEQ ID NO: 699156 - DNA, 740 bp, Homo sapiens
  misc_feature (26)..(26): n is a, c, g, or t
  misc_feature (71)..(71): n is a, c, g, or t
  misc_feature (93)..(93): n is a, c, g, or t
  misc_feature (125)..(125): n is a, c, g, or t
  misc_feature (134)..(134): n is a, c, g, or t
  misc_feature (146)..(146): n is a, c, g, or t
  misc_feature (152)..(153): n is a, c, g, or t
  misc_feature (167)..(167): n is a, c, g, or t
  misc_feature (199)..(199): n is a, c, g, or t
  misc_feature (208)..(210): n is a, c, g, or t
  misc_feature (212)..(212): n is a, c, g, or t
  misc_feature (214)..(215): n is a, c, g, or t
  misc_feature (218)..(218): n is a, c, g, or t
  misc_feature (221)..(221): n is a, c, g, or t
  misc_feature (247)..(247): n is a, c, g, or t
  misc_feature (252)..(253): n is a, c, g, or t
  misc_feature (264)..(264): n is a, c, g, or t
  misc_feature (272)..(272): n is a, c, g, or t
  misc_feature (274)..(274): n is a, c, g, or t
  misc_feature (279)..(279): n is a, c, g, or t
  misc_feature (287)..(287): n is a, c, g, or t
  misc_feature (329)..(329): n is a, c, g, or t
  misc_feature (339)..(339): n is a, c, g, or t
  misc_feature (342)..(342): n is a, c, g, or t
  misc_feature (344)..(344): n is a, c, g, or t
  misc_feature (373)..(373): n is a, c, g, or t
  misc_feature (433)..(433): n is a, c, g, or t
  misc_feature (721)..(721): n is a, c, g, or t
tccctacctaaataaaagtgcaacantcagtgcatgtgccagccccattctcccaagtcgtgggagtgggngtaggtggtggggggggggganggaaaaaggaattacttcacttacacctatgntgccctttncccaagcctgangaaagnnaaggggaaaagggntgcagggtacatttttttttttcacttgaacntggaaagannntntnncantcncccttcccctttttagggggtgtgtnttttnntcagcatcctnttttctcntncaccntgtgtttntgtgtacacatattccaccacagttgggaggcatgtttaggntgacccagtnttntntgttcctcctttgaagagggtttgtcaantgggaaaaaggaaggagccacatcaggcagaggtttcaagccatgggatgggggaaaggnggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacanttgtcttacggctcagtgg

SEQ ID NO: 699157 - DNA, 513 bp, Homo sapiens
caaagacgaaagactgaggagctaccaccaacagcaggaggtgatgccgtacctgctgataccactctgtggttctcaagtccatgaacagatattgttgcattttccacaccgctgattgaacataataaacaatccagaaaagcagttttgcccagttgaggatcaatttaatcttaatgatgtattagcatactctgaagagttattcctgaagcttgatactagtgcttcaggccggttatgatttactagttaaggagacgcggaactctgggggaggacccgggcccagcttagtcctatagggagaacgaatccatgtcagtgtgccgtgttttacaagaatatttacttgtaaaaccctgaggtagacaacttgtatcgctttgaggagaattccattttctgaagatggggaagtcatttaaaaggcgcaaaccaatggtccttttgccacatattgtcaccctcaatggggaaggggaaatttgcgggcgcatataatttgga

SEQ ID NO: 699158 - DNA, 320 bp, Homo sapiens
  misc_feature (23)..(23): n is a, c, g, or t
  misc_feature (36)..(36): n is a, c, g, or t
  misc_feature (69)..(69): n is a, c, g, or t
  misc_feature (71)..(71): n is a, c, g, or t
  misc_feature (139)..(139): n is a, c, g, or t
attcggcacgatggcagttcctnggtcgcgcggcantgttgagcgccgagggaaggcggtgcagaccantncctgggcgcgcatgagcgtggtgtcggcctgcgtgctcctgacccagtgcctcagggatctggcgcanaccccgacggggcgccaagatgtcggaccacagggagaggctgaggaactcggcctgcgcctgtctgaaggctgcaccctgctatctcaggctttaagggagaggtcttcgcccagggactttaaccgccagtgaattccaattctgtgaatttagcaacccacccccataaccctttttt

SEQ ID NO: 699159 - DNA, 127 bp, Homo sapiens
tgtagtatctagaggatcctggtagtgatctcttgttgtccacagggcgcactcagcctgccagctcatacccagttcttcagctcggccagcggtaactgaagcctcccagaatcctggatccggg

SEQ ID NO: 699160 - DNA, 89 bp, Homo sapiens
tatacctgtacattcgtgtcattcgtgtccaagcagggtcttgtgtgggtatattattgacggtatttgagtttagtaagttcaggaag

SEQ ID NO: 699161 - DNA, 909 bp, Homo sapiens
  misc_feature (10)..(10): n is a, c, g, or t
  misc_feature (61)..(61): n is a, c, g, or t
  misc_feature (64)..(64): n is a, c, g, or t
  misc_feature (95)..(97): n is a, c, g, or t
  misc_feature (107)..(107): n is a, c, g, or t
  misc_feature (111)..(111): n is a, c, g, or t
  misc_feature (122)..(122): n is a, c, g, or t
  misc_feature (140)..(140): n is a, c, g, or t
  misc_feature (221)..(221): n is a, c, g, or t
  misc_feature (363)..(363): n is a, c, g, or t
  misc_feature (393)..(393): n is a, c, g, or t
  misc_feature (550)..(550): n is a, c, g, or t
gctgctgccnttttcacccgaggaactgccacccaccagctctgcgcagggatgctctctnagnttagcgaacatatcttagatctcttttttcnnnttgagacctngctntggagagtagnactggcagccctgcctgnactccacttggcatgataccagctccagaagggaagggagtggagcaggcagtgaggagagagcctgggggtcggctgggnacagccgtatgtgctaggtaggagtggagggagatatgtttaccaaatgcctgtcctgccatcctcccaggtagtcagagtgagctacatcctgccccgccttcatttccatggaaacatggcagctaggacacggggtacnacagcagccaaattcttccccacctccctnacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacanccccaccccattcccctgcatcggagctcagtattcctacagggtaagaggtaggaatcttgctgggacgaggggagccagaagtggcaataaaagcgtgttgacctgggactccatggtgttgacatgggactacgcgggactccatgaattttccattctggcaactggaaggggaggtgtagaagggcctgcagaggacggcactggagactctcctaaaggccacacacctcccccttgctgcccggcacacgcgcgtctccttcaaccgatgcattggcagcctcccacaggctcggcctctgctctaaattaggtcgaaagagtcccagttccaatctagggaacaggataac

SEQ ID NO: 699162 - DNA, 351 bp, Homo sapiens
  misc_feature (93)..(93): n is a, c, g, or t
  misc_feature (110)..(110): n is a, c, g, or t
  misc_feature (118)..(118): n is a, c, g, or t
  misc_feature (155)..(155): n is a, c, g, or t
  misc_feature (268)..(268): n is a, c, g, or t
  misc_feature (316)..(316): n is a, c, g, or t
aagaggttttattgactcacaattctgcatggctgggaaggcctcaggaaattcagaatcatagtggaaggtgaaggggaagaaaggcacgtntcacatggccgcagagnagagagtnaagaaagtcacacagttttaaaccgtcagagctcgtnagaactcactcactatcatgagaacagcctgagggaactgcctccatgatctgatcacctctcaccaggtcccttccttgacacctggggtttacaactcaacgtgaaatttngggtggagacacagagccaaaccacatcaccatgtcatatactatctngaagaaacctgcctattctcaaatgttcagcagtg

SEQ ID NO: 699163 - DNA, 371 bp, Homo sapiens
  misc_feature (2)..(2): n is a, c, g, or t
gnaaccacccaaacagaaaaaaaaaaagccccggaggggtaatcgggaggggcaggtgggggaagcccctaagtttggtttgaacgtgttgagttgggctcatccccatggagatgtcaaaatggcaaatggagttttgggtctcaggctcagggaaaaggtcaccagtttgagatcagcctggccaacatagcaaaaccctgtttttactaaaaatacaaaaattagccgggggtgatgtcgtgcacctgtagtcccagctacctgggaggctgaggcaggagaatcccttgaaccagggagtcaaaggttccagtgagccaagatcatgcccccatactccagcctgggcaatagagtgagactccata

SEQ ID NO: 699164 - DNA, 271 bp, Homo sapiens
cattacaggctcagatgggttctcattatgttgcccaggccggtctcgaactcctggcctcaagtgatcctcccgcctcggcctcccaaggtgctggtaccacaggattgagccaccaagcccggcccgaatatatttttaattttttttttttaagacagagtttcactcttgattgccttaggctggagtgcagtggcacgatctcggctgaccgcaacctccacctcccgccatcttgagcctgtgtctccatcttgagcctgtatct

SEQ ID NO: 699165 - DNA, 228 bp, Homo sapiens
aaccgggtccttctccaacatcttcaaccccctgacattatctgggatcctacgggtttctccatccaattcttggaatttcccagtctcccctatgtaaaacttagcaagtgggggggacctcatgccggggactatgctgtaaccaaattatggtccaaggctatagtgcggggatgaatataatcggaggaagggcagtaaacagacccgcgggggggggtcacg

SEQ ID NO: 699166 - DNA, 987 bp, Homo sapiens
  misc_feature (79)..(79): n is a, c, g, or t
  misc_feature (153)..(153): n is a, c, g, or t
  misc_feature (327)..(327): n is a, c, g, or t
  misc_feature (592)..(592): n is a, c, g, or t
  misc_feature (595)..(595): n is a, c, g, or t
  misc_feature (612)..(612): n is a, c, g, or t
tcgagggtaatcgctggagctcttgatgagttgcgtggaatacaatgggcactgtccgacgagtaactcttaagagtcnttcacgagagtgcgatagaacatgtgaaagcaagtatcaatcttccaaatgattaggaaaaggtagcgtcgcgncaatgatagcaggtttcttgtatatccacctcccaggtatggaagttaggaagcttggtgggaggttacaatactgacgaccagtgggatgtgacacgtcgcatttcatttggggccacgcgaaagtgtcataatttgatactgtatctgttttccttcaaagtatagagcttnggggaaggaaagtattgaactgggggttggtctggcctactgggctgacattaactacaattatgggaaatgcaaaagtgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttnttnttaggtgtaggagaaantactttctccatggtttaacgtgcaaaacaagatgttaaggtttgcttcaaaaatttggtaaatgggtttatttttaacacttattcgtggttgggtaaattgggtaacgtgattaagaaatgtggtgatagtccagctggaagtgtctcttagaggggtgggctttggttgactgagggaggggaaactttttttttcctatagactttttccagattaacattcttcgtgagttcataaccagccgggcagtatgaggggcctaaatgcagagaaaacgagcccctgggggaatggataagtaagggcggaaaagattttttgtcatacctccatgggggaataggcttaaccctgagaattcttactacgga

SEQ ID NO: 699167 - DNA, 1216 bp, Homo sapiens
gtgagttgtggaattcattcatctgcggtaggcaagtgcattggtgtccatcttccgaccaatcgtgggaccgtcatagatacatgcacaagaatgagagccgggtgagctcaattctcgaacagtggtgtcgtccatgttcgcagcctatgcacccgaaggtcccatgggaatattcagcagagcaggcctatgtcaactcatccatggcacctagacaacacagtgggcatgggcttcccatatagcaacacaaagacactgcatcctagaaccagcacgaccctagatggcgtggcccagtatgtgagcccgagatgcacacgtggtagaggacaattgcgacatgctaaattatgccttggaccactggcgtctatgagcgcacggcgtccggtggatcccaataatttcaaacctctcaacgtcgcttgctatcccatcacacggacaattgtcttgtggttgcatgcaaggaccttcatataagcgtgggcacagtcggacgacaccacacgtggcagggtgatagaacaacccctaattgtgcgtttcgagacagctgacacagttcccatgcacacgatgggtgtcagtagaaccccagtgtagaaccgtcgcaacatgtgcgcggtctagccaatggcacatcgtgcttcgcaactggaacccagatggacaagtggacaaacaggtgcctattgtattcaccatcaggcacatggtgcctccgagaacacgcacgatgcacactcatatccccacaacggtggaagtggtgagaggggaatatgcacgcaaggtgatatggcataaacgtccactgccacctatttgacacggcacaccattgacaaccggaattgaacattggggcctggcaatattgtgatagacaactctacaccatcgtaaaaaccgccttgggcctgtaaagcttaatactacaatctaatcgaccaacaccgtgtagtataggaatggcagaaaacgcgagaatcttataagagccaagctgtggcgcgtacatcgtgacagtgtgtgacttttcattcactacctaagggcagtgccctgggcaagcatgtgtggtgactaggtctgcattgcgtgctacaccctggtgcacggccacaacgatacctcatacacttcgtacaccaggacaggagaacccgtgcgtatcacttgggacaaccaatacacactgtcggcc

SEQ ID NO: 699168 - DNA, 419 bp, Homo sapiens
gagttagggtatcgatcattgctcaggacagcatttgacctccctgtcttacgcaatcctcgtcagctcagccatacagggagctgggactacaggtgtacaccactatgtgatgctattttttttttttttaaagtagagatggggtcttgccatatggctaggataacagttgtcagccactgcacccggccagcaacctgttcgtatagcagcaggaaatggaggggcagagaggttaaggacacctgccaaatgtcacacagctggagaagcagagaagccagttgcccgagctcctcatggctctgtcagcctgattctcctcgtggggaaggcctccctttccttccaggttctatcagggtcctctttgtccccttgattgttttcggtgcctcctgctctatgtcagtttg

SEQ ID NO: 699169 - DNA, 621 bp, Homo sapiens
  misc_feature (1)..(1): n is a, c, g, or t
  misc_feature (17)..(17): n is a, c, g, or t
  misc_feature (36)..(36): n is a, c, g, or t
  misc_feature (74)..(74): n is a, c, g, or t
  misc_feature (78)..(78): n is a, c, g, or t
  misc_feature (116)..(116): n is a, c, g, or t
  misc_feature (125)..(125): n is a, c, g, or t
  misc_feature (133)..(133): n is a, c, g, or t
  misc_feature (167)..(167): n is a, c, g, or t
  misc_feature (185)..(185): n is a, c, g, or t
  misc_feature (236)..(236): n is a, c, g, or t
  misc_feature (296)..(296): n is a, c, g, or t
  misc_feature (333)..(333): n is a, c, g, or t
  misc_feature (335)..(335): n is a, c, g, or t
  misc_feature (342)..(342): n is a, c, g, or t
  misc_feature (473)..(473): n is a, c, g, or t
  misc_feature (475)..(475): n is a, c, g, or t
  misc_feature (480)..(480): n is a, c, g, or t
  misc_feature (522)..(522): n is a, c, g, or t
nattttttttggggganaagtttagggttgggttcnccttggggggggagcaatagttttttggtagttaaaanatcntgcaacccaaagtttttaacaaaggcccagatttgttngtaaagcantttgattnttacttggggcccgttttttaagggttcctgcgntcccacttcatctgtccntgagatgcagagcaggatggaggtctgcttctagctcagctgtttctcctngaggttgcggaggaattgaattgaatgggacagagggcaggtgctgtggccaagaagatntccgagcagcagtgacggggcaccttgctgtgtgtcntntgggcangttaacccttctgtggggccaaaggtttgcatcgtggatccagctgtgctccagtctgtcccctcctcctccactgtgactgccacgccccggaccagcagcttggggaccctccagggtactaatggggntntgttntgagatggacaaattcagtgttggaaatacatgttgtactangcacttcccatgctcctagggttaggaatagtttcaaacatgattggcagacataacaacggcaaatactcggactggggcataggactccagagtagg

SEQ ID NO: 699170 - DNA, 132 bp, Homo sapiens
  misc_feature (18)..(18): n is a, c, g, or t
  misc_feature (113)..(113): n is a, c, g, or t
tgaggatgcgtgtaggtnctgaagaaggaagaggataacaaacatatacacaagtagagatgagtgtgttagtttcctatttctggtataaaaaattaacaaaggatctagtnggctaaaacatcacaaact

SEQ ID NO: 699171 - DNA, 1143 bp, Homo sapiens
ggacgcacgcagctgacttggtcttctccgcacgaactggtacgagaggtctccaggagccttctctctcctgttgcatggatggctcatcgtcttaatggaaagatcgtctattgcgaccctagcttgcgggacaacaaggaggcatccacgtgtccaatccaagtaagattcactctgtagtggagtgtctggacaatagtttggtgtattggtctgtgtgcttaatctacgtctattgtgcgtaggcgaatacagtcatccttgggccttggagtagtaaactatgtcttcctttggttggcgtattgctttgtatgtgaaaggcactaacatgtcctatcacatacgtgtaggaatacagtcgcatcgcggaatctagcgaaggcactgggagaaggcatgttagtatgtccgatctccaaggaaactaggccttcatagaaaattcttgcttgagcgcattcactgagggacgtaattactgtcctggattggaacgcggacaccgaaagtaatacttaaaacggaatggtggtacgattgggctaacaactttgcgagtggggacgatcgcggatctcgggccaaagagacaggcgggggaagaagttcagggctttccaacattttgcttagcgataggctagggaaagaatacaattggttataacagtatgcgttccgtttgcccacaatactctctccaagcatctcaaattttccctttccaggggacttccgagatgcacacatggttacacgaaagggtcccctttgtgacgtttgtgtcaacttccaatttagaacattctcggtcttgcggtatttttcccgaaaacacccacgcaaaggtttggcgaacgcaatatccttataaaccgcttaagtagttataatcccctggggtcaaacagccttacacaggcttgtgggaattttgaacgccccgaaagtatgcgaatccccgggccgcattggcactctgtggtggaaacggtcggcgcacttagattcacaagtcctcggggggactttccttgggccctcacgaaatgtacatccgggcttaaggcgctttgttcattggcggcccttgcgaacaacaactacaccttttcgtgtggccactgtctcctaatc

SEQ ID NO: 699172 - DNA, 313 bp, Homo sapiens
aataatgtgtgccaggctgcgtgtatggcgtgatctcggttcactacaacctccgcctcccgggttcaagcgattcttctgcctcagtctctcgagtagctgctgggattacaggcgcgtgccaccacgcctggtaatttttgtatttttagtagagacagggtttcaccatgttggctaggctggtctcgaactcctgacctcagatgatcatctgcctgcctcggcctcccagaggctgggattacaggcgtgagccaccgtactcggccggatttggttcagttttattatatgggcacacattatggag

SEQ ID NO: 699173 - DNA, 177 bp, Homo sapiens
tcacactggcttgcctgagttcttcctgggcaagctaagaacctcccgggctatgcttcaatcttagggctcgcctgtcctgcatcactgggatcatctcccagtaaactagccacatttacatcctatgttctggcactttctgaaagatctaattaaacatgttgatgtgccaat

SEQ ID NO: 699174 - DNA, 193 bp, Homo sapiens
gttactgctgtcagtagggtgtcgacactctcctccacttattctgtggatgtcacagtcttttcttaggtctaggagtaattgctttaccaactttacttctgctaggtaaaacattaggtagtcttctgtcttctttatacaggcacttagctgtataaacgtttcctcttaagcgctacttttggctgca

SEQ ID NO: 699175 - DNA, 393 bp, Homo sapiens
  misc_feature (335)..(335): n is a, c, g, or t
  misc_feature (352)..(352): n is a, c, g, or t
  misc_feature (362)..(362): n is a, c, g, or t
  misc_feature (378)..(378): n is a, c, g, or t
  misc_feature (387)..(389): n is a, c, g, or t
  misc_feature (393)..(393): n is a, c, g, or t
ttttttgaggggggggtggtggttttcccccccaaaaaaaaatttttttttttttgttttttccaaaaaaaaaggcgcccccctctcttttgtttttgggtggggtattaaaaacaaaaaaattataaaacacacccccgggagattgttgttggtttttttttttataaaaaaacaaccaccaactccctcggggtgggtctcccccctcttgggaaaaaaaaccctctggggtctttctccatctcccaaaggggaaaagaaataattctttgtggttccgctcccttgtgtggccagaggcaagccaaaaatatttaaaagtctttggtctncgtaaatggccaagatnccgcctacgnactttcccttgttgangctcgtgcnnngaan

SEQ ID NO: 699176 - DNA, 936 bp, Homo sapiens
tttcggcgcgtcgtttgtgggcgtccgttgtgttgtccgcgtggagacgccgaatccaccgctggtgtgtcgtccctcttgtgtggacaccgcggggtggattccgggctgcgtggctgtttgtctgttggtcgcgcgggggggggagaccattgtgtgcaccagagctcggtcgttgcgccgcctcggcgcgttgttgggtgccgcccattttgagcgcagctgtttgtgtcctagaaggatcgagaggcggtgtgtgcacgcgtgccgtgatttctcttgcggggatgtgttttctggaccgacagcggttgtgtgcggcccgacggtcggttgcgctgtgtgagggttttggggggcgctgccgccccccaccgatttgttgagggggggttggtatttatgttgtgtcccccccgaggggcgcggcttttcatgaggctgtgtggttgtcaccccgtcgatttgtggggttttttcgggagagaggaggagggtgcgtcatcccgctttgttgaagggagggagatttttgtcagcctgtggcggccctcttcttctctggggagcagatttttcccccgcgaagtgctgtttctctggtgtgcccccgcgcgtgggtggtgctccccaggagcactgtgggtggtgttgttgtcaagacgcctggggcacaacatgtggtgcgcccactacagccgccggcggtggtgcttcccccaccttgtggggggcacctgcatgtgcccacaatgtgttttatctatctctttgctggggtcgatttttttgccaccccctgggggccccctccacgaggtggttttcccgcgggggggggttttggggggccccttgggggtttaaaattccccccccccccccctttttgtgggccccaagggggttttttttaatttatttttccccccggta

SEQ ID NO: 699177 - DNA, 686 bp, Homo sapiens
ggtatttcatgataaaccctgtcacaaggatagtagtactccttgttaagtagccatggcctaatttgaaccgttcccgtaggacatagacactttgcatcagggtacatgtactgtcagctactactatagggaggtacatggtgttacgtcagtagtctgatactaagtttgagctgatttaggccatagccgactcggcttgagagtatagcggcaagtcgtatagtctcaactctgtaggcatcactgttagtttatgaatcgtgaccagatgtacgcaagagttactatgcactaatcatgctcacacatgtatgcttcttcctctgatattgcatcacaacatcctacgagtctaatccacagccctggctatatgccaggatcttgggactgtcaaaatatgtactgatggatttatataatggttggtgtacatgtcatgtcagttagtcacaataaatccaatagctgaagctttagagttcatacaatcaagcaatttggtaggtaagcagtctcagtgttttaatactgataagaatatcttaactctcggttttcatactagcattagttacctctaagtgtgcatcacctcctctcctgtcctataccatgccctccatctgtgtagtgtttatgacagttcttgactgccatgtattatgactctgagctcc

SEQ ID NO: 699178 - DNA, 113 bp, Homo sapiens
ccgctcagagcagttctctcagcagctctaccaatttacattcccaccatacccccagtgcccagtgtgtcttttctttttatttattttttttaagaacggggctttggggg

SEQ ID NO: 699179 - DNA, 256 bp, Homo sapiens
gtcttgttacgtagcgccatggtgtcaacaggaaaaggatatgcataactttggctaatgtctagccctgaggtttgtggcatattttttgctctgagtctggtactctaagtctactagtcattactgtaagccaaccaatatgcttccacataaattcctgtttcttatcggttcacgctgaccttacattaattttctgtccatttgcaaccccagaatcctaaatatggtaccctcatggcactacttggga

SEQ ID NO: 699180 - DNA, 886 bp, Homo sapiens
agagcggtaagacatctgtggaccaaaacctagggccccacctaaagaccagcgagaaccttgggacccaatacccaatggcttggcagatgggaccaaaccaacccgtttgtcgccccgagagacgcggcccccccctctgtggagttccaaaacctgggaaggcgcaccaacagagtcacaccgtgaccacgaagaagagcctgtgccgaagactaactaacccgggtcccgcacgccagaaaatggggtgccagagaagaccgccggcaatggccgagagtccccacaagggccacgaaaacactggtgaacagccggacccaacgttttcaatctctggggaatccgtgaacaaaaaacctctcccacaaagttttaatcgtgaacccttccccccctccccttccagattatatgcgccccccttcttgagaaagagacacccatccagacaccacacccccaacttgtttgagacgcttgtgaacacccaagcccccggcccacccaagacgcccacctggaaacgtttttatggaagaattctcgtccacctttgtagaaaaatgccttccaggcctgccgataaggagacccctttttcccaaggagggttaaaaaacacttgttgccgccaaatcaaactccccttaggcgcttataactactcaccacttttaagcaatctccgccctctcccctgagaatatagagaaaaaaaattaaagactccaaagcgttagttcaatcctgtttttctctttttctgtctggtgtaaacacccccaacccccccttctcttaaaaacaaaaaatttttttaaacctttgcccctttttttttggcttccattaaaaaaaaatgggaaaaattttaaaaaaa

SEQ ID NO: 699181 - DNA, 396 bp, Homo sapiens
  misc_feature (10)..(10): n is a, c, g, or t
  misc_feature (43)..(44): n is a, c, g, or t
  misc_feature (108)..(108): n is a, c, g, or t
  misc_feature (112)..(112): n is a, c, g, or t
  misc_feature (116)..(116): n is a, c, g, or t
  misc_feature (132)..(133): n is a, c, g, or t
  misc_feature (143)..(143): n is a, c, g, or t
  misc_feature (152)..(153): n is a, c, g, or t
  misc_feature (162)..(162): n is a, c, g, or t
  misc_feature (172)..(172): n is a, c, g, or t
  misc_feature (181)..(181): n is a, c, g, or t
  misc_feature (190)..(190): n is a, c, g, or t
  misc_feature (209)..(209): n is a, c, g, or t
  misc_feature (220)..(220): n is a, c, g, or t
  misc_feature (236)..(236): n is a, c, g, or t
  misc_feature (247)..(247): n is a, c, g, or t
  misc_feature (296)..(296): n is a, c, g, or t
  misc_feature (305)..(305): n is a, c, g, or t
  misc_feature (307)..(307): n is a, c, g, or t
  misc_feature (348)..(348): n is a, c, g, or t
  misc_feature (352)..(355): n is a, c, g, or t
  misc_feature (378)..(378): n is a, c, g, or t
  misc_feature (382)..(382): n is a, c, g, or t
  misc_feature (387)..(387): n is a, c, g, or t
  misc_feature (395)..(395): n is a, c, g, or t
gtgaggcttnttgatgatggttgctgacaccatcatcgggggnnggcacacggcccttcggagcctgggcagcctggcctcacaggcagactcgcagacggggcagtnagcntctnggacagtgccaagagnncgggtgtgtnttttttcgnnaggcgtctntgcatgggtnttttagggnacaaatgtncaacaagggacaagaacancggacaccttnccgcccagcgcccctnccatggcgctngcgttcctcctccagatcgacccctagatgcctacacaatatctttaangtaacacanangtttttattttattaaaaacgtatagcctacttaaacgcgngatnnnnatatatagagtttaattttacgncccnccgcngggagccnc

SEQ ID NO: 699182 - DNA, 122 bp, Homo sapiens
actacattgcccaggttggtctcaaactcctgagctcaagcagtcttcccaccttggcctcctaaagtttggaaattatagcatgacccactgtcaggctcttttgtcagcctatcaacctt

SEQ ID NO: 699183 - DNA, 539 bp, Homo sapiens
  misc_feature (75)..(75): n is a, c, g, or t
  misc_feature (109)..(109): n is a, c, g, or t
  misc_feature (115)..(115): n is a, c, g, or t
ggattgctggcccaaaagtccccttttccaagggcctttccccaaaggtttaaaaatcattctactataaagacncatgcatacatatgtttattgcagcacttattcncaatancaaagacttggaaccaacccaaatgcccatcaatgatagacgggataaagaaaatatggcacataaacaccatggaatactatgcagccataaaaaagaatgagttcatgtcctttgcagggacatggatgaagctggaaaccattattctcagcaaactaacacaggaacagaaaaccaaacaccgcatgttctcactcataagtgggagttgaacaatgagaacatacgggcacagtggggggaacatcacacaccagggcctgtcggggggtgagaggcaagggaagtgatagcattaagagaaatacctaatgtagattatgggttgatgggggcagcaaaccaccatggcacatgtgtacctatgtaacaaacctgcacattctgcacatatatcccagaacttaaagtataattaaag

SEQ ID NO: 699184 - DNA, 239 bp, Homo sapiens
cacctggcggctctaattggaaagcctaccgcccgcgctctcatggacctcctgcagctcacaagggaggagggtgctgagggcctgccatgggctctctctgtcactatgtcctacttagagatctaccaggaaaaggtgaggctcttttctgatcgaggaatggaagagacaaagggttaaatcagacttagttgtagaacccgtaagacataaccgcccgcggttatgtcttacgg

SEQ ID NO: 699185 - DNA, 315 bp, Homo sapiens
ttacattcacgcaaatgtaccaggcatcaaagaattggtaccaatcctattgacactatttcataggattgagaaagagggaaccctccctaaatcattctatgaagccagcatcaccctaataccaaaaccagaaaaggacataaccaacaaaagaaaactgcagaccaatatccttgatgaacatcgatactaaaatccttaacaaaatactagctaaccgaatccaacaacatatcaaaaatataatccaccgtgatcaagtgggtaacataccagggatgcagggaggtttaacatacgcccaggtatgca

SEQ ID NO: 699186 - DNA, 956 bp, Homo sapiens
tttgtgtttgtgataaatctggattaaaacaattacctcttcagtgttttctcatgcaaaattttcttctagcatgtgataatgagtaaagctaaaatctattattcatgcttttctcaattaacatttccggtagtatacttcagagtgatgtaatctaagtttaagtagtttaagtatgttaaatgtggcatcttttacaccacatcacagtgcaacacactggggagacgtgcttttttggaaaactcaagaggtgctagctccctgattcaacagaaatatttctcatgtttgttgcattctaggtttatattttccattcaagaatcctttaggttaagtttaagcttgttctaaaacgtctagtctttggagaagttgacgacacagagtagcataactactcgtaggacacttggtgacggccttgtagcttatcaacctttcttgtgatactgtgatgttccctctttggtgtgctattttgcgtaaggtgacacctatgttaaagtgtttgtcgctttaactaatagtttcttccccttaagaagtaaatagactttcttgcagcagaaatagaaagacatagagaagacccacaagacagaacaacggaagatacaagataataataaggcaggcgtgatccctgtgaatgttcagccgcgagcaggcggtgtagtgaccaacctccatttactccatctaagctaagacaagaagaatgtggccatacaatccggatgcggaattgcttgaacggcaagaatggcagtgaggcctcttgggatactcggaaatgtgggcccgggtttaggaaaaaaaacgcggtcactcggatggagacaccttggactaataagagccccgtaactgggaagcgccatgatggaattcccttgacggctaccctactcctaacaacttgctgcagacctcttgacaactattca

SEQ ID NO: 699187 - DNA, 272 bp, Homo sapiens
ggctcaagggatcctcccacctcagcctcccaagtagctgggaccacaggtgcgttccaccacagctggctaatttttttggtagatggggtctccctgtgttgcccaggctggtctcaaactcctgggctcaagcaattctgccttggcctccagaagtgatgggattacagaggcgtgagcccctgcacccagcttaacatgacttcctaaaatcagattctgaactcaaggtttgttaactttcgcagtttagtcgacgcggccgcgaa

SEQ ID NO: 699188 - DNA, 232 bp, Homo sapiens
acccccgtcctgattgccatgtagttctgatacacagtcccaagcacgcatgaagtcttgacactgagagcttgtcccggagctggtacctctctgtcacatccccgagcggttccaagcgggcacggggggagcgatggtagtagagctcgttaaattcatccatccatacttcagctggacaaacactgttggccagagccttgtggcgggattagggagcgtgcttggg

SEQ ID NO: 699189 - DNA, 255 bp, Homo sapiens
  misc_feature (196)..(196): n is a, c, g, or t
gaacagaggcgtatgctgtttcagcaattaagacaacatcttgagatggaagcttcgtcttctgtcaggtgaagtggaatcacagatggacggggacaaggggaagtctctcctcatatgaacactctgcatctgcagagatggaaaggtgctgcattaggaggaaagtcactgggaggaaaaatccaccaccagnaagggtgcagggcgacttttggcggcaagaattttaacaaggccacggtccatgacctc

SEQ ID NO: 699190 - DNA, 401 bp, Homo sapiens
gctaaggggtttggatagactctagctccagagcagttagagactgcagaaatcacagaagtgtggagtcattcaggtgtcccttagagagtgatcatttccctaattgaaagtacagggaggaaaagttgaaagacaagaaatgtcacattctctgtgatttactgttgcccaattccctctcccctttttcagttctttcctcatcatcatcttaccttcctctataccaaatgcaaacttattccaaaactttcatgcagccttatttattaatgtatcttccatacctaacgtatcttcagcatagtatatactcaataaatatttgttaaataaaatatccaacatagaattctatatgaataaatcttaaaatcttggagaaataaaaaaaaaaa

SEQ ID NO: 699191 - DNA, 901 bp, Homo sapiens
tccgtgtacagcgccctgtatcctgccgtgatgcagagcagcctgcgccatgccccaggctgcgtgccccccgagccccatccccggaagcctgacgtgctgcggccctcgctgacctccattgctgctgtccccgccgaccatctgcagctctgcggagccacgataatacgacgaggcgctcgccgcaccgcgatcacgcatcagggccacagtcgagagaaaagtcgacacccgagcagacctctcaatcactagcatacgcacacacaactgacacaccacaagacagaacaacaaagaacacagaaacagagagggatcataacaacaggaagcgacccaaaggacgaagcgccggaccaaccacgaacaggaccacacagcacaccctccgagacgactgaacacaccgaccccccgacggagacgaaccagcaaaaggcacgaaccaacgaaaaacagagaaagaccgcgcgcccgcaccgccaccaagcccgtcacaggagcgcgaaaaacaccggaacggagaaaacaagaacgaggccacacacaatgaacacagaacacagcggacgagcaaaacggcagggaaagaccacggacagggccaaccagcgcgtagcgctacaaccagcagcacaacaaaatgcagacacacagggccaaaaggggcaagcacaagaaaagtgacgcgcacaagaaccacacgagaaaaaagagaaaagaacaaacatcaaagaacagcaaacaaacaaacaaaaaaaaacaccgcgaaacaaagaagccgaaaaaccatcacactaaaaaaaccaacccaggcaaaaaatccaaaccaaaaagaaaaactgacaacacgaagactacacagacagcacaaaaacaaaaaacacacaacaag

SEQ ID NO: 699192 - DNA, 140 bp, Homo sapiens
ggctaagcccagggtgcgggatgggccgcgcatgcacaagttacgtcagcagcaagcaggtcttgcgctgggtccctgcggtgccagtgaactccaggcagatagcccggcgtacacgaaccacattctgcgtcgccctt

SEQ ID NO: 699193 - DNA, 153 bp, Homo sapiens
tattgagctggtctgcaatgcaaatggatacctactccacttatacaatggcttaaagatggaaagcccatagctcgtggtgaaacagaatgaatccgagtgagtgcacatggcagcacattaaacatttatgagagctcttacatctcgaca

SEQ ID NO: 699194 - DNA, 356 bp, Homo sapiens
cgttatgagagggagagggaaggtgtatgtggacttgacgacgggataggctgaggctcgtgcttcctcctgccaatgcccatttgaaagcacctggtcccccttcagcatcccctgatgtcctctgttccctcctgtgtatccagtgggcaattacatgagcagtgaagaggaggtcacggctggatgggaggatggggtacttgagagtactagggcctagaggacacagggagttgatcttagacacgaagcgaggcaacaccttttgaactgagaaggaaggagctgtcctggcgaaaccgtccgccacaaacgagctccgcatttagggcgtcatgcaccaggcaggcccc

SEQ ID NO: 699195 - DNA, 304 bp, Homo sapiens
tgtgtcagggtgcagtgagccgagatcacgccatgcactccagctgagcgacacgagtgagactctgtctcaactacatatcaacaacaacaacaacaacacttatgctggacatggtgatgtacctgtatgtcccggctaccagggaggctgcaggtgggagaattacttaacgcctgggatggtcaagcgctgctagtgacgctgtgacttgtgccatctgctacccatgccttgtgcgacatgagacccgtgtctctaacaaaaaattgacaaattcacgtttaactttgctagcttatca

SEQ ID NO: 699196 - DNA, 646 bp, Homo sapiens
  misc_feature (83)..(83): n is a, c, g, or t
  misc_feature (108)..(108): n is a, c, g, or t
cgggaggccgggccggcgggctgcgagcgcctgccccatgcgccgccgcctctccgcacgatgttcccctcgcggaggaaagnggcgcagctgccctgggaggacggnaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctggcccgcgcgtgcgcccgggagccgcccctgagcactgggaagaagacgcgtcctagggggcacacgcaagcgccagggcggaagctggtgcccataccgcggaacgctctcgaggagctcctgggtcttcgtgccccacatgcgccggttcctgaggcaggaagaaggatccggacaccacatctacgtgcgcaaccaggtggaccacttcaggttcaaccgggcagcgctcatcaacgtgggctaccaggagagcagcaaccagcaacggactacataggcatgcacagacagaagacctgactcccatctcaacgaggagctggactatggcataacctgaggctgggcccaatccaagtggcctccccg

SEQ ID NO: 699197 - DNA, 814 bp, Homo sapiens
attaatcccctggcccaacccgtcatctactctaccatctttgcaggcacactcatcacagcgctaagctcgcactgattttttacctgagtaggcctagaaataaacatgctagcttgttagttccaggttctaaccgaaaaagaagtaaactctcttcgttccacaggaaggcgtgccagtcaagatatttcctcacgcaagcaaccgcatccataagtccgttctaatagctatcctcgttcaagcaagtatactctcctggacaattgaagccagtaaccaagtactaccaagtcaagtagctcagtcattaataagtcagtaatggctatagcaataagaactaggaatagccccctttcacttctgagtcccagaggttacccaaggcacccctctgacatccggcctgcttcttctcacatgacaaaaactagcccccaatctcaatcatataccaaatctctcgcctcactaaacgtaagccttctccatcacgtctctcaagtcttatccatcatagcaggcagttgaggtggattaaaccaaacccaggtacgcaaaatcttagcatacatcctcaattacccacataggatgaataatagcagtatcgtaccggtacaacccgtaacataaccatgcttaatttaactatagatataatcgctaagctagtaccagaattgcctacatactcaaggttaaactccaagcaacaacaagccctacgtactatctcgcaactgaaacaaggtagcatgactaacacccttaattgcatccaccctacatttgacctaggagggct

SEQ ID NO: 699198 - DNA, 1531 bp, Homo sapiens
  misc_feature (937)..(937): n is a, c, g, or t
  misc_feature (1058)..(1058): n is a, c, g, or t
  misc_feature (1095)..(1095): n is a, c, g, or t
  misc_feature (1117)..(1117): n is a, c, g, or t
gtgctgccgtccgtctctcgtgtcttgtgtgtgccggtcgtgccgttttgctctctgtccgttcgcgtgttcctgcctgttctgcgtgttggtctcgtcggctcgttgttgctgtggtgttgttctgtcgtgctttgcctggtcggcgtggtcgcgccgttcgtgcgtggtgtggtgtggccggccgcctcggtcgcccctgcgttgtgtcgccgctgtcgtctgggtggttgttttggggcgtcggttggtctcggtccccccacgtgtctcggtcgttggtcgcgcgctcgttggttgtgttggtcgtgtttgtcgtcgtactggcgggcggagggggggttctaataacccaggaagttccctgttttaggtggaccccctttccaggttgtccccctggggggaacccccgccactccccccccgtggtgttggacccccccccatttagaaagaccccccggggcccccgatgtccaagcctctccggcggactctttaagccctttaggccccgccggggggcccgggaattaaacgagagtgggtcaaacagcacggggtaaccacagtctttattgtgacccccacttttaggcccctctaatttttaagggtgggacacactattagtgcacccagggttttgcgcccccaaaatagccctgggctttgggtatccccggttctcccgggattttctccccggggagtaatctgtcttgagcaccacacggcgggttctctgcccagcatgtcttgtccccgctgacccggtgccacccctttattggggccgcgcttgtgcccgtccccgccgttggccacaggccacacacggcacttccctcgagggagcactctttcgcgaggcccccggagagccacagccctcccccctcttggggtgtctcggccttttctctcgcgaagngtgtcccaactgtgtcacccaccgagcgccccctcttccactgagtgttctgacccccacgcgagtattttgtgttctcctctaaaaacactccccctcgagagtgttcacccaccctctnggggccacgaaaagtttgttttctcggccacgagacnccacgcttttgagaggaggagnccacgagcacccccatcgccacgagaggttctctggagaagaaaggttgaaaatgaagagtgagttcgtcccgccgggcccctattggcacggccttctcttgccccttggtggcacctcttggccacgcccgcccacgctggagaaggtggagacctctctcgagagagacctcgagttcttataattggagaaatgtgaactatgagcctctgcgctgtggagagagaattcgagctggagaaggtcctcgctggttggggcacgacaaacttcaccgcctggcttggccaagccacactcctcggagaaaggagttcttgtttcgagtatgaaagccaccacgtcacttgaaaaagaaacgaaatcctggcccagaatccttatgagattccgggaaagggaaaacttcca

SEQ ID NO: 699199 - DNA, 328 bp, Homo sapiens
aagattgcctgcatacactcggtaaggacacatctaggagcgaggcctgagcagacagaggggggccccgctgctcacggcccctacccttcctggcaggcacccctgctcactgcagacaggtgttccatggacatgtaattcctgcaggactggggccttgggcagggccatcaagaaggtatcactacaggtgaactaatccatggaggtcgtgcgaggctgagcttaccaggtatatcagaagaaactgggtcccatacacccagtcagacaagaggcgccaagtgagagggtggtcacacgtcaccaagctctgtggcttcag

SEQ ID NO: 699200 - DNA, 768 bp, Homo sapiens
cttgttttttcttttccccctttttataacacggctacccaattgtataaaccataaccctttatggttatccagaacaaccataccgatttttaagtgcacacacttatttagtaacttccgaagggaatcccccaccaagattttgtcaccacaatataacaccaggcgtttgtgagataaccgcaccgggccccaggttaacttgatgacaccggttctcttataggtttaatccgtagggcacctgtggttgcgccgaaattctcggcccacagaaggacctcgccatttgagcgccagaatagccatatgataatatgttgaatagtgagacactcggtgccacactcgttggggttagcgcccaccttgaagattggtgtgtgtgagatgcttgtgtggctgtatgccaacaccagtgtgtctggggatatgattgagaccctcggatgtgtgtactcgccaaaatgtggaaatatggcttctcgctgtatatgtctgctcggaatggtgggtgtaaatggaactggaaaattgcccagtgcactgcttggggctgtagactgcctaccgtgtgtgttgtaaaacttatagtgggcccatccacccaaattgtagtgtttttgtgacaccttgaattttcgttgccacctgctgaaaatggaaggtaatacttaccttaagtggctatgtagaatgaagatcatgggtatgaattgttggtgcttcttaagaaccagccccaaattaaattattttccaatt

SEQ ID NO: 699201 - DNA, 668 bp, Homo sapiens
cacaactgtagtcccagctactcaggaggctgaggtgggagaatgcttgagcccaggaggtcgaggctgcagtgagccatgaccacaccactacactctggcctgagcaagagtgagaccctgcgtttaaacaaaacaaaacaaaaacaaaaacacaccaaagctaaaagcttctctgtgatttaaaagatgtagaactagaccagcctgtccaacatggtgaaatgccacctctactaaaaatacacaccaaaaaaattagtgtgggcatggtggcacgtgcctataatcccagctactctagagatgctgaggcgggagaatcgcttgaactcgggaggtggaggttgcggtgagcccaagatcgtgccactgcactccagcctaggcgacagaatgaaactccatctcaaaaaaagatgtagaacctagataggcctgctcattagaatatcaagatggctccagctgactttctttcctaatttatatgtactagtggctttactcttaaatagtttccttctgaaaactaatcatttggaccagcttatatgtggtcgggcgggaaagggacacgtgttatctgtaccagtgccaaatatcctatcaaaaacttggcacaacgtgtccaactaaacaaacaaggacaataacacacaccttgg

SEQ ID NO: 699202 - DNA, 852 bp, Homo sapiens
agcgggggggggatgttaaaacacatgcaaaaaaaaaaaaaaaaaaaaatttggtttatataaccatttaaatcttttataaaggtttggaaggtccaggtttgaattgctggcagctggtgaagcatacataaataaatggaagtaaagccaataacgtggatttaatttatggggatggttaatttcccctaaagacctggaaaatggaacatagtatggctaagtaattttccagtggttagcctttaactttcctcacacaattgggaatcatataatatagggtaccttgggtccccggattaaataattggtgacgggataagaatggcttcaaggtggtgttattatggaaaaggaggtgggaaaaggtatataggctttaagcaaagggtggttgggcccattctaagaaatggagcgaatatattagaaattagtaggggcattttcttcccgtgtaagggggaggtgtatgggtgtggacattttcttccccaaatttctttcccacttcgtggttttctccccaattatttggaattacaggggtgactggctgtgaagaattgacctttggaaactccttatattcgcactataaatttaggtgtttacaagaaaaaacccgtgtacgtggacacgggtgagaacttcttcttcccataattttcacggttaaagagcaactttgaagaaggatgtggacaaaagattaaaaagtgcgctattagaaaaaggagacaagggggccacaagggggattgggcccaaatatttggattcttttttgaattaaaacccttccttggggggtttagaagggaatggactttagcttacattaac

SEQ ID NO: 699203 - DNA, 136 bp, Homo sapiens
acacatggaaatggctcgcaaatcaacttcttgatgcgaaagaatcgagcagatccgtggcaggctgctgagcgctgtgtgtggcacacatggtcgcgaaacccttccattcaagtttctttcccaacctttttcc

SEQ ID NO: 699204 - DNA, 668 bp, Homo sapiens
cggggttcctaaagttgaccatcccattttggcgcagactattaacataagtttactgggtgaacattatatagccctcatcacgacgcaatcacccaacatcactaacacttgaccacctacattgatcacttaaaagtcacacagaccaactatgtgaaaatcaatgactgccttaacgtgcttaccaagaacaacgatctacaagaattactccacccactcactagtactacgaataaccctgtgaaccctctcaaacacgcacacgcgctcaaccgatgcatgagccgggtaccatgcaacgactacagctggggatcccacataccgccaacagacgaacaccgactttctaacacattacacgctgaactgctcccagctctaaggagaacactccatgcaacatctattatccaataagcgaagtaccagcatccagtttgctctgaccttgaaccatgctacgctactgcgtaggcatgacacttaccgcaaacggagaccagggacacccctagaacgcggattcttgcagatgctacggttctattggatcaaacgccacctaaggtcccagtctagtctcaaagacaatagtccacccaattcaagaaacataatatccgcatttacccaagtgttttctagagccaccctcgata

SEQ ID NO: 699205 - DNA, 960 bp, Homo sapiens
  misc_feature (547)..(547): n is a, c, g, or t
atccgagtgcttatgaagtaatgctgagtgaatcgggtaggcatggagctcccggagtgtctggcatgagtaaagaaggaaaaaccgacggctctcgggactcgagataggcgtctctgactcatggtcgtccagaagctctggacaggggtgatggacattggctcgaattccttactgtgcgtggtcgcacacgagagatggcgaggcagacacgcccattggttccctgtgatagacagaggtcctcgaagatcatagcaaaaacatgaagtaaagagttcttgcatcgcatgcgctcgccgtatcgaagggacactggccctaataagggaccgttgggctgactgtcgcagcacgagcatcatcaacatcgacagtcggctggtaccagagaattcgctccgcttggacgcgcctgcgagccatcctcctgagtggggagacagagggccttccactacaaaaacgagcacgaccacgtacccctaccccttcccacagatgattccacagtgaaccaataggaatacggctcgtccttggnttctagtacaccagggtctccgggaggaacgaattatcctggccgcctatggggacttcccctttccgccgtctgaattctaccccaatattgccaagaaagcggctaaattacttctagtttgacgaaccctattctcaccaacacgaggtggcgttttggcaagacacccgacttgacaccccttgggccaagtgaacctccataatgtgttttggcctttctagtacccaccgtgggggccccctggtgcataacccaaatgtctgagggtggtatttctcctccaacagcgcccaagttagccaagggaaagcgagaggcttgggggtgagacccaagtcaagagggaacctccacaaggtatgctggggcctatgcaacatggggaagtcagcattcgcaaagggcgg

SEQ ID NO: 699206 - DNA, 1072 bp, Homo sapiens
agcggatgggtgcctaaggatcatgtctgcgaaccaggatacccgatccacacagcgatgggccccgatggaactggaggcgccgacaggcgtcatcgagagtagaacgtaggcacatgacgattgtcgagagctgtagatgacgtgaatcctcatcgggagctcagcgtatcgtacgctggacatctacgacctatgagtttcgagaaggccctctggcatccagcaggcgagcgcagttctaccgttggtactcaacggcgttaatgagtgtgagttgctcgaagcgccaattcctgggaccgtggggagagaagaggctgaccactttgctcagtatctgacttcctgtcagcatgatttgacatatagaatctatacatgccagcccagtgccttggtaccttaggcaccaatctgcctagaagtgcgagcctcaggcagaagtacaggaagagtgggtacatgggcaggtaggagcacgtacagtggcgtcgaccttcactgtgcgaacgcgctgtacttcggggggtcgagccacacggtgcggttgcctagaggttgccatgacaaacttggcgatggatggggaaacgacttccgccgtcgatcccatccgtaggtgcttaacaccattggacccggtagatacgctatagcatcattggctattgaacccctgcgacagaatcaacttggtaatcctcccaaaaaatgaacagttcgaaagacattgctcgaggtcacctcgggggactggataggccttgggactcggaaaccatcgttttaaacgacccgggtggggaattttcacagagaggaaccccaaggagtttccttagattggaacacattaattcttccgcaagacaagcaagccgttccaggaccgaggacaagaaccaacagcccaaagggataaaggatgttatgggccgttgggtcagaggcccccaagaaaagtggccaccgtattccattggacttgggtcggccttcttggcaagaggttgcgaaccccaagtaggaaacagggcttcacaagtggacaaggggaggaagcaccccc

SEQ ID NO: 699207 - DNA, 914 bp, Homo sapiens
gagtgcgcatccggacgtaggaggtggaggtggtggcattcgccgttcgaaagcagggactaaaagccccacttcgtcttacgttccgaaaggaaggcgtcgtgttgagcctttctctgcagtgcgtgagggaggcgtcgacaggcgtgcggaatgtcctgagttgaggcttgcgggatcctttccggagaaagcgcaggctaaagccgcaggtgaagatgtccaagtacgtgaacgacatgtggccgggctcgccgcaggagaaggattcgcgcctcgacctcgctggtcgggcgggtccagccgagtgtcgtcgcaggtcttaggagccagctcttttgccagaagcgtctcaggttcccaattcccgggtctcgagccggtgttcgtccaggagtcggaggagcaagtccaggtcccggtcccgaaggcgccaacagcggaagtacaggcgctaatcgcggtcatactcgcggagcccggcgcggatcccgaaagcgccgttaccgaaagaggcgctacgggttcaaccaggagatactaccgggtctccttcgcggtaccggtcccggtcccggaacaggtcgagcatctcggggaaggtcgaactggcggaaagggcgtacgcgatcgcgcgggggacagcgacaactacgactatgaggcgcacaagcgtacccggaggatcacagcacaatggggagggggccaagggtcccaagggacgaagggtcgcgagacacaaggaacccacacaattatcggctaacgttagagacaggatccgaattgagacgcggtgcgaaaaataagccagacaacccactggaggggaaaagccctagggagacacagcacagacttcgacgtgccacgcaaggacacaagaactggacctcgagccaaggaacgcg

SEQ ID NO: 699208 - DNA, 192 bp, Homo sapiens
  misc_feature (11)..(11): n is a, c, g, or t
  misc_feature (13)..(13): n is a, c, g, or t
gcatggtggcnantcttcagtccagcacgtgggagtctgaggcggaagagttgcttgagccaagagttcaagaccagcctaggaacaaagtgagaccccatctcactttggaactcaggactgcagtaagccatgatcataccactgcacttaatcctgggtgacagagtgagaccttgtctcttaaaaaaa

SEQ ID NO: 699209 - DNA, 141 bp, Homo sapiens
cggatcccccgacttcttgacgggtgctgtgtgtgctgtgtgctcatctgtgtgctgtgtgctgtgcgtttgtgtgtgtgctgtgtgtgcatgtgtgtgcgtgtgtgtgccgtgcgtttgtgtgctgtgtgtgcatgagca

SEQ ID NO: 699210 - DNA, 326 bp, Homo sapiens
cggtcagtttactgtctatataattaatagaaaccagctctttatctccattcaaacatgcatcacgtttaaacgcactatggcatcctccaacctcagctctagtctacacaacactgcagtgtacagagcagctacaatgcccgtgataggaagcagtctgcattcacagtcgcaagcttttgacatctagagcgcgcacagacctcataacctgtatagagacttcccctaccaaagctgactagtctacatcacaacaacacaaaaacagtaaacaacaacaacacacccacaacatggacagaaatgacataccttaaaac

SEQ ID NO: 699211 - DNA, 198 bp, Homo sapiens
  misc_feature (35)..(35): n is a, c, g, or t
atttgctttaattttaaaaaaaaatttaaattttncttttttattgctgggttaaaaagattcagattatccctggcctttgaggaaaagttttttatttggagttttttggaaacagttttagtcttttaacttggaaaaaagagggattaatccccccccttgctttccaaaagccaataaagtggtttcccccga

SEQ ID NO: 699212 - DNA, 1573 bp, Homo sapiens
actagttctagatcgcgagcggccgccctttttttttcataacttatgtttttatatggttgcattacgccaataaatcctcagctgggaaaaaaaaaaaaaaaaaaaaaaaaaaaaaaaaaaaaaaaaaaagaaaaaaaacaaaaaaaaaaaaaaaaaaagaagagaaaaaaaaaaaaaaaaaaaaagtgagaaggagagcagcgaaagagcgagcgaacgaagacgagagaagagaggaggaagagataaagtagagaagacgcacgcgaggagaggaagaagagaaaaaaaaaaaacagaaagagcaaggtggcacacaaacccgacgaagagcagaggaaggcacacaccagaccgaaaaaaaacacaggagggaggtgaggaagagtacgagaagagaggggcaagacagaagaggggtgggagagagggaccgcagccggagaggcgatggaagggcgtaacaacagaagagagtgaagagagagagcgacgcaaaagaaggaagaaaaagaaaaagacacgcgacggacagcgccgaccgagggagaagaaaaaaaagagggcagacagggggcgaagcaggcgagataccgaagagacgacacaagagagagagagtacataggagaaccaagacgggaggagaacaagaggtaagacgagaaagaggaacgagaggaacgagaaagaagagggaggggcgcgcaggagagaagaacacaagaagaaaacacgatgaagcggaccagacgaagaggagaaaaaataaagaaggaaagacgagatagagcgagaaagcaggcagagaataaaacgagacgaacaggcaaaagaggagacagagaaaggagaacagaagaagagggaaggaaaggaaagaagagagaagaaagagaggagaaaagaacgaaaagggagcagagggaggaagagagaagcagagcggcgacgaagaggagcacgaaaaggcaaggcaaaagacacagagcgaagacgaaggaaaggagaaagacagggaagacacgtgagaaacgaagaggggggacacgagagagggaagggagaggaagaagagaagcaaaagacggacagccaagcgagagctagaaggagagagcagaagagaaccagagagaggaagaggaagagagagaagagacgaggaacaggaagagagaagagaggggcagagagaatgaaacaggaggaaaggacggacagagaggaagaaaagaagagagggacaggcgacgacgaggacgcaagcaaagcgagagagaagcaggaggacgggcgggagagagagcgggagaggggaggggaggagcaaggccgatcgcaggccacggagcgaggaggcgaggaggagaaggcgaaagagagagggaaggagacgcgcatgagaagggagacgagaagaggagaaggaaagagcgatgaggagaggtgagagcgaagagcgacgcaaggaagacggaaggagctaggagagaggagagaggatgagaggaagagagacgcgagaaagggagagagaaaggagagaggaaggaaggggaggggcgac

SEQ ID NO: 699213 - DNA, 1178 bp, Homo sapiens
  misc_feature (267)..(267): n is a, c, g, or t
  misc_feature (310)..(310): n is a, c, g, or t
  misc_feature (342)..(342): n is a, c, g, or t
  misc_feature (370)..(370): n is a, c, g, or t
  misc_feature (405)..(405): n is a, c, g, or t
  misc_feature (553)..(553): n is a, c, g, or t
  misc_feature (605)..(605): n is a, c, g, or t
ggctgaggatgccgagtgggacagatgagtccgccgggaggacgtacctgtgtgctcccggccctcagctgtgtctggatgcaattcagtgagcgcgtgatacgaagaagtgcgtgagatcgccctcgttccgcaagacagtgcctttgataactgttccgcggtcactttgttgtacccaggaaacatttcctaccgaacgcctagatacaagaggtaaccttctagccctgcgtttaagctggaaagtgcgccctcccgtctcantactgagtgtgcttgtggaaggccgaggcataggagtgctcanctacctccttatgtagaaggcggagcctgtanaccgtctgcacgtcccgtgggcgttaantctattaccccatgatgtcgagcacgccacggcgntccttgtggcaatgccgggtgcataggagcgatggtcgtgagcgttgcatgcccctgtcgtttaagggcctgcgcactcgaagcatacggttgaacatgaacgccaagatcgcacccaaacacgtccatgggacgataggaaggccancatgatgtgattgggggaccaagtgagcgcggccgcatcgcaatggcctgcnttcgcgaaacaacggcgcggagaacgggttcctcggaaggtacatcgaaggattcaaacttggtccattgctgcattccatggacgattgaactcatcggatccaccccaaccttgcgttgggatcgcatcgagaaggagataagctccatccgttggcttgggttcatttggcactaagcgacagtttgcgagtccacttgtgcaggcattggtctcgccttgtcctttggcgtgccacgtgtggtcgaaggtctgtgggggtcaccatatactgcgagttactccacggtgagaggagggcaacgatcgaggttggacggtcttaagtaccatctgagaaaagacccatgctagcaatattgtctgctattgaatagtacgagtgaactcctagacacttacgggtgacccttggtgtaagcttggtcgcaacggttatcaggacgcaattgtcttggtgacatttccgagtgggactcttccggcactcggggtcggacaggaccttagccctaatgttgagggcgcgccgaaacaggcgaactgaaaggcgtggtaatagctttgccag

SEQ ID NO: 699214 - DNA, 291 bp, Homo sapiens
cgtgtgtgattagtcagtgtattgatgcatgaaaggcaaccttagaggccaggcatggtggctcatacctgtaatcccaacactttgggaggcagagcaggaggatcacttgaaatctggaattcaagaccagcctggaaaacatagtgagatcccagtttctgcaaaaatcaaacaattagctgggtgtgatggcatgcacttgtggtcccagctactcaagaggctgaggtgggaggatcatttgagctcaggagttcaaggctgcagtgagctatgatccactgcact

SEQ ID NO: 699215 - DNA, 88 bp, Homo sapiens
  misc_feature (51)..(51): n is a, c, g, or t
  misc_feature (78)..(78): n is a, c, g, or t
tttttgcaccagcagttgacttcttgaatgtatagtcctcaaagccgctgnagaaaaaccatgataaaacatctctcnctctatcgct

SEQ ID NO: 699216 - DNA, 323 bp, Homo sapiens
ccctcgagtcctccgatagtcatgcatagcctttgcacaaaagacagctccctataaaagggttaaatggagatcttttggtaacacaagccatgaatgcgagtttgtcttaccctagccctctggaggccatgtttgtagcattcagaataggagctttacaatttttcagttctccaaaggaaggcatatacgtgaccgtgtatttgagcataattctagcaaggttaagtaaggggtaaaaattcttcatttgaaatatcccccgtatacaacccagacactctcgtgtagtctcgtgtccccatggatacgcatgacct

SEQ ID NO: 699217 - DNA, 661 bp, Homo sapiens
tttttgaagttttgttcttacataaacaaaggttaggggtcaagtgatctaaaactgtctaatctcagatgttacgaagaaaaaactacaaagaagaagtcaagagtcatatgagagtcttaatagtagtagaatcacagatgcgtgtaatacaagatgagtaactgcgacatggcggacaagatcgaggatgactacaaaacatacccacccagaagcggtaacgtccaacgaagagagtccgaaacaaacaaaaaactggagcaccctaaacgaagcacaacgcacgcctcgcaatacaaccagcaaaacttcgcgaaaacacccctagtcgcaactcactacagcactacagcgacacgccagaaaccaacagcaacccagtccacgcccaccacacaaccacggcagctaagtagcactcaacctccaaagatgcaacaactacccgcggagaactaaacaaagcgagaacaaccgaagaaaccggaccaactaccacaaccgaagaccctcccacggcaccaaataacccatacacggactctgaaaaaggccagcacacaactgcgcgataaggacaaaacgcaagttcacgggcaacacaattacaaccgaacaggctcacacacacaaaatccaaccatctgaagcccccccg

SEQ ID NO: 699218 - DNA, 114 bp, Homo sapiens
tctgaatttttcactttcagtgcacaaataccattaccatcaagtcataatgcagaagtaagaaatggctttgtctagacaagaaatgcaggaagttcagagttctagagagcg

SEQ ID NO: 699219 - DNA, 696 bp, Homo sapiens
  misc_feature (25)..(25): n is a, c, g, or t
  misc_feature (616)..(616): n is a, c, g, or t
agcgcgtcctcacccccacctatgntgtttcatcgagagcaccctcacccgcctcggcaagacggtgcgggtattgaccccggacctgttattggtacgcgataaacaggtgttgctctacagcgtagccggcgcaatccaggcgtttgattcgctggaggcgttcagccaggcctgggggagcaggatgcaacgcgagtttcagttcgacagcctcacttggcaacgcaacgaaactgccgccaacgtgtttgaacaacaggccgggctgatcctcaactaacaactcgaagacctggcagccctatcgttccaggggcaagacgaaaaagaactcgatcaacgcctggacatgatcaccaacccggccaggtattttaccgacatcaagttgcccgacaccgagcgccttggcactgtgagccagtaactgccgcaatggctcaagcaagccgagcccgcggatcgtttcgcctatcaccgccacttgcaggatatggcgcatgttctgcaaaaaaaccaggggcgatcgttcaacgagggtattgaaaacatccacacattcagccgcagcgcattgcgcaagcagatgcaagccgatcacggcggtttcgancctgatgcggtgccgttggactttgccgtagcggcaggtatccggcgcgcgggatcatcgagcacgtgcgcatgtgccgt

SEQ ID NO: 699220 - DNA, 356 bp, Homo sapiens
gtgcggagcatcataagatcaccagataagtggattctcttttgtgcccacaaagatctttctcactttgcacaacttgtactttgcctcctcaggtgtaatacgatcttcagcatagcgacccttgggtgtcattgatcagtacggacattcgtctcccggtgcttgtctatgctgatcacctccataaatccagcaagggtcagttatatctgttcggaccttgccatcatttttgttgacccactgcgtgtcccctcttcttttcttcctctcctgtcggggcatactttactctgttcctccataaaattataagagggagacactctctctacttgtgcagaccggctcgg

SEQ ID NO: 699221 - DNA, 280 bp, Homo sapiens
gtgatagcctgggggtctggcagtgaatgggaggcatccagaacgagaaggagacatgcaaagcctgaacgaccgccttgcctcttacctggacagatgtgagtgagcgtggagaccgagaaccggaggctggagagcaaaatcctgggagcacttggagaagaagtggaccccagtgtcagagactggagccattacttcaatgatcatcgatggacctgagtggctcatgatcttctgcaagatacgtgtggacaagtgccctgcatcgtatcttgca

SEQ ID NO: 699222 - DNA, 816 bp, Homo sapiens
ctgccgatcttggtctatttgtgggggagaaggagaaactaagggaaacaatgacactattttgatattatttatctttaggtgctccaataattcttgcaatacttaacatgtctggaaacatagaatctttgccatttatggaaaatatgaaaaataaagctaaatttagaaaaagtcacatattctaataaaatatactaagggaattagttctggccataagataaattgatcacataaatctccagcaaaatatattaatagctacagtaaaatccaataaaacaaaattagcagctttatgcctcggggcacattcaacttctcttacagatcccaacttccagccaccattttcagctcaatgccctgtctctctgctttaaaacgcattttgtttttaagagatccattttttctcaaataaggaatgtttgtattagaaatgtacaaatgttttaaattagcatttgaacaaataactagagaaaaacttacatttacttgcctttctatcatttgtagtttaaaaatataccaaaacaaaaataatgtttttaattctggaagtaatgttcccataggcatatctactaaatgaaatattataatgaagatattttgccaactcttaaagtataaaatgaaaggcagaattgtcattttatttgcaggaaacacttaagacagagattttgtaatataagttggcaaacaaaacattactaactgtcctacaataaacgttgtagttaccaaactttgatatttttaaaaacctctttggctgtatattgaaaccaccattctgct

SEQ ID NO: 699223 - DNA, 317 bp, Homo sapiens
gagattttcccaagctttcttagttttaaatatatctgacatgggccgggtatggaggctcacgcctgtaatcccagcactttgggaggccaaggcgggcagataatctgaagtcaggagttggagaccagcctggccaacttggtaaaaccccatctctactaaaaatacaaaaaattagggcatgatggctcatgtctgtaatcccagctacttgggaggctgagggatgagaattgcttgaacctgagaggcggaggttgcagtgactcaggatcatgaccctgtactccagcctgggtgacagagtgagccca

SEQ ID NO: 699224 - DNA, 914 bp, Homo sapiens
  misc_feature (647)..(647): n is a, c, g, or t
ctcactttatgtgagtgactgttcctgcgcgcgtctactctggtgtgaccctcctcttgtggcctgaccgcgataatttggtcgcctcgttcattatcgccacgtcgtgccaatacaagggggactggctaaatcacacactccggccctcccgacggtgagtacctgggcgccaacacacatttgtggccactgttgaaccccccgccggttcaaacccgtcgggcaccactaatgtgccgccactttaaagactcccgcggggttaaacacaaaaaaactgggaggcccggggagagaaattaagggttctaggcttaaagaacgaaagctcgccctctttcccaaggggtctcaacgaaggggcttaagtaatcttcgcccgtctttctatacatgtggcggtctcaaacaactgttcgccccgtccggcgccgttgaaaatcgacccgcgccctggggcactgggtcccactattaggaacgaacaaaactggggttttgggagaactcagggctttctatgagctatctccgctccgggtgtcggaaataaccacgggtgggggagccacacaacaaggagcaaaacgcacgtggggggaagcatatcccttggcgcctatagtttttgttaagcgttgaangaggggaagataaccgacaaatgcgttctcattgataatgaccttatattccagaagtctaaaaaacactaaaagcatatcccccggccttggtgggggtcgatggccattgattctcaccacctctctctaggggcgtggggcgaatggaaacacttgcaaccccgcgagagtggcgggcgcactgagtacgggaatacaaccgtagggcccccctgcgggaacaaggggaggcgttcccaatataaaaacaaaaaacaaaagaca

SEQ ID NO: 699225 - DNA, 680 bp, Homo sapiens
  misc_feature (40)..(40): n is a, c, g, or t
  misc_feature (42)..(43): n is a, c, g, or t
  misc_feature (90)..(90): n is a, c, g, or t
  misc_feature (659)..(660): n is a, c, g, or t
accagcgtggaagccacgtggggctgacacacgacggaancnngtggagacagggccttgctctgtcactcagggtggagtgcactggcncaatcatggctcactgcaacctcgacctcctgagcttaagtgatcctcctgcctcagccccctgagtagctgggactacagacagaagccagcatgccctgcctatttttaggaacaaaagtatctctcaactcttagcaagatttttatttttatacattatagtgaaaagtgttgtagaaacatatctaggaccacttgatgttgagaaaatatttatattgaatgttttccgtgcatttatttctgttaggaaaaaaatagcaatgaaaagcattatcagtctgggtggttctttttcagatgcaaaaatcactcaaactgaaatcctttttatactcaaattgggcctgccagctttaaaagagggcagtcaggataatatgataaactggcccatgcgctcaatcttagctcatcaaggctgtgccagaactgacattttcgtacagtatggcttgatgctctgattacaaattggtcttgagcagctatactctttgtaattttattcactgagggattgtgtttgtatcataggtctgttttggttttgaaacctgaagtannaaatacatcactgaaaaaaa

SEQ ID NO: 699226 - DNA, 115 bp, Homo sapiens
atataagtgggtgacaatccaacgctagcctcactcatgtgatgtccatccctctgtactgtccacctcctcatgtctgtccacatactcatgagctgtcccctccctgtgctgt

SEQ ID NO: 699227 - DNA, 606 bp, Homo sapiens
agggtggcggagaggattgggtagtgctatggggaatcatcggaatccttcaccatggcatcagtccggccagcgtcggcagaggcaatgatcctctcacctccagccctgagcgaagctcccggacgtactgatgccctcacctccaggcctgtgcgtgaccttccaccatttgaggatgagtccgaggggctcctaggcagagaggggcccctggaggaagaagaggatggagaggagctcattggagatggcatggaaaggtgactaccgcgccatcccagagctggaccgcctatgaggccgagggactgggctcgggatgatagaggagccgtagaggagctagaggggcagtcagagggatagtagcatggaagcggaggcatgcgggcggacgtgaccgggaggctgggcggggggctgggccgatgcgccgtgggctccggtatgaacaagtgagggaccgaggacgacaagagacgctctgtgccgcgagtgtccgcacagggggatgtgggggcacggagggacggtgcaggaggacaaggaggatgactgcgagagctggagaacctgggggatctgcagagggcactctgtggg

SEQ ID NO: 699228 - DNA, 224 bp, Homo sapiens
ttcattcttttaatgaaaaatgtattagtaaatatataataaataaaacgacttacagattattttatgatatattcttccttgaataataataataaataattctaatttgttgttacttaaataggactgtagtataactccgatgcacgtgcgatgctcacgagttattaccagatcctcgtgggtcgagttaaacgggccggggctgttagaaccgtcaa

SEQ ID NO: 699229 - DNA, 252 bp, Homo sapiens
caagagtagcttatagccttgtctaagtacagtattaatcatgctgtcgacgggggaatagcacattgttttggacggactctagctagtaacttacagtgcaagataattcaataactgatgttccatatcatacagagaccttattgctcttatcaaaacagaggagggctacatttgtaggagtgttatcatattctcaggccacctgtattgaaatgcggtatctcactgggctattctggacacact

SEQ ID NO: 699230 - DNA, 188 bp, Homo sapiens
  misc_feature (7)..(7): n is a, c, g, or t
cgcgcgnttgtgatctagataactcggcgatcgcacgcccccgtgctgcgagaccattcgatgttgcctatcactttcgatgtagtcgcgtgctacattgtgacacggtgacgggatcagggtcgatccggagaggagctgagaaatggtaccacatccaaggaaggcagcggggcgttggatgcagt

SEQ ID NO: 699231 - DNA, 1512 bp, Homo sapiens
  misc_feature (330)..(330): n is a, c, g, or t
  misc_feature (1401)..(1401): n is a, c, g, or t
ggaacaacctgaggagttctgcactatgaatctctgatggaacactcgtgaacaacagtgccaagggattgtcatcctgctgtccagaaaacgacttgggtcatcatggagacgacgtgcaagcagggttgcttcagatgtggcacgctcagcatacttccagtagtctagcatccggatgatggaactccgagatgtcaagtagacctctgcagatctttatctctgttgcaacctcttacaatacagtgttcattcggcatagagctcgcaatgactcaaggatggcttccgggagagtctccgtgagttggttgcgattactagtgnccttgcccgtgattcaaggtgactgcttccagagagcctacagcctcggagtctgggcggagtacgaaggagcgatgcgcctgtatggccacgttagcacactaggctggcaagctgtaagggtggtggaattcctacaagtagcagtgggaagcgacgttcttagaaccacgtttctcgtggggtcaattttgagatgttacacatagagattatggcgtgagaatacacgagcgtgcgatcttgggcgacgcctcggtggtgccttagcccggggaagacgtttgctcgtccgagtgtcccttgcataatccaaaacaatcaatagacttccttcgtgtagccaccgcacgtagttgacacctggcaagggcctggggctttgcgtgtcccaaatccactgtggtgggggggaaaatggggacgcaaaagccgtttcccaaccaagggcttcttggctcgaaaaagggccagcccaggaactttgcgtgggtgcgagtctgggtgtcccgccggtgcaagtgaattagacccagcatttgtggggtagttcggtgaacccgtacgaacgccttctccaaagacagaaaatgaacgtacttaaccaaagggctttggtaattctctggaggattagctcccgtaatcaacggcatgtggcaacttcccccccaaaagcgtcccaaacgggcttcggattccccaacgttcaaaggacatctaattcgaacggcagtagggtccggggactctccacttccttatgaaaatgtcgacacacttttagactgtggaggacaacacttctttctgccctcatgggagagaacagcactttaaatcttatctctggtgaccagtttcccggaacctgaggaaagacgttctccaaaaccaccgcggtggagcctttcgaaagcgaaggaaaaaggaagtctaaacacccccctcgggtattttgtcaaacatcggcgattggcctttccaaaatgcacaacaagagcactccaaggaaaactcccaatcaaattggacctgggcgaagcaccatcgaacaccaaactgttttgngggcgaggtaccaatccgccaagggatgtcacgaccgagcgcactcactgtaaggtgaaggaagcggtcagatcacatcagctatggagacctacatcacagcgggagcac

SEQ ID NO: 699232 - DNA, 404 bp, Homo sapiens
tttcctatgcatatatacatatgataaaatttaatttataaaataggcacggtaagagattaacaactaataataaaagagaacagttataacagtataatgcaataaaagtcatgtgaggccaggtgcacgtgtcacgcctataataccaacactttgaggggccaaggcagaagactcacttgaggccaggagtttgagccagtctgggcaacacagtgagaccccatctctacaaatgtatattttttacattagctaggcgtggtgggacacacctgtagttctaactattcaggagacagatgggaagatcgcttgagcccaggagttcaaggctgcagtgagccatgattgcatcactcactccactgtgggtgacagagtgagaccctgtctcttaa

SEQ ID NO: 699233 - DNA, 116 bp, Homo sapiens
ttgttactcacaaacacacacgatgtatccagctcctcctcaacagacacatgccatccagctcctcctctacagactcattcctctggctatacactgtttgtggaggtagcact

SEQ ID NO: 699234 - DNA, 264 bp, Homo sapiens
actcgccctcagaggggccgtgcccgcagtgtgaggacgccctcgttgcgccttctgcccttttcttcccctttttcgctggttcagctgcttgaaaagccttgtgccttttgcagcggggcaacaaaccattcgatgtcgtccagggcgcagttgagaatttgggtctccttctctattttctgagcaagcacggcccgggtctcctcttgagattccagagggggaaaacttggttggttgaggtgcactgcgggcccacgc

SEQ ID NO: 699235 - DNA, 237 bp, Homo sapiens
agaggaaaagtttcaagtcggctgacttccctacccggggcttcaggcgccccctctccggggccgcgcgggcccaaagcgggaggggcgcgccccctcctttggcagcctcagagcgcggctgtgacggcactcattccactccctccggggttcttgttgtcatgttgatggtttttgttgggcaggaaagcgggctcgactttctctttttgccagcgggagctgaagcccgtt

SEQ ID NO: 699236 - DNA, 579 bp, Homo sapiens
  misc_feature (22)..(22): n is a, c, g, or t
  misc_feature (59)..(59): n is a, c, g, or t
  misc_feature (160)..(160): n is a, c, g, or t
cggatgggagtctcctgccaangaatcaaagttggaagatgaagatcaggccaaagtangataaatatcaatgaaaataagagagatttcacagataatgagaggaagtattacagaatgggtaaatatgcaagcccttaatcaagtctgggtttcaatnctagctccgtcatgtatttgcagatgatcttggacaagttacttaaactttctaagcatagatttcattatttgtaaaatatagtcttagagtagctagccaagacctttagatttccaagtataaattaaaagactggtcaaatatgtctcccaaactacagttttcacatagcgagctttccaagtggtactgttgaagccctttccctaggacctaggtcagagggagcacaccccacccatccttcttgagggtaaatgaaactcataatataccaaaacctctctccaaaatgctcattctaatgtataactcctctcagtctctccaatcccctttattggcttgagatgggtagttagcaaaggtcacaaaaccagtatctagtctcacacctcacttggcgatcctctaga

SEQ ID NO: 699237 - DNA, 175 bp, Homo sapiens
gagaaaaagaagggattggatccagagcattttgccattacagtttccattaactccttccccccgctccccccaaaaatttgaattttttttttcaacactctttacacctgttatgggagaatgtcaacctttgtaagggaaccaaaataaaaattgaaaattaaaaaccgta

SEQ ID NO: 699238 - DNA, 537 bp, Homo sapiens
taaaaaaagggtctccctgtgtcacccaaacgggagtgctgcaggggcattgaccacgtggctcactgtggaaccttccacctgtgggggacagagcaagacttatcttaaaaaaaaaaaaaaagtgttggggcgcgggggcccaggccctgtgttattcccagcactttggggaggccgaagggcgagggtggatctcacggaggtctcacggagattcgaaaacacactccggggcaaacccgtggggaaaaccccattttcttacataaaaattaacaaaaaaatatagccggggggagaagagggggggcgccgtggggtcccccagaacaactgtggcggagggcgggagggagaggaaaaaaacagccgggaaacccacagggagggtggaagacctggccaggaggagacgctggagaatagggcccccacgtggcccccacaagccccagagggggaaaagggggcaaaagaacatccgggtcttaaacacaaaaaacaccaaacaaacaaaagaaacaacaaaacagg

SEQ ID NO: 699239 - DNA, 862 bp, Homo sapiens
  misc_feature (35)..(35): n is a, c, g, or t
  misc_feature (162)..(162): n is a, c, g, or t
  misc_feature (337)..(337): n is a, c, g, or t
  misc_feature (393)..(393): n is a, c, g, or t
  misc_feature (479)..(479): n is a, c, g, or t
  misc_feature (487)..(488): n is a, c, g, or t
  misc_feature (569)..(569): n is a, c, g, or t
  misc_feature (606)..(606): n is a, c, g, or t
  misc_feature (611)..(612): n is a, c, g, or t
  misc_feature (627)..(627): n is a, c, g, or t
  misc_feature (708)..(708): n is a, c, g, or t
  misc_feature (735)..(735): n is a, c, g, or t
  misc_feature (751)..(751): n is a, c, g, or t
  misc_feature (772)..(772): n is a, c, g, or t
  misc_feature (798)..(798): n is a, c, g, or t
  misc_feature (841)..(841): n is a, c, g, or t
tgaacacaagtcttagaataacaaatataaactantataaaagtgtagcttatgcatgatgtataaccaattcattgtcagtttaggtagaggaaagattaaaaaatctcaatctaggtaataagatcaaatcaataaattctttctgtgtacaaatactantatttcatttggcatccttaaaatggttcatcctaaacccaaccattacaaccaacatcagtcactgttatgatatatgatagtcattattccaaaatagcagctgaaaagatctctttaccatatacgcacaatgaaaaacaaagaatttacaaatcacatcgtaccacctgcnaatatctcaatattgtttgggccagactcccaattagggtttggttaatactttcngggcttttactttccccccccgctcattgtggtttgctagtgctttggttttcttaccacaaactcccggctctttgcataaggcncccagtgnncttctgctggattctttcctggctgctgcgcgcccttccttttttatgttgtcatttatcttctcccatcgggtcgggctnttcgggcggctctctctctccccttctttcttcccgnggggnntccattctggtgggnctttacaactgaccagctctcttgtcatggctggattttcagtaaagtttataattagtttcataatctgtatcttggtgnagtgatttcccaggtataacaaagcanaaaagtctggtaaagnataggtaagcaaatgttggtnatgattagtcacagtcatgttggttnacagtcttagcccagccatctgcacagctgtgtccaagcgtcntaccatggtgtcatcacacac

SEQ ID NO: 699240 - DNA, 95 bp, Homo sapiens
catggggtgggttcatcataagtaggatgggattatccttcctgggaaataaattcccgtttttatccaaaagagctataaaaagttttcagtga

SEQ ID NO: 699241 - DNA, 284 bp, Homo sapiens
tgagaacaagtaagtgaacacattagttgtactgaagcaacttagttacgatgactcgctgatcatcaaacaacctgtgtgtaatattttttccccaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccccagg

SEQ ID NO: 699242 - DNA, 367 bp, Homo sapiens
  misc_feature (128)..(128): n is a, c, g, or t
  misc_feature (134)..(134): n is a, c, g, or t
tgggcggtatgggtgaggcaggaggtggggaagcaggatctctggaggctgtccagtctctttcctgggtgagggtctggctgagtctccgggtagagatgggaaccagagattggaagaccagaggncacggncacgctcatgacggggctggggtaatgtgggctcgtgataggaagaagaggaaacccttaaagctcttggggtacaagggagaagcaggttcctggtcttgggctggcaaattcaaagggacctggggggaacacatgaggaacctgaaaagcacaagcccgaggccaactaattcctccggtcactgccccagccatggccctatctgcacacccaggccctgggagcagcg

SEQ ID NO: 699243 - DNA, 104 bp, Homo sapiens
aggaaaaacgacggccagcgatttcgttgtcttcctggtggctgtctcttgaggaacacccccccctgctcctcttcttgattgccttcgcggctttttcagga

SEQ ID NO: 699244 - DNA, 430 bp, Homo sapiens
  misc_feature (1)..(2): n is a, c, g, or t
  misc_feature (430)..(430): n is a, c, g, or t
nngacatagtgtgcccacttatattctgctctacctattataaatattgggcagtagtgtggcaccattagttataaatggtgtgccaatattgatacagcattattaactaatgccttaggttacattaagggtcattctttgatttgtacattctatggattttgacaagtgttttgtaacatgtatccataattacattatcatacagagtacagtcacgtgtcaatactttctgagaaatgcatcgtttggagatttccaagttgtgtgaacatcatagagagtactttacacaaacccagttgatataacctactacacagctggtatatgatatagcctattgctcctaggctataaacctgtacagcaggttactgtactgaataccataggcaattacaacacagggtgttttctgtttctn

SEQ ID NO: 699245 - DNA, 702 bp, Homo sapiens
  misc_feature (179)..(182): n is a, c, g, or t
  misc_feature (184)..(186): n is a, c, g, or t
tgagcctgggaggcacaggttgcaatgagcgggtatcatgccactgcaccctagcctgggcaacaacagcaaacttcatctccaataaataattaaataaaataaaagcagatacctggaactgacctgtcctttgcttcctgggccacacagacacatgttgggtttcctttcactcnnnncnnnagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagctggctctgaccccagttggaaatgtatctgctactttgtccggcgttccactcaaggaccatttatgacattgcttgggtgtcagctgacaggggcatctggccacagcttgtggggatgacgcgatccagcgtgtttcaggaggatcccgaactcggatccacatgtagcctcgaacgttctcgcctgacatgcccatcttgcatcaggcccattcccctaggactgtcaaactgtgtggcctggaatcctccaaggagccagaggctactggcacgtcctgcagtgatgactgggg

SEQ ID NO: 699246 - DNA, 463 bp, Homo sapiens
  misc_feature (179)..(182): n is a, c, g, or t
  misc_feature (184)..(186): n is a, c, g, or t
tgagcctgggaggcacaggttgcaatgagcgggtatcatgccactgcaccctagcctgggcaacaacagcaaacttcatctccaataaataattaaataaaataaaagcagatacctggaactgacctgtcctttgcttcctgggccacacagacacatgttgggtttcctttcactcnnnncnnnagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagcctcgacatgtt

SEQ ID NO: 699247 - DNA, 459 bp, Homo sapiens
  misc_feature (3)..(3): n is a, c, g, or t
  misc_feature (389)..(389): n is a, c, g, or t
  misc_feature (413)..(413): n is a, c, g, or t
  misc_feature (434)..(434): n is a, c, g, or t
  misc_feature (448)..(448): n is a, c, g, or t
atntcggcacagctctttgcacatgatagcatttatacttgagaaaaattgtacaaatatagaaaatgtagaaatccattaatgcctactcatgtgttactaaatatcagagagtttgtacttaataaaaggattataaatgtagtatttgttgaaagacctattagaaaatacaggtcttaaaagtgaagaagagtattctgaagatagacaatagaaatagtaagagggttgtagtacctgtacttgcatcatgggtcttattgtgcatatttcatactagaagaaaaccctggaagcagttgcccaaactttctttgacattagaggaatttatattgggaaaggaaattttacaaatgtaataaatttgggaaaagcctttgttncaaaaactatagctttaaaaaaancccgtttattactcggaggtnttttgttggtgtcngtaggttggaa

SEQ ID NO: 699248 - DNA, 405 bp, Homo sapiens
aaagtactgtcaggaatgttaaactcggccaggtgcaatggctcacacctgtaatcccaaagtgctgggattacaggcgtgaaccactgtgcctggccaaaaaaatagacttttgtaatgggatcctgagaccaaaatatttgagaaccactggcctaaagtatatgaaatattataatctgcaaacttgagcagatgcaaaatataattctgccttgggagcctctttcttttggggtggctgttacatgataatgatggatagtgaaaataaatctcacactatgggccaggtgcggtggatcacgcctgtaatcccagcactttgggaggccaaggcgggcggatcaccaggtcaggagatcgagaccatcctggctaacacggtgaaactccatctctact

SEQ ID NO: 699249 - DNA, 395 bp, Homo sapiens
gtgccaggtactctattaagaattttgatataccttttcttatttaactctcacagtacttttaggaagttggtagaatttctgttttctttagtgaaaaaaatggaagctccaagatgttaatcagcttgctccggatcacatggctaataagtgagtggcagaaccttattcaaacacaagtccttctgattccaaagggctttttctataagcattgttgtaagagaatgttccataaattctcagttgttgaatttttcagaatgatttatttgcagatataacagataggctgtgatgtcctcatgtgtgctttatttattgtgctatcctttatgtagcagcatatccataaggaatgaaaggatatcagggtgcacatggtggattta

SEQ ID NO: 699250 - DNA, 417 bp, Homo sapiens
attcactcttggtcaaaatatataaacttaggcatcctaaccactttagtctatcccctattggaatatattccatccccttggatgttttttagctactctccccctaggtaaggaaattaatcataacttattttgcaatcacaaggaatttgaggtttttccccctcagaattcactttacatttcttacattaagggttttaaaaataagtgaggattttaaagtcccaatgggacttttattcaatgtctcgcgttttcccgggatattataattaaaacacaaattgagatgagaggtttggggttgggcggagacaagaggtaaatctctcctcaatatataattaacccgtgtcctcaaatcttctgaggtgagggcccaaggaccccttcccctgattttaaaaactt

SEQ ID NO: 699251 - DNA, 381 bp, Homo sapiens
  misc_feature (171)..(171): n is a, c, g, or t
gacttttttcgggggccttttcatcatcttgctttggcggacgctcaagtacctgtggaccgtgtgctgcccctgcgggggcaaaacgaaggcccccccctttgggtccccggaaattcccccaacagcgcggaattggaacgggagtccgccttaggcccgggttttacncggagggttttccctggcgctcgaggggggtaaatgttgtcggctttaactatttctggggcaaacgccccccggccctgaggctggcgaccccttcgatgtatggttgctaggctccctgcctggtttgtagttgtgtccctaaaaatgttttcccttccccccaacccctgggtggagtggggggcccccccctgataaaaaactgca

SEQ ID NO: 699252 - DNA, 327 bp, Homo sapiens
  misc_feature (61)..(61): n is a, c, g, or t
  misc_feature (69)..(69): n is a, c, g, or t
  misc_feature (92)..(92): n is a, c, g, or t
  misc_feature (116)..(117): n is a, c, g, or t
  misc_feature (135)..(135): n is a, c, g, or t
  misc_feature (140)..(140): n is a, c, g, or t
  misc_feature (142)..(143): n is a, c, g, or t
  misc_feature (167)..(167): n is a, c, g, or t
  misc_feature (169)..(169): n is a, c, g, or t
  misc_feature (181)..(181): n is a, c, g, or t
  misc_feature (187)..(187): n is a, c, g, or t
  misc_feature (191)..(192): n is a, c, g, or t
  misc_feature (195)..(195): n is a, c, g, or t
  misc_feature (219)..(219): n is a, c, g, or t
  misc_feature (268)..(268): n is a, c, g, or t
cattacttaagaatgtataggactagattgacattataatgatagtacatggtttcacaantccaaganttatgacataatctctacatcgntgcccatcacctattatatttctnnatgcccactctgcttgcncacanannttctgatggagtgaatggagaagncncctgaagtctgnctgacnattnncangcattcctgtgtccgtctgttcanaagttccagatgcaatgtttgtcaaagcccatgcagcttcaaactgtanagaaggattgtcatctctttcaagacaatggacctaaatggacaatggacctaaatgga

SEQ ID NO: 699253 - DNA, 422 bp, Homo sapiens
tgaattagagttgttgctctccttcacaacgcagatacttgcaagtaagttttcttactatccattgcattttatttctctctagtattctaaatatttgcttcttttttttcctttgtgagatttcctaatcccttttcaaatgttttatcatttctgtttctttgtacttagtagttacttagaaaacaagtgttaaatacctattaatctttcaccaaaacttattctggtactttttctcctatattatcaagtgaatcagtatgtataataaattggctctcagatagtccttgctgttgggaagttcttcctccaggggaaagtttttgcccatctctctatgttattccctgtgcacattctaatatgtttttgtttgtgcaggcatcattcagtttatgtattgtttagatatg

SEQ ID NO: 699254 - DNA, 388 bp, Homo sapiens
tgtagagacaaggtatcaccatgttgcccaggctggtctcctgagctcaagtgatcacccacctcggcctcccaaagcgctgggattacaggtgtgagccaccgcacccggcccagattggcttcttccacgtagcaatgtacatttcagcatcctccacatctgctcaaggcttgacagctcatttccttttatccataaacaatattcccttgcagggaagcgccaccgttcgcacatccacccaccaccacagggtatcctgactgcttccaccgcgcccgtatgaatgaagtggttacaaacacctgcgtgcagttttcatgtgaaggatggttttgaacatttttaaatgttgaaaaaaatccagaggagaatatttcacaac

SEQ ID NO: 699255 - DNA, 258 bp, Homo sapiens
agaggacctggaatgtgtggtgtatgccagattaagtcatatctagttctctcttcaaaatcctaatacatcaacagactttaggtttctggaaaacgttgacttgcattttattttatcatctttttttagaaaatagatcaattaaaatataaaattgcccctagtggactttcgaaagataggtttagccatttcgaaagaaaactattttcattccttttcttaattccaaaaacaacttagttttacttggaa

SEQ ID NO: 699256 - DNA, 836 bp, Homo sapiens
aatcagcagttaattacagctgcaatgtaacaggaaaaatgctaagtggcttaaacaagatagtttatttctctctcacataagggtctagttgtaagcaattcacggcaagtaagacaattatgtcccccagaagacttcagctgcttatcattacagttttctgccttgccatccctggttcacaatggagctccggccatgatgtccatgtcccaagcagcagatgcgcgaggagagaagtaatgatgaagggtacaaagcaactgtttcttaaaaaaggtatctgaaagctctcacatgacattttcacttacatggcattgatgtggccatatgtagctacattttccaaggaaggctggaaaatgtaggcttttattctacgtattgtgtaagaccatttgcctagctgaaactttattattgtgaacaaaaagagggaacagactactggagaacaattaacatcttctgctagtagaaattctattagctttatcaactccatggagagagcatcttctcaggtcctgtaaaaaactcctggcaacgctcttataggctccacttgagtcctatgtccattgttgaacgatcactttctggggtggtttgaccagacctagcatgtgctcacccccgtggtggtgatgagggtagagccggaaaggtaacatacgcaccagatgggatggattcctccaggagaaaagctatgtgtgtgttggcggggtgaggaatggggtgtctaataccagacaaagggaggcaggaagctggattgtataataaaggagttcaacaaagttcttggatcaggttcagcttagaag

SEQ ID NO: 699257 - DNA, 651 bp, Homo sapiens
cgggcagtacggatgtgccacagatgccccagacccagcacaggcgcagacctggcgccggcttgaaatcacaggcaccaggaagtttcccccaatgccaaatgtgggcacagccggaatgcaaatgtggctggagacagctctgtgggtgagctgagccgaggctggcttcacaacgacacccaggggttcccacgaatggctctggctcaacacagtgggaaggtgaaggagacagaaagcactgtcagtcatggctttgccaagcccattcttccctgtggtttagaaaacagaactacattattctcttcccagcccaacctttccaacctggagagaagttgcagggatagcagagcaaacacccattcacttcgccgaggttccctggcggcgtgctttgccacaatcgcttcaccactctttctgtgatgtgtaggtacacccacatgcactcacacgcatccgtacatgcacacagacacacaggcacttatgcatccgtgcacacacacaggcactcacacgcatctgtgcacgcacacagacgcacagacacgcatccgtgcatgcacacacacaggcactcatacgcattcgtgcacgcagacacagaggcactcaaagcatccgtggccgcacaaaggg

SEQ ID NO: 699258 - DNA, 1134 bp, Homo sapiens
  misc_feature (580)..(580): n is a, c, g, or t
ttgctagtgtctgagtgccttgtgttgttttgctgtggctggattgtgctgtgtgatgtgtgtgttctgtgttgctgctggccatgtgccaatgccctggttgtgtgctcctgcatgctgcatgctgccccctgtgtgctgccccctgcctgcctgccctctgcctgctgtgatgcctgctgctgtgagctgtgagcctgtgctgatgctaaccctgatgccagcctgtgctgtgtgctgttcctgtgatggtgctgtgtgtgctgcatgtggatgtgtgtgcccttgacttgcagtctgcagctgttgtgcaccctggtgctgtgcctgcccatttgtgctgttgacatgctgttgcacctggctgtgtttgtgtgctgctgtgctgtttgtgctgttgcccctgtgcgccccctgtgtgccctgtgtgccattgttggctgtgccccattgtgaaccgaccggcggtctttactttttcccatgatgcccccccctgtttgtgccctggcattgtgatgatggtgtgcccccttgtgtgctgtgggtgtctgtgactggattgatgtgtggcccatgnttgatggctgccaatgttgtgaagatgtggtcaaccctgtccaatggtttattgaccctgcaattggaggcctactggttgaaatgctgcccttcagaccttaggatgtgagttgggagtcccttgtgagcatgcctcagctggcgcccttctaagctgaccttgccaaggtgaaacggagtgtgatgattccccaagaaaccttggatgaattttgacctgtttggattgacggctccttgtggacattggaaccgatgttgaactggatttgccctggtggcttgcccaatgggggttctaatgcacggcttgcttgggttgactttgttacagaaacccaacaggaggtgcctttcaatttcttggccttgctttggaccacagattcccgggggcattgcaaggaaagcttgaaggcacagccccaagacagaagttcaggggtcccccgacccaaggagaactgtgtggctccacagtgacaatctgtgcccccccaaaccttcgtagcaacagcaataccgcgggacccttcggcagggcttggtgcc

SEQ ID NO: 699259 - DNA, 375 bp, Homo sapiens
taccccaaaatccaaacagggccccaacatgggccggtcccccattttaatgggggctgggaattgctttttaaaaccactgaaaacccaagggaatgaagcccctggaagtacaaaacttgaactacatttaccataggactcttgggtgcctgacctcccttgggaactcctttggcattcacagtcccttcaagggtatttattccacacccctttccactctgcccctcagcagctcccccaaaggctgggctgaaacttgagcccccgtggatcaacgtgctccaggaggactctgtgactctgacatgccagggggctcgcagccctgagagcgactccattcagtggctccaccctgggaatctcatt

SEQ ID NO: 699260 - DNA, 1129 bp, Homo sapiens
caagagtatgtaaaaaaaaaaaaaaaaaaaaaaaccaaaccacgggaaatattcaattgccaaaagggttacccaaattccattaccgtggaaagccaaagcagacagaaaccaagttattgcattgggagtgattaaagccattgtgtttataagtgggtgaacaacctctcaccagaattcacctaagtggttctctagaaggtttaacctctcaagtgtgggccaagccgtggggtcttttacagggcatagtctccagtgtggcccaatagttccctatacagcccaccaggaatattagggaatctcgtggtataacacctgtgaatgtgttctgtgtctgtgaaaaggcttatggattttaaaccctgtggcatgtgagaggggcattctccctatttttaaaaaacaacacaaactgtgtgtatgtggtgtcgcaccttcaaggtctgtgtcctcttgtggaaaggggaaacactgtggaaaaaaacctgtgaagtgttaagcccccctgtgggccccagaaatataacacgtggccgtgaaattttctctcagaagaactatttaattttccactcctgtggggaaaacacaaattctccctacccatataagccacaaagagcggagagccccttataacagaagaggtgtggggccaatataaaatgatctttctctgctgcgccccctctttaacgagtttctccccagaaaagacatattatatttctacccgtgggatcaccgtggaagaaaaatctcccggtgggaaaaacctataaaatatatgggcgcctgacgggaaaacaatttcttcaaacagcgaccgtgaccatgtggcacccagtagcactgtggggagtatatcgaccactataataccaacatcaaccttggggcgcgaacatctcgccccgtgagagaacagcttctgttctctgccgtgggaggcacccccgtgaaaaattcgcacatcaatgggacaccttataacatgctcacagaagtctctctttataatctccctctgataacaagcctgtggcccccccattaataatatcgtgggaactaccaaccccaatgtggattccacataaggaggaacgccatctcgtga

SEQ ID NO: 699261 - DNA, 322 bp, Homo sapiens
cttctcttcaccctgaacaacgccgggacctctttgtatcaaactcaaacaggtactgcactctcctggacagagaaactccgccctctcttttagagcctcgtacttcttttccagctctaagcactcaccagtaagagcctcctgatccgccctcttacttactggcggtacctagtggctgctgtcttgtaatgctaccatttttttcagcttcttatccagtttctcaccctttacttttgctgctaccatcttctctccaggaggatcgtaaggtttgggacgggcagacccacagagaacacctggagatgggagg

SEQ ID NO: 699262 - DNA, 113 bp, Homo sapiens
gatctcaaacatgttcacaaggaatatcattgggaaaggaggcgcaaacattaaaaagattcgtgaagaaatgcaacaccaaaatctgagcttccagcagagaatagcaattc

SEQ ID NO: 699263 - DNA, 664 bp, Homo sapiens
gaaaccccagggttccactgtgtctgtgttgggcccaaaaacaagggagggggcacaactgtggaccttcctcaaaaaaagttcctgcgccaaaaaattcccacgtggacgtgcaatcaagtcttggtaaacaaggccagtaaggcggggttccaaagcccagaatccgtgttaccggcgtcaattttttcatttgcaatcatcaaaagttagtgccaaaaatgtaatgatgacctgcacgtcaagccggagtatgccttttcctagagtcaaagccatcttggcacaattgcattgtcagtctcgtaaacacagctcatgtcacaagagatcaataaagtctgtaatgtctttatcccagcctttgtaaataagtgcgctaagacggacgataagcacacatatgtggcagagaagggtaaaatacatgctgtagcaagtcaaccatgctttacgctgataactccacatttaagagcgtctcacgcctcccatgagaataatagacactgaatggagatcgcaagccaagtcagcagtcctcatgggtggtgggtgaagagccaacacctggtctaaaatgcatgcatttcctcaatcaattaaccaccatgcaaagtgcttccattaatataatatggtaagtatctacgaaaaaaaaaaa

SEQ ID NO: 699264 - DNA, 1361 bp, Homo sapiens
gctggcgcgctgctggatcaacgatgagcctgcagtgagctgcgtgctgcgtgctggctgtgtgctgcctgatgtgtgcatgtgccaatgctgtgatgaactgcctgaatgctgcttggacgcttgactgtgttgctgtgctgtgtgtccatgtggctgcttgcttgctgtgtgtgccctggtgctgctgctgtgttgatgcttgggctgtgctgtgtgtgcttgtgtgcctgtggtgtgcatgccttgtgcgctggctgtgtgctgccccttgttatacccccttttgttcccattgaactagaggtcaggctgacacaattttccccgcagttcaccaccggagtactgtttccctacacctagtgaattcaaccatggacttccagcggatccgacgggcctgcaaacgcggtggcccccattaccacccccaaaacaaccaggttgccaatcagaccaaacgcgacgaccgaccatttgctccgtgtgccacccccacccgccccgggacccacgcgcttcagtattccccacttggtggcacccctcgtcaacgagcaccctggccctgatattcaacacccgaactgacccggccaacgctcccaccctacggcaacgaccttgctagaccgcacccataggtcgacagcgaccacccacgacaacaccagagaccaccaaacatgagaagtcccacaaggggcaccaccacgcgcacccagcatctcactaaaaacccgccccgtgcgccactgaacacacggcacgcaggcaaaacccacgaccagggatggcagccataccaaacattgaccgaattccgcccagccgcttcccagcagcgcgcaagcagccgcagcatatcccgggacgcacgcgcccgacagcccgaaaaggtcaaaaagcacgctgtgcacactcgacagaacggccccagaaccgcaggaccagccttgtgccacaccacacgacgcatagcccccagtgcacggggaccacacaatcagtagcatccacgggcaaaaaagcagcccactttgggcacaacacagaggaccccaccagaagcgccccaccgataaaaatagtcaacacacagcgagcaacgcaaaccaaatagcttgaccaagctactccgctctgtcgctggcgcagaacccaaacattatcatcaaagcagcccaccaaacatacgaaagcttccactcgacaccacctcaaagatcacggtggcgcataatggtcggccccacaccaagacaaattttgcggagcaccaacaaaaacccccatagcctaacaacaaacctctgacgaggcaactattcctgatcgccaacaaacacccgacgacg

SEQ ID NO: 699265 - DNA, 503 bp, Homo sapiens
gagttaccagacaacaggcgtaccatttgagtcttaggggtcgagtcctctcgttatcaccacaccacattgcttcacaaataaaaagcaaaaatccaattcacggcacaacctatactgaaatttaaaatgcaaatatcccttgattcagcaattccaatccttggtatttatctccaggtacacaggagatagatgattgatagatagatagacagacagataggcagggcgcggtggttcacgcctgtaatcccagcactttgggaggccaaggcaagaggattccttgagtgcaggagtttgaggttaacctgggcaacatagtaaaactgtgtctctacaaaaatttttttaaaaattagtaaggtgtggtggcatgtggctgtagtcccagctactcaggaggctgaggtgggaggattacttgaacagggaggtcatggctgcagtgagccatgattatgccactgtaccccatacaggctgggtggccagaagga

SEQ ID NO: 699266 - DNA, 204 bp, Homo sapiens
cgctttgtgtgtggacgtcccacggggcggtgcggcgtccctctgcagcgttagacttctttgggactgggccacagttacttacagacaggcaatctatacctgcgggggccctgaagaagtccaatgcaccgcttgtcatgtgaccctctactatgaagcactgtgcggtggctgacaagccttcctgatccgggagctctt

SEQ ID NO: 699267 - DNA, 405 bp, Homo sapiens
attaatgttgtctaggaattataatagacctcaaacttgttttatacaaatttaatacatatattggaattattcacgttagattatgattggttatagtattaatggttataggctgggtgcagtggctcacacctctaatcccagcactttgggaggccgaggtggctggatcacctgaggtcaggagttcaagaccagcctggccaacattgtgaataataccaaatataaataccactataaataccaaaattagctgggcgtggtggcaggcgcttgtaatcccagctcctcaggaggctgaggcaggagaattgctggaacctgggaggcagaggttgcagtgggccgagatctcaccactgcattccagcctgggtgatagagcgagactccatctca

SEQ ID NO: 699268 - DNA, 293 bp, Homo sapiens
gtgatatcgagagtcgtgaaggtgtattgacatgacgctatagactatacgagtgctgatcggtcattctccatgtgggctgacgcagcgatattactacagattgaacgggtaggcgatctgattcagtgcagtgttgcgcgcgttgctgcatgggtggtggtggtcaccatgtcatgcagctgtttttcaacttcgatgaccagcactgcttcgagtatctgttgttcgaaacagggcggcgccgggctggacgtattcttcgtcatcagtggcttggtgattatcctcgc

SEQ ID NO: 699269 - DNA, 179 bp, Homo sapiens
atagatgtgctgtgactttgatgacttggtgtaacgtagaaacgcgtaaagacagagatgagggcacagagaaaactggactgggcggggaacagaagaacatggaataagaccaagaggaagaagaggcagggccacatgtgtaatctctcctcagcaggtaggtatgatgcaggacg

SEQ ID NO: 699270 - DNA, 882 bp, Homo sapiens
ttgactgaagaggagacccgtgtcatgtttgagaagatagcgaaatacatggggagaatcttcaactgctggtggaccggcccgatggcacctactgtttccgtctgacaacgaccgggtgtactatgtgagttgagaaagaattattggaaggcttgggccggccaaattatttccgggggaccaagctgggtgtcgctgggggacctgcttgggaaaattcactaaaacccacaagtttcggtgtgcacgtcacagctcgtggattaccttgcaccttatgccaggtataaagtcgggataaagcctggtgcagagcagtccttcctgtatgggacccatgtgttgaaatctggtctgggtcgaatcactgaaaatacttctcagtaccagggcgtggtggtgtactccatggagacatcccttgggtttggggtggcagcaaatctacacaagaatgcgaaaagtagacccatgggatgtggtatttcatcaagcaagacattggggaatttgtgcggatgaagagacgttgatttaaaagaagcattccaatgacagacgggtgtatggaaagggcgagcttggtttcctgtgttgtgtggactcccatcactccatgttgaatcggccacaatctgacatctttcaggacttcttatttaagaatcccaatcatgcgaacggcggcggagtccatatatccggatgtcacaggggtccgaccttggagaatgaacggtcacatggaacaaggcttgtcgggaatggaacctggacgaacacgtggtgcgatacacgtaacacgggtgttaaacccaccgcagaaacacggaacaagacacacaccaacagggggagaaccaaacatcggacacaagc

SEQ ID NO: 699271 - DNA, 115 bp, Homo sapiens
  misc_feature (8)..(8): n is a, c, g, or t
gctatttntggtgattgtttcctttgctgtgcaggtttttagttttaaattatccatttgtccattttggctattgttgcttttgtttttggcaccatatccaaaaaatcattgt

SEQ ID NO: 699272 - DNA, 160 bp, Homo sapiens
  misc_feature (145)..(145): n is a, c, g, or t
ctgtgagtggcgtgtagtgggatggcagatgaggaagaagaccccacgtctgaggaagaaaatgaagaaatggaggaggtgcagaaggtggacaggtaacaagaaagagacttttttctaaaggaattgcgatgtattgatgtcnatggctttggggatt

SEQ ID NO: 699273 - DNA, 372 bp, Homo sapiens
taagtgtgtgtcatgtgattgtgttggattgtgtgtcatgtgattgtgtgtgcacatgatgtgtctggtgacgtggtgctggtgtgtgatgtgagcgtgtgtgtcatgctgatgtgtgtgtgcgtgtgcatgagagcatgtgtgtgtgcacgtggatgtcagtgtgtgtgtccgtgggtgtgtgtgtggatgtgtgtgtggctgtggatgtcagtgtgtgtgtgtggatgtgagtgtgtatgtggatgtcagtgtgtgtgtgtggatgtcacggtgtgtgtggatatcagtatgtgtgtctgcatggtgatgtgtgtgtaggtgtgagcgtgtgtcaatgcggctgtgttggggcgtgtggctctgagtgta

SEQ ID NO: 699274 - DNA, 213 bp, Homo sapiens
atgtgtacagctgacatcatggtcccctgcatgtgtgattctgtggctagtcaccagcctgggagcagcagacagaccgggtgacacttacaactcagaaagcaatagcagctctgacgccttgtccaaggttctcatctggtggctcagtgcgactttgggatgccgaaatgatgaaatccacagccatagcacgggtggggatacccgggg

SEQ ID NO: 699275 - DNA, 163 bp, Homo sapiens
ttccgcaggccagccggctgacggcgctgcgcaacaagccgagcctgaagccaagcacgacgatgttgtcggcttcagcattggtttcagcatcacggatcatctgttgaatttcttcatcagacaggccggagttggccttgatggtgatcttctgctcttt

SEQ ID NO: 699276 - DNA, 178 bp, Homo sapiens
ctcctgtacattaagaattactttagatgacaaacgcagattacaaggtcgtagggaagtactttcatcacccaagcatcagaaaaacacacaagaacaataacacagcaaacagattgagtagttgttgtggtttttgactaaggtgtatgttagtttcatcagaaacttaaaacat

SEQ ID NO: 699277 - DNA, 677 bp, Homo sapiens
  misc_feature (645)..(645): n is a, c, g, or t
tgggcaagatgaaggctatcgttgagaagcttcgcattcacatacagaacgtgacagcctttgagaacctccgtgctgcagcagcacttcaggaacctggaggtccttggccttggatcttgatggagccggaacaagcagtggacctagacattgcccaaggttgaagcaatgcaataacaagactgggctccttggtggatgagtttaacggagcttgtttacccaccagattactatcctgatgggcaagttaccatagatgaagacactgataactgaagtgcttctgtgaagcaaaaggacccaagactggacgtattcagagagacggatgctgatagacccacagtcaagtaagggtacgatgggcaagttaactgtgcccaggctgatagaggcctgccgggccttacgggctgaagagttgtctgaagatagcaggagctactggaagcccatcaccaagcatcttcacaggactagaccagaggcagcgcgtccagctgcccttcgcgcaatgtggcacacggctgccatgagccttgtctctcagccagttaaaatgtgtttctcctgaggctaggacagacctctacccaacataagtcgagggacttgatgttatagcgctgtcatgttgcnagtgtactgcgtagccctcccacatcggttgc

SEQ ID NO: 699278 - DNA, 687 bp, Homo sapiens
  misc_feature (118)..(118): n is a, c, g, or t
  misc_feature (183)..(183): n is a, c, g, or t
  misc_feature (188)..(188): n is a, c, g, or t
  misc_feature (191)..(191): n is a, c, g, or t
  misc_feature (214)..(215): n is a, c, g, or t
  misc_feature (252)..(252): n is a, c, g, or t
  misc_feature (260)..(261): n is a, c, g, or t
  misc_feature (265)..(265): n is a, c, g, or t
  misc_feature (267)..(267): n is a, c, g, or t
  misc_feature (290)..(290): n is a, c, g, or t
  misc_feature (368)..(368): n is a, c, g, or t
  misc_feature (411)..(411): n is a, c, g, or t
  misc_feature (477)..(477): n is a, c, g, or t
  misc_feature (659)..(659): n is a, c, g, or t
ataacctcaccagttcctgtaagtataagatgtatattagtatcaaagattagatgaatatatatacatctattccataggtctgtgcttgcagtagtcatctatgcaccactgtccnatgtcaaaagaataatgagatgctacctccagtttctgatcctgattgcatagtgtgatgtcacnaatcncanagctgagtataatattattttannattaggccacttgatatagatattaatctggttcacnactcttannatantnttctgagaacccattgatgaganatgtgtaggaaagcaatgttttctatgctagcggtaccaaacctggacctttaagtatcattttttagctcattactnatatagaagattactaagaccagtaagggagccattttcttcncctcctctatttttattacttatctctctcctctttactcttaaaattggcaatcttctgacaacnccagctaataaaataatatagctatatataattcaaataactaaagaacttttgagtccatatatgcaggatttttgaatacctcactacatttgctcttataccctcactgtcctggtatcataaatattattaagggaagataacttagaaggggaaagcaattccaacctgggataaanaagtgattaccaataattatcttctcgt

SEQ ID NO: 699279 - DNA, 421 bp, Homo sapiens
  misc_feature (21)..(22): n is a, c, g, or t
ctaatgaaacagctcaactgnnttgcagagccaggctccttctgccatgatacagtttggatgtttgtccctttctaatcttatatggaaatttgatccccagtgttgaaggtggggcctggtgggagatgttcctgttatcgggatggatccttcatgaatagcctggtgccatctttgtggtaacaagtgagttctcacttgattagtttctgtgagaactgtttgttaaaaagagcctggtggcacctccctcccttcttcctccttctcttgctatgtgatgctgctgccctttgccttccgtcatgagtggaagctccctgaagcccccaccagtagcaaatgctggcaccatgctgcttgtacagcctgcagaactgtgagccaaataaacctcttttctttataaattaaaaaa

SEQ ID NO: 699280 - DNA, 89 bp, Homo sapiens
caagcagtgagaacgactgggcgtgctggacggacgagcttgtgggagccaatggagcaccttggacatctggcagtctggcaggagtg

SEQ ID NO: 699281 - DNA, 679 bp, Homo sapiens
ggttcggtcggggcccgggctccggtcccggggcggtgtgtggggagcgatctgtgtgtgggggacggcgtggaggggtggccgctgcgtgtgcggttctgtggggtcggcggggccgctgggctgccccttcttccgcctcggtatgctcgctctcttgtgctttccctgtctgcccgccctgttcctcctcccggtcccggcaagctccgtgcccgggacctgtcagcagaggagaccaggtatatgctggtctcgtttcgaagagccgcctatgctatcaaggctggatgggaagaaaccatgcaaggtggatgaatgactcgagacaccttcaggctgaaggacttacgatcttggccaatccctaaggacagcttggatttatcacattgagagatagattagtaactggcatagacgactatgggcagggaagaaaccctttttgcttggagccagcagtatttatcacaatttactgatgggagcaggtgataccaccaggtggggtccaggatgaggtactggggagcactcagatggaatgacgcaaggtagaaaacgtatgatcttcgaagacgggcaagtcaattacccatttgtactacatgtagataaatctcatggcagaaatacacagaaggtctgagaaggtaaaaacaaacacacgaaaaaa

SEQ ID NO: 699282 - DNA, 248 bp, Homo sapiens
acctaaggtcagagcagggaaaaaccccccctccctcaacctgatcctttccacagaggccttttcccttttccttccccgctgggaaagaagtaaatacagttaggggtcctattcaacacacacatggttccctttcctgagtcccatccctgggtgattttgggggtgaaaagtgggttgtgaggtgggccccatgttaacccctcccctttttttttcaataaaacgcagttgcaaaccccgga

SEQ ID NO: 699283 - DNA, 388 bp, Homo sapiens
tcgatgtatagaatgcatagagaagtggagataagtcgggggtgacggtgcgaggtgggttagtgtgaaaaacggtaaatgccagttttaataacaaaaatggtactaaacgcagatgaccattacattaatacagtataaaagagaaccagcttcactaaactgggtatgcccctattacaatagcaacgttatgccagaatgaactgaagacatgaacagtttggacaattctcttttccgcctacttccaaatagaaatagtccggcttttttcctgtacatacgtttgatgcttggtctataccatatatagtacaacaataaattctttagcaacctacgaaacagttactaaaacctcttaaagtttacttttcttttaggc

SEQ ID NO: 699284 - DNA, 226 bp, Homo sapiens
tacagtacgaccatagacaggctctcacatatgacctggacagtaaacgtgctacactggtaacatactagtatcaaggagaattccatatcatacatagacatacacattatatacttttcatcaactggaatgctctgcttacaggcattaccaaatcacaccctagtaactcgacagtctagagatgcagtggatattcacatcacatttttctagcacaagg

SEQ ID NO: 699285 - DNA, 362 bp, Homo sapiens
cgtctgcaccggcggcaagcgctggaatgtgcttgtacagcatgaacaggtgactgtgtggcaggccgtgcgggcgctactgctggcggtcctcgtctatcgcgcgcaaggcaatgtcgcgtgcatcgtgaacgtgaggcaatgatggaattgaatcacgatcataacgagcgcgatcgcgcccgcattggcgctgctgccggcgcgcatggacacgcctggggcgcgcgtgatgctgctggccatcggcctgcaggaaagccgcttcgtgcaccggcgccagatcggcgggcccgcccgcggtttctggcagttcgagaagggcacgcgcgccagccgcggcggcgtgtggggtaccgagc

SEQ ID NO: 699286 - DNA, 158 bp, Homo sapiens
accctgaaaggcctcactgtccacccatcacaggcatgctcattaggaaaggttaaaaaagtcaaaggaactcggccacagtcttaccccgcctgtttaccgactacatcacctcctgcatcaccagtattagaggcaccgtcctgcccgtttctggt

SEQ ID NO: 699287 - DNA, 1194 bp, Homo sapiens
ggcggatgctggttcctctctctgtaggctttgaatagctcgcacccagcgaatagtttccgcgcttgtcgttccggctcctcatcatggggcgcattggggatcggccagccaggggttatagaggcgttcgcgcgcgcgcatacctaagctttgcgccagagacagcgtgatcacatatggggtccgagtcgctataagatggtggaacaccctcgccgcccggagggtggtagcacgggatgtacccggggggggttgcagagcggtcccatactattctcggcaaacgggcggctttccacgcaaatcggagggaataagcggtgtatgcgaggctctgggatagaggggccttccgctgcttggggccgtgggaggttgggtggcgtcaatgcgcggcgtgccaggggtctggacaggaaaacggatggtcggggcgagtaatagggggaagccttgggataagtagtcgccagggttaaaatggatggacgcagctttgggagcccggcgacaagaagaaaggcccagaaggggggacagaaagagccagggccgctcgcatagggatgagacggccagggcagcgccagggcggcgcgtgccctcaggcgcgcgcgcgcagagcgaggaaggagggcagcgcagcgcaagccaagtgcaggcgcagcgcaggcgtgctaggagggttcctccgcaaaaggccgccgcgatggcgcagcgtggctgccgccagcgccgctgggccgccgcagcggcgtgcgcagcgcgtagagtccgcgaggaggctgcgcgagggagccgccagccagcccgccgctgagccgccaggactttgagccagctagcgtctgctaaagaggtagaagatgcccagtaggaggctgcactggagcagcgtacggctgccgccaaggagccaggcctaaggagctcaggccctggcggttgccagccgcgcgccagcggccggcacgagaaagtagcagaatcagccgaaggggacgggaggagcgcaaaggacagttgtttcatcgctcgcatggcgcaggccaaacagagaggagcctgtggacagccggatcgcccgtgacgcgagagagttagctgactttacacggagcggattgcaaagcaaaccaaagcaagaataaaggcagctgttgtctcttaatacctaccgggtaggga

SEQ ID NO: 699288 - DNA, 409 bp, Homo sapiens
gggacctctgcgtatacgggctcccggaccagtagactaggcagtcgtctagcagcgctccgtcgcaacggagaacgtaggcggtcgagcaccgagcctagtgtagcgccctgacggccaattagaacaccacctagcggagggggttcctagcggcgtgggctcctcgtggtatcagctccctgggtagtaggggtcttgcaggaagacagctgacggaaatgtataggcaccccaactcaagtcccaggccccaggcatctttcctagccctgccttgctaggcccatccagtccaggcgcctggagcagtgctcagctacttctcctgcactttgaaagacccctcccactcctggcctcacatttctctgtgtttaaattccttcccccaccccgtcgggtggag

SEQ ID NO: 699289 - DNA, 420 bp, Homo sapiens
ttctgaagaaacacaggtttcctgacatgttgattttagcctggtaagagccattttcgactcctggccacccaaactgaaaataataaatttgtgttgttttaagccactaagtttttggtagtttgttacaggagtaatatgaaattaacacatatttggtacctggagtggggttccgcctttgggcatgggcaaaaactagaagcattttgaggaccacgttagaaaaagcctagattggcctggaaagattttgagtaccaatatggtcactagcaactctggtaatgaggactcagaggaagtgaggagcacagtagagaaaatctacatcatcttggagtatacataaatcatcgtaaacacattcttggtagaaatattggtggtgacagtgcagaaagagatgaagaacat

SEQ ID NO: 699290 - DNA, 143 bp, Homo sapiens
  misc_feature (41)..(41): n is a, c, g, or t
  misc_feature (49)..(49): n is a, c, g, or t
  misc_feature (133)..(133): n is a, c, g, or t
  misc_feature (143)..(143): n is a, c, g, or t
gctcgtcgggtccctcagaccccagcccaggacctgcgganggccgcancgaggagagccaacaggctttcctttgaactgggccggtgttgcacctggaagcccccgtttcctggggacccagcaggcggcngctggctcgn

SEQ ID NO: 699291 - DNA, 203 bp, Homo sapiens
aatactgtgatgtaattatagcaaggcttctgatatgattgatgtttattatgactctatctggctgaaatgcatatgtttactctagaggtatagactctagtatagtgatagaaaatggaaataaatagccctacatgtcttttttattgtatgaggagtacaactattatgatgctttatacatgtagcacacaatagca

SEQ ID NO: 699292 - DNA, 248 bp, Homo sapiens
cgatcccctttgaacgagacgactcctagtgtgtaagagttctgctctggagcttctaagcacgtagttgaactatccctgtagggattgtctgatgaagagaaggtaaaaggctataattgtatttttttttttttttttttttttttttttttttttttttttttttttttttttttttttttttttttttggggggggcccccccccctttttttttcccccccaccagttttttttcccccaaa

SEQ ID NO: 699293 - DNA, 410 bp, Homo sapiens
tgctacaccacgagattttcagtgtattccaaacagccttcttttggaagaagaaaccatctaggactttcatggagaagagaagttaatccctggcttaaaagcatcaaaggacagctcgtctctcttgttaggggttcatgcagctggtaactttaagttgaagccaatgctcatttaccattcagaaaatcctagggcccataagaattatgctaaatccactctgcctgtgctctagaaatggaagatcaaagcctggatgacagcacatctgtttacagcatggattactgaatattttaagcccactgttgagacctactaaatattaggaaaaaagaattctgtcaggtgtggtggctcacacttgtaatcccagcactttgggaggccaaggcaggtggatc

SEQ ID NO: 699294 - DNA, 573 bp, Homo sapiens
  misc_feature (15)..(15): n is a, c, g, or t
  misc_feature (23)..(23): n is a, c, g, or t
  misc_feature (50)..(50): n is a, c, g, or t
  misc_feature (132)..(132): n is a, c, g, or t
agcagatggcccaantggctcangccattattcccaacatttagaaggcntaggcaggagcattcacttgtgcctgggagttcttagactagcctgggcgagacttcatctctacaaaaaaagcaccaacgncaaaaaaaattagccaagcatagtggcacacccctgtagtcccagctacttgggaggctgaggtgggaggattgcttgaacccaagaggtcgaggctgcagtgagccaagattgtgccactgcactccagcctgggtgacagagcaggaccctgtctctattttataaattaaaaaaggctgggtgtggtggctcacacccataatcccaacactttggctcagcagattgcttgaacccaggaattcaagtccaatctgggcaacatggggaaaccccagctctacaaaaaaaattagcctggtgtggtggcacatgcctgtagttccagctactcaggaggctgaggtgggagaatctcctgagcctggaaggtccaggcagtgagccaagattgtgccaccacactccagcctgggcgacagaatgagaccctgtctc

SEQ ID NO: 699295 - DNA, 190 bp, Homo sapiens
aaaataaacaataggcgtgtggtgcgcacacctgtagccctatactactcaggaggccgacgtgggaggatgtcttgagcctgggaggctgaggctgcagattgcaacactgcactccagcctgggtgaccgagtcaggctccatctcaaaaaaaccccaaacgtatatatctgctatccccaaacatat

SEQ ID NO: 699296 - DNA, 737 bp, Homo sapiens
  misc_feature (11)..(11): n is a, c, g, or t
  misc_feature (48)..(48): n is a, c, g, or t
gccctctgcgntcctcactcttccatcacccgcgtctatcatcctcanccacttctcacattaccaagggtcactccccaagcgctagacagcatgcacatgcctctatttttctgcgggcatctaaggagacagcgcctggctccgaaacccaggctggaccacacacatgccattgaaagaatgcattccagcaaaaaaggaaatcccagaaggacggaagcttcggttaccaaaggctccccaatcattgaaccctacttcagccaggaagaaactaaggggggcaaccaacagcgatacccaacctgcgctaaataaaaagcccagcagcggggacgaacccaacccacaggtgaaaaaaggattgtagatactgccaaaaatccccgatacccacataaaacgctgaacaactgcaggcacatgcaaaacccgataaggtccccaaccccatttcaataagggggtctcagaaaacataacgctcacaaaaaaagtggtggcaaaaccactgacacccttctggctgataacctgcccagagaaccaccaactgggggggaaaaaggagaagatctttcaataggcagcacaccaatcagtggtaacgctgataaagcccaaacaacacagatgaaccaaaaaaacccccctcacacaaaactcaccaaggacccaggctaaaagcgtcaaaagccactttaacctccaaggaacgacatccttgacacacc

SEQ ID NO: 699297 - DNA, 283 bp, Homo sapiens
tagagccccccgttcatgtagtcctagagctgtatactgacccgaaaggaagaaagcctctccttcatgaaagaaacagagggcatacggtaaaacctcgaatgggctgctaaaatacatagaagagagatacatactccagagcaagcaaaggacgaactagctcagtatcagaagtgggatatcatgagacgagccctgtgaatataccagtttccagtcaggaacttaacgagacctcgtgccttgcatgaacagagcagcgtacggagctctgaattcg

SEQ ID NO: 699298 - DNA, 309 bp, Homo sapiens
tgatcaaccgcgtccccagtagagctaaatgcagctgaatagtaaaaaattccagttaagacatgatagacaacgaaagtggcttctcaatatctgaacacacagatagctaacagccaaactgggattagataccccactatgcttgagccctaaacgtcatcagttagatcaacaaaactgctcgccataacactacgagcgacatcgtacatctcttcggacctggcggtgctcatatccccctagatcgatgcctgttcttgtcctctataaaccccaatcaccttagtgggggagtcctctata

SEQ ID NO: 699299 - DNA, 490 bp, Homo sapiens
cattaacattctcgggggggtcaggtaccggtggcaggagtggacatatttacagggttcatcaacatatgcaggttctccagggccacattggttacgagcacaaactttaaataagtactcttttcctggaacaagatcaggaacggtgaattctagatcagtcacaaagtccataactttagtccaggttttccgggcggacttctcgtttttcaacaaggtatccagttaagggacttcctccatcatcatcagggggttcccaagtcaaaggtacggagtcctgggttatatcaccaaatttcaattcttggggtgcactggggcgagcaattacatggacatcaatttccccagaaatggttttcacacggttttctaatttcagggtataaaggccctggtctgaacgttcactgggagaaaggacaagttcggcataggcagacaaggtcttcattttcaccgggtcccctgaggatcactt

SEQ ID NO: 699300 - DNA, 150 bp, Homo sapiens
cagcgccagtgtcctgcaggtccatgctgcgcgcgcccaccagtcccgcacccgttcgggccagggtaagttagccctcagcatgcctgtgtcaaatggaggcaccaatgtgcttcaatatacctagctgtatcggatttaaccttcata

SEQ ID NO: 699301 - DNA, 762 bp, Homo sapiens
aagagaaccaaagcactgaagtgtactgctacctgatggaactggacggcgtgtcatatcaggtagaaccctccaacgtagccccattcagccatcgtaagctatgcaggatcacttctaacacgacaggactgggcagggaagggattggtcgtggtattcatgtaaatagaacaataagtgggccatgtttactgatagagtactctcccaagaagcaatccgatctgcacctctacagggatagagctgcagtcatacccgctttactgaccaacaggaagcacaagtcaaagtaccagtaattgtaacacgcgaagacgttggagttctcactatcgattgaacctggtgactcctgaagagtagaacacgttgacgttggcaaaaatggcccagagataaacgtactagacacagggacattgtgcccactttagagcgttccttgtaagcactcgcaagccattgaaactaattctgcgtcatggatgctacacaaccacaagacgttctttgtccgatacacagccttggataccctccaaagttccttttaaccttcacgtgttactctattgtaaaacaactcgagaggtgtttgggtctagtttagccaaaggcttttcaccatagacacgtgctaaccaatgaccagtttgtgtacaccttcggtgtggccatctaactttaaagatggcaaaccgtttccctttggttaaagacccagttttcattccagtttaaaatcatttttaaacc

SEQ ID NO: 699302 - DNA, 229 bp, Homo sapiens
ggggactgacaggaaccacttaacatgtaacttaaacggaattattttctttagaggatcctcttcaaaaaggaagggatagtggaaaactgtccttatttcttcagatccctagcagaaatgactgtttattccaaactatgtttaacttgtctatgatgtagtcaccttaactatctttcatttccatacttcccccgccccgatttcaaaggctaatggttgtatt

SEQ ID NO: 699303 - DNA, 148 bp, Homo sapiens
tgttctgagatcccaagcagtatacagactcatgtataaaaagtacatcatggttcaggaaacaagcccaccaagtagagagcaatcatgcatccgtggatagtcaaaggttagtcttaggaccacataagtctgtattaactgcttg

SEQ ID NO: 699304 - DNA, 574 bp, Homo sapiens
  misc_feature (1)..(1): n is a, c, g, or t
naggttgtgtcgtctgttggggcgagtgtagtgcctctcactgtgttcagacagtctctgtgcctcctcctcccaccccagttcctccggcttggtgtactgacgggggtgctgcggggctgaatggtactccatagctcgtggagctggggagtccacttttgcacccgccgcgtggctagctccccctgagctgttttggtcaattttgccatcatcctacccctcagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggtcttctctcagcaaatattgagcaaacactgactgtgccaggtgatgtgctgggtcccaaacccttcccagacccagccctggcactcacggagatccagctaggaagtc

SEQ ID NO: 699305 - DNA, 355 bp, Homo sapiens
tattaataattacttaatgtacgccttctcatcccagtcacagcatcagaaagggcaaatcgaatgtatgacaaagactctgaacacatggccatgaagtgctggccttgccatctgcaggacatctccctatcgatcggataccttcaccttcactctctgatacaaagtgagacagactgaacatagtcctgtgaacatttaatgcctgtgcccagaccatgggtctgtaccaattgcaggagtcaccgtggggaggagccgggcacttggagtatgactgccactgtctgaattccagatgagcccattcctaggccagtgcctgggacagttatctgacctctgagatcca

SEQ ID NO: 699306 - DNA, 376 bp, Homo sapiens
  misc_feature (33)..(33): n is a, c, g, or t
  misc_feature (53)..(53): n is a, c, g, or t
  misc_feature (111)..(112): n is a, c, g, or t
  misc_feature (311)..(311): n is a, c, g, or t
  misc_feature (318)..(318): n is a, c, g, or t
  misc_feature (359)..(359): n is a, c, g, or t
  misc_feature (365)..(366): n is a, c, g, or t
actatttcacacatacagtcccctggcatgtanaagggacttaatgttgaaanaaggggaggcattttaaaatccacatcaaaaaaatgttgttctgtttgggaagtgggnncacgcctgcagtcccagcgctttgggaagccaaggcaggtggatcacctgaggtcaggagttcgagatcaacctgagcaacatggtgaaaccccgtctctactaaaaatacaaacattagctgagcatgggggtgggatcctgtggtcccagctacttgggaggcttaggcacttgaatgagaatcgcttggacccggnaggtggnggttgcagtgagcaatgattgtgccactacctgggcaacangaagtnnctctgtctca

SEQ ID NO: 699307 - DNA, 520 bp, Homo sapiens
ggtctctggcctcgccggtcttggggggatggttccactcatggcgtcaatgcagaaactgactacagaaatgaactgtgtggctttgcaaaattgacccacctcctggaatgaccctttaaaatttgcagaacagacgttgttccaaaattcaaattaccaccagtggatggtacgacatggaaggtgccccaggtaccttatatgaaggggaaaaatttcaacttctatttaacatttagtagtcgatatccttttgactctcctcaggtcatgttactggtgaaaatattcctgttcatcctcatgtttatagcaatggtcatatctgttaatcccattttctaacagaaagactgggtccccagtgctctcaagtcccaattcaaggtttgggtccttaagcattattagcatgctttccagcttgcaagggaaaagagacgaccaccggataattcttttcatgtgcgaacattgtaacaagaatccaaagaaaacaaaatggtggtatcactga

SEQ ID NO: 699308 - DNA, 311 bp, Homo sapiens
aaaacctccaacacctcctcccccttcctcactctccagctgttaaccttacttcctatttcaggaaagtaacaaaaacagccagaagagaaacttttcagactcccaagaccacattgagccacctatctccatctgtgcttatgtactctgcttccttcttgttaggatgaacaatgggcgaaccttccaagttcctatttaaagttaccccaatctgtgcagaagatcctgtctcctcccacctactcaaggcattactctggcaattatttcctgtctttcttggatcatcaagagacagatcttac

SEQ ID NO: 699309 - DNA, 427 bp, Homo sapiens
taaactggttaaaaattctgaattttaaacagctttccaaacaagtgtggtgggaaaaaaaaaatagtagttggaaaatgttttgggcagcaaaactctggggttaaataaggacatgttcccccctgttgcccattttttaaaggactagggccctctttcccaattttggaataattggggggaggtttaaaacaaaaaagccccttttgttaaaaagctatttcctttattaccctggaaactgactcagccccatggtggccccaattaaggtttaaggccccccttaggtgccaaaaaaattatttttttttacaagtaaaaggaggtgattccccctttggattggaaaaaaatgaaaaagtttcccagggctttatttgccttctggccgcctttttatttaatggtcaattaattgggg

SEQ ID NO: 699310 - DNA, 410 bp, Homo sapiens
actcgagctaaacccagtgcgcaacgcgctagtgctgaggtagtgccccgaacacagtttccctttgcagcatgcagctcctggaagcgcgttttcagtcgtatcggagataggccctaggtgggtccctccctagctggccatgcttgggtagcaagggccaggcccaacagggcttcttcatgccaaatcagccttctccttgaaggagaacatgtgtggagttggtttcaagctgcggagaccaccagccaagcagcagtgcccacggagccagaggaagcccagaccctccttgtggctaatggggagcttaggggcaaggtgagaactaggccagggccggaatcctaagccaagccgcataggggctgaagtacgtaccgggttatgcgccactgggggatcct

SEQ ID NO: 699311 - DNA, 391 bp, Homo sapiens
  misc_feature (21)..(21): n is a, c, g, or t
  misc_feature (95)..(95): n is a, c, g, or t
tacagagtgaatgtccagcangatgaaacctacaacctgctcaaggactacctcgactgggcgctgtaccggcaactgcgcctcaagcacggttngtcctacggcccgtgggtggaacgcgaagtgctcggcggcgttgggttcctcagcctgaatgccgaccttgagcgagaaaacctccctgaagccgagcaggtcttgcaagacctcaaggcccagttgctcaaggatggcctcgacccaacggtattcacacgcctgcaacaagccgccattgcccgccaagcctgggcagtgcaaggcaacagcgcactggccgactattactggagtgcggccggcgactactccaatgagcgtttcagcgacccggtcaaacgcatcaaggccg

SEQ ID NO: 699312 - DNA, 467 bp, Homo sapiens
tgaccctgttccccctaaaaatcctgttcttgcattctacgatacacaaacctctagggtttcagttgacacaatccagttcaacttgtactgacagaaaatattaaaaaccttcctattgagtttttaatatcaaacagggaggttagtaaattgttttctgattcttctacaaaaaaaaagtctagaagagggacagggaatgtagtgtgcaccacttattattattctaagtaataatttttacttacgaggtcaacacgagtgcaaagggcttagtgatgcatcttattctttgattttggacagtaacaccctcagatggtattattattggtttgttttatatcccccttttccatttgcccttctgttttgaagtgctttttcttaaaacttaagttctttgcctccattttcttataaacccaatttcctctttagtgcaactctaccatttgaaagga

SEQ ID NO: 699313 - DNA, 694 bp, Homo sapiens
gcgtatggacgctgacggcggtaatgccgcgcgtgagacacaggttgtctgtgtgaagctcgccagtagagaggccaacgatgtggggtaagatgtgaaagaagatgtctattatctaacgattgtgcgatagagttgtgtgcagggtagaattcgtggtaaggttgcgacactagctaatgaggccaatcgtgtatctattagataatgctgagtgtgatagtcggactacatatggtaaacaagttcgtagaaaataaggatgaacgcgaggcttgatgatggatagggaagagtggctcgctgtcatgctagtgccgtgaggtacatgtggcatacttcgtgacaacgactgaaggccgtgaatcggctgggtaatctaccacttcgaatcgtcctcgctgtgatgtgaacacttttggagaaccggtcaacgttcaccctatgctagaacctatcaagttggagtgacgccgcatggcaacacccagaacccacgtcttcacttcaaggaacacgcctgaattcaccaggtggtagctctccgtcgaggacctggaactcgctggctagtcactaggactttgctaggcacggcaggatggttggaagtgaaatgccggcaagcatgcgttgatcttcctatgcaatgcgggcaagcacccggaccagccttgcacctaatctgggcgtt

SEQ ID NO: 699314 - DNA, 990 bp, Homo sapiens
gggatctggcctctagctgtaacatcgagtcgtggggatctggaacaagatccgttcggacatctctcccggctgtccgcatcggcctccgatgtccgtctgggcggatagcgaccctgccgaggagcatcgtatctcagtgccatcgtaccatggaattcgggtcacccgtgtcagtcaccgtttaaagtaggtcagctcctttctgtgccagatcgaacactatgagctccctaaattgcgtcagaaggattccaaccggacgtgtaggctcggcgtggagcatgcactggtccgcatgtagtactctgagaggcctaccgtacagtctacgcatcgtcttttgggcttctagatcgacctgtgatgatgtggctcgggagggcgtgagccatttcgtacccgtggatcggcacgtacgcataaagcgcggagggctaacaagcgtctcctgtgacgatgcaaaatggcgtgacgatgcggcagcgcactcatcccaagagcaatcaaaggaagtccagcctgctcatgagtggggtacaatgcgagcatgccgatgaaaggtagctgttgccctgtggcctgaataatcctgaacgacgcctggggatcctccatggccgggtctgcccgccgtgaccctcattctctgtagactagcctgggaatctccactatactacaatcacgcaagtgccgcgatcccgccatatggggtgaccagctgaacaagcctgcagagcgtggggggcagaggcggtggaagaaacctccgaagatcaatgccacgggaatacaggctctgaggcagaacaatgaacggcttgaaagaaaggcatgcaggccaccacaccaaggagcttaaaggctaaagcggccccgaaaaaccggggacaaaagaaagaaagcgggcgcccaaattacctgcggcagaaagacgaggacgcaggatcccacagaggtacacacggtacagaccgaaacagtccg

SEQ ID NO: 699315 - DNA, 296 bp, Homo sapiens
aactcatttaagtaacgaaacctgcatgtccttttctaaaacacacacaaaattaaaaatgatttctctcgagtctctttcaccctcccaaacacactttgagaatctattttcccagaactgatctttgggggagaaactcatgtaactcccatcttcctggcccactaaaatataccatctgatgaaattctattagcatattattgttttaaatactggtatctccgatagagggcagatatcttgtaaaaacataggctattataaattatttgtgaacagcaccaaaaaaa

SEQ ID NO: 699316 - DNA, 1156 bp, Homo sapiens
taagaaccctcatcaatagatggagacatacagaaatagtcaaaccacatctacaaaaggccagtatcagggcgggggctttcgaagccaaaggtgagtgtttgtggatgtgttaaaggtgaaaatatttaggtgtgggggatgtgaagcaaattaggtgaggaaagttgtgagccaatataagtgacgtgtgaagttccggggaagccgtggtggctctaccaaaaaattgtgtgacgccggataaatgtcgccggctcggagaaatggggagaagggagaagaacccagaaaagttacctctgtgagggctatggtgtaggaggggttaaaattaagaagacccagataaaaattgtggtaaataaggcagggtgcgttgtgacatttatatgtgggagttccaggagtgggtttcccatattctaagacttatgtggggagggcctcaggtgtgatgtggaaatactctcccgtgagtgcgagagtataaataggggagtggtgttatatagagagagatgtgggggcacttctcttaagagaggagaatttaacgcgggggggtgaagtgcccggtgttggggggcgccaagagtgccctcttccttaaatgtggggggagagaatgagggggggctatgagaggcagaggagagtgtggggttaaaaagagtggcgcttcgagaaaaaaaaaaactccctgtttgaggaaaagagaaaaaaaacacactttttctgtgggaagggggatacacttaacacactggagggagaataattatcccccggagataaatacgagaggagggggcccatatagcggggggacccgagcgtgttgggctgtgttgcgtgggcgagggcccctaggggcacaagagggaggctaaaacacaacgggtgggtcacaacactccgagcgccccaaatacaagagggggggaacatagtgggggacacaagaggggaagaaacagcggaaaaaagcaaacgggcccataagataatgcaaagaaaaagccgcgataaagggggacgcgggggacacgtagacaaactaccacatgtcggccaaaaggccccgaaaaagcgacacaacacgagaagggggcgctgaaagaggggccccctgagaaaaaggggagacacaggg

SEQ ID NO: 699317 - DNA, 248 bp, Homo sapiens
ttaagctcccaggcgcagtgctcatgctgtagtagtccagaactttgggagtcgaggtgggcggatcacttgagtccaggagtttaagacaacatagtgagaccctgtctctgattaaaaaaaaaaaaaaaaaaaaagctcccctggaaggcccaggttgaggtggtcacaccccatattaatcccagcactataggaggctgaggtgggaggataacttgaccccaggagtttgagaccagcctggg

SEQ ID NO: 699318 - DNA, 533 bp, Homo sapiens
ccttgagtatcctgataactcctggaatcgccagacacgaagtgtatctaagagcccaggcgcacgccatatgtaaatacggatgtgattgccctggatcgaggcctgggtgtgccactgcagtcaggaagcatgaattgaaggagctgcatgaataccagatgaacacagagccagtgaggtagagaggaactggctgtcaccatcaccaagagagtttcgatgaacagaatggagtcagtgtggaggaagggatccaagggcaaccagcccatctcctcagggctcactcagatcaaggacatttgtttggcaatacagaagattactttttcatgtgtgggtccatcttgaaacattgggcggggtaggcagatttaaaatgacagaatcaggcctcctaagctcccagagaaactggaacaattagttaaacgctaacaagttcatcccaaattgggataaattactggttatctagtcccacaaaaggccatatggaggtatgcccttgcatggggcgataggaaagt

SEQ ID NO: 699319 - DNA, 184 bp, Homo sapiens
  misc_feature (43)..(43): n is a, c, g, or t
  misc_feature (45)..(45): n is a, c, g, or t
  misc_feature (54)..(54): n is a, c, g, or t
  misc_feature (69)..(70): n is a, c, g, or t
  misc_feature (83)..(83): n is a, c, g, or t
  misc_feature (105)..(105): n is a, c, g, or t
  misc_feature (145)..(145): n is a, c, g, or t
gagagcgcggtacccaggtcttttcccctcaaattccccgcantnccaggcgtnatcatatcgttgcanngcttgggcacaangcacatgacctccacagcttgntctaggtctgcagtatccatcccagctctattgtaatacntgagaaaatccttgagcaccagctgcgtttcacttccga

SEQ ID NO: 699320 - DNA, 134 bp, Homo sapiens
tagataatgagtcagagaggcagatattgatggagacggactatgtcaatctatgaagaattcgtacagatgatgactgcagaagatgaagacctactttcaacttcctttttccccccgtctagcaagaatca

SEQ ID NO: 699321 - DNA, 383 bp, Homo sapiens
  misc_feature (379)..(379): n is a, c, g, or t
gcgaaccccgtgaaagcacacccattcatgacaagaaatcatgacatttttcaaaacccacaaaacaatctatcaactaaaaataacattctaagccttccaactgactgaatggagacctcctcttggccaagggcattccaaagtaaacctgaaactagttcaagccttgatggaaaatggaggcccaacatacttcattatacccttctccctttggaattcagacacaactgaccagcattaacattaaaacagagatcttaagactgagagaacagactcctgtagcaataagataccaaattccaacctgactctagtatagcattatatgacagataacagccctgaaagaaatcgaagtattttacctcanaata

SEQ ID NO: 699322 - DNA, 374 bp, Homo sapiens
  misc_feature (92)..(92): n is a, c, g, or t
cggggcgagcggccatatgttctggagcccgcgcagcaggagcgctttcggctggagaccgaggcgttgtgtgcgatgtaccccatccttgnatacggggatcgctgaagaaagaaaagccccgtcttcacgctggaatacggggcttttcaggtctgcagaaggctgtgctggcgcttcgcgatacagccgggttacagctgttgctgcgcgctgtagccttcgaacgcggtctgctgctggatcgcggtgatgatgttcttgcgggtggcctgctgttcgttgccatccttgtcgaggaacatctcgctttccagttccgcctcgtcgccttcgccgacaaagctgaagccgaggaattcgaagacttcacg

SEQ ID NO: 699323 - DNA, 897 bp, Homo sapiens
  misc_feature (252)..(252): n is a, c, g, or t
  misc_feature (262)..(262): n is a, c, g, or t
  misc_feature (273)..(273): n is a, c, g, or t
  misc_feature (309)..(309): n is a, c, g, or t
  misc_feature (324)..(324): n is a, c, g, or t
  misc_feature (326)..(326): n is a, c, g, or t
  misc_feature (335)..(335): n is a, c, g, or t
  misc_feature (340)..(340): n is a, c, g, or t
  misc_feature (344)..(344): n is a, c, g, or t
  misc_feature (346)..(346): n is a, c, g, or t
  misc_feature (352)..(352): n is a, c, g, or t
  misc_feature (364)..(364): n is a, c, g, or t
  misc_feature (366)..(366): n is a, c, g, or t
  misc_feature (370)..(370): n is a, c, g, or t
  misc_feature (374)..(374): n is a, c, g, or t
  misc_feature (376)..(376): n is a, c, g, or t
  misc_feature (381)..(381): n is a, c, g, or t
  misc_feature (387)..(387): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (402)..(403): n is a, c, g, or t
  misc_feature (405)..(405): n is a, c, g, or t
  misc_feature (407)..(407): n is a, c, g, or t
  misc_feature (412)..(412): n is a, c, g, or t
  misc_feature (414)..(414): n is a, c, g, or t
  misc_feature (417)..(417): n is a, c, g, or t
  misc_feature (422)..(422): n is a, c, g, or t
  misc_feature (424)..(424): n is a, c, g, or t
  misc_feature (426)..(426): n is a, c, g, or t
ctcactcacactgctggaaggttaaagtcgacttcacgctagtttaaggaaatagctgacgctgataaccatgtcccaagcactgctctaagttcccaatgtgtccggaattggtgggttcttggtctcactgacttcaagaatgaagccacggaccctcgcgttttagactatgctaaaaacagcctcaggaccttcagcactgatcaacaatcctgggcatgggctgaccgacagttttcacccagagantgagatcatngaggagccatnttaaattccgcccagcgcaggctcccaggaatcctnatgtcacgatctcantncagccaatntgacnaacncngcagtnattaagtctagngngctnaacncncctcnaaaagnattgncncntggtannantngaatngnatnaaatncntngaacccacaaaagtttcgaggtgaacatattagcaaaaatgctctagcttatccaagcgacagttcaaagtgtcaaaggacttctagactcccaatctttccaccggcagaaagcaggctcagtagcccaaactggcgcattttaaaatgcccttttcagaagtgtgatggacaaagaaggatgtgtcagtgcaggccagtgtgtgcgggaccaatggcaaactgcagctcctgaactaagaaagactttcatatctttaacaacagaacccggagacactaggaactatgtgatagagactgtatgtgggccacaaagcctaacatatttactgtgtagatctttacagaaaatgtttgccaactcctgtggcactcctgtggcaactcctgctgaagcacttccaggttgcagaaccaaagccttaattccctagcttaaagtaaagggactggcaagtttactccacg

SEQ ID NO: 699324 - DNA, 145 bp, Homo sapiens
actcacgtttacacacagactgctactcccccaatcccataacacacacacacacacacacagactgcctactccaatcccataacacacacagacacacacacacacacacagagtgtctactccccctatcccataacacaca

SEQ ID NO: 699325 - DNA, 257 bp, Homo sapiens
tgtctgattatttaataaagcataaagaggattttagaggattgacattaagatttgagtcctggctgtagaagtaataagcgatatgatcttgaagtttacttaatttccttaattctatttgtttttctgtaaaagtcagtttaatggtatcgatcttacatagtagttctatgaaatgagattaacagtacagttcccaatccatagtacagatgatccctgatttactatgggtcaatgtacatttttcaact

SEQ ID NO: 699326 - DNA, 202 bp, Homo sapiens
gatcttatttgcggtgcctttcccctgcaagttacttacaggacgagaagcaccgtggctgagtctgtaggagccagcagattttgcgccagaaccggggcgcaaggcgtgtgaccggcctgtgccaagaccatgaagaagaaggctgagggcaccgtgtccaccgatggaagacttccacgaagttccagcaggcaatact

SEQ ID NO: 699327 - DNA, 112 bp, Homo sapiens
gatctagaggatcccgtgctcatttcagtcatctcgggctcgaggggatggcagcttcgggggcgactgggaaaagactatcaacattcaaggcgtgattgtgatacttctc

SEQ ID NO: 699328 - DNA, 1703 bp, Homo sapiens
gattgtgcttggaccccactccgtcttcctcacccgtcctcctccagctgcacagggtctctctcccagcttgtgcctgtacgtcgaatcggcggtcgtctgacgctctgcccttcccgtgtgggaagccctcggatcaagcgtcaactgtcactactgagcatggtgggtcacagcgaatctacgtcgcattcgacatgggtatcgagcaagctagccaggagcacagggctcctcgggtagcattgaatagaaagctgtgagcaggtgagtggtcgaggcacaacatgcgtgggaggagacgcgagactcaccgtgtagtctgcgttgcgtcaagtgcgtcgcgagctactgtggtgacatgacccgtctaacgcgtcatccagtgctcctagcacatgcacatggttcttgatgggcattgcagggactagtacatgagtgtgatcgtagttcgaggaacgcatgagggtcccctgagtcaattacagtctggttgtatccgagactgcgtagggaacgcaaagggcttgatccagtcactagaggtcagaccccaaaggggctagagcgcctcgtacgggagtacgagctacatggtatgccccggtccgcgtacgcatacgtgggaagtgcaaggctttcgaaattgcgcaagacaatatgggctctagacactagagttagttagttcttcgaattaacatggtgacctattcattaacacccagtggggaagcccttgttgtacaagtctgtggccttcgcgagacgggcagaggagttacgacacggtcccccggtgcaaaaagggccgggggaaggtaggcgagaagcgacacatggaaggccgccttcgcaagaaagagagagagaggccaatgcgggagccacacggtcagccagacagtggcctatggcaaggcttaagccctttgtaaggcccttggagctggccctagaaagtcgaaggtgtgggagacgttcccccacaagaaaagggcttagcacgcttgagcccaggggtatcagcgcccatggaaatggcggacggcaccccggtggggaaggacaggtacacggtgggggcccgcccttaacaaggaagactggtcgcaataacaggggttcctcgaaaaacgaattcacagccccgcgaagccaaggggcgaacaacacattaggaacgcatgtacgtgagatgcccccatgggtgcaagcgcggatcatctatatccttaccaaacacccaaagtgggagtaacaaggccccttgtgttcccctggaagacctaatgaacaacccctcccacgagaagaaattcccccgaggggcgaatctcaggcagtaggagaacagcgcgaacaaacgaaaaaacagcgtgcgacgaagtaaatgtaaacagcacctaagtcctccaggaaccacgacagaccaacggcggtaggacgaagtacagcgcagcatgggaccgacatgatacgagggagaagagctactcgagcacaacgggtgcgtgcactaagtagacaaacaaggcgggcggggataagaatgcttgctgcagacacaacgcaacaaaagtgagcaatgaacaaagagtcggacttaccgtaagaacaaacttccgaggtacgaaatcagaaaaccaccgctctatcacctgaccgtctagtcgacacacagcaggtacagactgatg

SEQ ID NO: 699329 - DNA, 681 bp, Homo sapiens
aagaacatacattatgaaaatgtattataatatctggaaacacaacattttcctctggcaggtgactttgtacgaaatgaaaaaaaaaaaaccggtattttttttggtggtcctttggggattaaggatatacatttagtagtcttggttattaaagggaaccggctgataagtacaagtgtgaccatctcattcaaaggttggtggttatgatgcaaagggatatgggtttcaatagaagcgggatccttaatactggatttctggaattcggtttaatattggtgtaaagtagacatagctgaactcacatggaatcctggagtttggttatcagcagcttggcagtggggaaacaaagaaaccaaagctggagtggttttaaagaatgaacatatctggaaatccttgctctcaaaacaaaacaatataatctatcaaaggtgttttactcagtgttctaatttttaaaaaattttatcttggatatttgatcaaatatttctgtggtaacaagtgtttgtttaccctccttaaaatgactaaagttagtaatagttattgggtttaacctaatacacaagtgattaagtgcttaaattggtattaatgaaaacattctgccagggtgttacttgaggatagcgaatttattgaagttgtagttttttgtaatttgta

SEQ ID NO: 699330 - DNA, 234 bp, Homo sapiens
gtacgtctctagacggatcccccggagacacttacgccaatcatatttaataaaaataatcatttgcctaaccattatcttctagagttcctatagttcaaatactttatgaattattcaatgcacatcatcatcttcattgattttagaagggaaaatctgaccctaataagattttttttttatttcccactagaaacctatggcatactattggtcttaacgtgacttttt

SEQ ID NO: 699331 - DNA, 1645 bp, Homo sapiens
aagccaatgcgtacgtgtgacgcgtgaatatatccaaggcgtgggctgacgcatacgtccgtggactcacggatatccgaatcacgtggaacgcgtgatggggcgagggttgaacaagacgtgtcacaagactcggagagcgcgtgagtgaccagaacggacgtcgagacacgagctatggctcaccgtctcgcacgtagaccacgatgagacttggctcatggcaatgcagactcatgcagtaagcggagagcgtctccatgcgaccgtaggggcctccggacaaacgaaacggagaaaccggagatagaacggaggtatcccagccggagaaatcggccagccggaagcctgagttagagcacagggcaaactcgagctagtggactgccgaatgcaatagagtcgtgtcctttgcgcctaggagtgtggctggatagcccttggcggtaccgtcgggggctgaaaggctggacgcctcttggcttgggacttagcgcgcgtgcgcaagggggtgggccttccgtggtgcgtagactccgcacgctggtacctggggccggccatgggactaacggagttcccgtgattcgcttgaaccctcgagtatgtctaaatgccctgtgcatagcctaattcgcccagccagaatgactagagaaaagcgggtcgcctctgcgagcatgctacgagggcaccgcaaaaacttcgacgaacaaccagttcgaatacctggacgtatgcctagacataatcacgagcccaagtgacgcccccgtggacgaccaaagaggtccgtgggtggcctgagcgagagaaagcgccaccccgggctcgcgataattcgcgggcgcctcaaggacccgcccaaaacgttaaaaccgagaccccagatgcaaaccagacccttggctggaaccacgagggtggcctccttcgtagcccaccttgagcaagcacgggggcaacaacagggaataccccgggcgcttgcttcgggcccccaacatgcgagtccactcccccaaagagcaaggggccctacgctccccacggagaaagacacgacaggggccatcagccactccgccggacccatggcaagaacaggacatagggaacaccgaacactgccgcattgtgatcccacacatccgacttacgtcacgacacactcatcaacactgctgccacacacactggcagtccccacacaacagcacgatcgcatccacacacacgagagccacacacacacgtagtcagcaaaacagcgcaggcccatgtgggatgacaccacccactccacacaacctctcatcaagtcaaccaacctccaaccccaacctcgcggccgcgtcctcacccacctcagatccagcagcacacaccacagcactaccgcccagcaagcaagggagccacaccacaccgtactacaagccgacagagcccaaccagaccaccgcagaagacgcacacgcccacctccaactgcgacgccactcagtgcagccacccccagccgcacaccaccaccaccaccgccccccgcccgacccgacacacgcggctgccgtaaccgcacatctctcacacgcgcaacacgaccaccgccccgcactagcacccacaacaccccacc

SEQ ID NO: 699332 - DNA, 205 bp, Homo sapiens
ggtaaactcacttcgagttattaccatgtatagctagccacactagatgcgagcgtaaggtatctgtgatcactgtgagagaccgtgtgtcatagatatagaggcgtaagggatgcactgtgcacagatattgtagatgagtgtctctgggcctctgtatgcctcatgagtaatcgatcatctgtaactaacttatcaaggccgc

SEQ ID NO: 699333 - DNA, 890 bp, Homo sapiens
aaactgggggagtcttgtggagcaaaatccgtttcctccgcagtccgcaatgtattccgtcgaattttgtgccataatgcttgcgcgtgtcttgctcacaccccattgtctcgcgcgatgtgtccccccccgtgtgtgcgccctcgcgctatgccccacattggggagctcccccatgtctaccccgccactatgcatgagttgtctttctttggtgttacgctcccactgtgtgtgcataccctcttccctcggagggcgaagcacccttcttatgtggacacccgtgtgtagaacaccactcccgagacatttcgcgtgggtccctttgccccagcgagtgccacttcgtcttgctgaaaagagcagccctagctcccctgtctggtcactccattgtgcggacttgtccccccccatagttgtcttcgctcgggcgcacatccgccgttgctcgcacgtagttgtctttgacacgcccgtcctcccgcgacgagggcatccacactccattgggctggttgcctcctcccctcgagaggcactcgcgactggcagcgcaccactcgatgtctccaactcacaggggtcgcactcactcacgggcacgcaccgcggagtgtacacgctctgtctgtgatgaacggccccagtttgttctaatagggagcgagtgcaacacacgcaccaggaggggttattccctcagtgggagtcacccggacgagcattcagtggtgcgctcacagcagtgctccccagtaacaccacaccgagagaatcttccgtcccctgcggtacaaatgagttctcaccgaagcagccactcctgtctgttaagaggaagaagaacaagaatgaggttgctgctcgaccccatcataacgcaa

SEQ ID NO: 699334 - DNA, 239 bp, Homo sapiens
ggaaaatgacatataggcaggagcaatggtgtgaaccccggagtcggagctggcagtaagccgatgatcgccccactgcactccagcccgggtgacaaagcgagactccgtctaaaaaaaaaaagaaagaaagaaagaaacaaacaaacaaacaaacacttggttaatactatactacatgattccacttgtatgaaagctctaaaaaattacattctaattctatagttggccagaaa

SEQ ID NO: 699335 - DNA, 173 bp, Homo sapiens
aagtgcagtggagcaatcatgggcttgctggaagcctcagcctcccaggcccaggtgatcctaccacctcagcctccgagtagctggggactacagctggcatgtcaccacacccggctaatggtttctagtcctagtacagatgggggcttggccatggtggcccaaggggt

SEQ ID NO: 699336 - DNA, 121 bp, Homo sapiens
cgaatgagctggtaccctcccttctctcacgcgcagacggatcgtacacacgcgtcatctcgaaacttcgtgaccaagcgcgcgcataccccttggccaacccagttttcgatgacagaaa

SEQ ID NO: 699337 - DNA, 954 bp, Homo sapiens
gcttctctacccgggacggcttactattgcggctagcgccgagaaccccaccccctttctttgcggaatcaccatggcaggctggagaccctgtacacgtatcctgaaaactggagggccttcaaggctactcatcgctgctcagatacaagcggggctcaggtccgcgtgctctccgagaccagcccacattccatattatggaccaaaccaaccgcaccccatgaatttcatccgccaaatttcctgcacggcaaaggtcccagcaatatgagggtgatgactggattctgtagtgtgtagagagcaacgccattgcctactatgtgagcaaatgaggagctgcggggcaagtactccagaaggccgcagcccagcgtggtgcagtgggtgagctttgctgataccgatatagagcccccagccagtacctgggaagtaccccacctatggacatcatgcaccacaacaaagaggccactgcgaatgcaccggaggacgtgaggcgactactgcggctgccggactgcttactcgaccgacgaggactatactgcctgggcgaacacgtgccatcgggctgagatcaacaggatgtcgtgcgaccctagagcaggcatctataagacagagatactaagagaccttactaaccgaccaggaccaaaccaaggtaccaaccggagtggccctcaacctgcgataaaccaggccccgatccgaggcagcacaagagcggcaagtcaaccgcggagcgcacgcggcccccacgccagccaggcacaagagacgtacagcccgacgccgcggcaccccatacgcacgcacaccaccgcaccggaaagcacaccggggacacacgggagaagaagaccggaacccccacggcgagggcagaggacagcccaccacaggcagggcccaggcacccggagagcgcacctccgcccacgg

SEQ ID NO: 699338 - DNA, 775 bp, Homo sapiens
  misc_feature (25)..(25): n is a, c, g, or t
  misc_feature (64)..(64): n is a, c, g, or t
  misc_feature (66)..(66): n is a, c, g, or t
  misc_feature (74)..(75): n is a, c, g, or t
  misc_feature (105)..(105): n is a, c, g, or t
  misc_feature (119)..(119): n is a, c, g, or t
  misc_feature (261)..(261): n is a, c, g, or t
  misc_feature (263)..(263): n is a, c, g, or t
  misc_feature (278)..(278): n is a, c, g, or t
  misc_feature (283)..(283): n is a, c, g, or t
  misc_feature (285)..(285): n is a, c, g, or t
  misc_feature (290)..(290): n is a, c, g, or t
  misc_feature (292)..(292): n is a, c, g, or t
  misc_feature (328)..(328): n is a, c, g, or t
  misc_feature (359)..(359): n is a, c, g, or t
  misc_feature (379)..(379): n is a, c, g, or t
  misc_feature (385)..(385): n is a, c, g, or t
  misc_feature (397)..(397): n is a, c, g, or t
  misc_feature (415)..(415): n is a, c, g, or t
  misc_feature (459)..(459): n is a, c, g, or t
  misc_feature (461)..(461): n is a, c, g, or t
  misc_feature (502)..(502): n is a, c, g, or t
  misc_feature (519)..(519): n is a, c, g, or t
  misc_feature (531)..(531): n is a, c, g, or t
  misc_feature (540)..(540): n is a, c, g, or t
  misc_feature (558)..(558): n is a, c, g, or t
  misc_feature (645)..(645): n is a, c, g, or t
  misc_feature (692)..(692): n is a, c, g, or t
  misc_feature (773)..(773): n is a, c, g, or t
taagtgtattaaaaataagaaatantcgtaagatggcagtataaattcatctctgcatgtagangncggaaaannagcatgttcagtacttcaccaaaaaatttnaacattgcaaacanaggaaattgagaactgacaaacagaaatactaggaaatgcaaagtcttgaagctccaaaacaaaaacagcaatcttggaaaggcccctaatctacctcctcaatggtggggcctgacccagaccctcccttaaaaccctgancnccgaagcccccaggnccggnancaccngnaccctggtacagtccgctgatgatggggttacacanctgctccagctccttcctcttgtgctcaaantcgtccttctcggccaaggngttggngtccagcacganatgacctcttgacactcntccagcaccttcttcttgtcggccttgctgattttgctcttgancncctcatcctccacggcgctcttcatgttgaaggggtagggntccagggggttcttggntgataacctttngggctggancttgtcctccgctttgtncttctccgcctcctgcaccatgcgctcgatctcctccttgctcaggcggcccttgtcgttggtgatggtgatcttgttggccttgcnggtgctcttgtccgtggccgtgacgttcaggatgccgttggcatcgnatgtcgagggtcacctcgatctggggcacgcccctgggggccggggggatgccgctcagctcgaagcgccccaacagattntt

SEQ ID NO: 699339 - DNA, 108 bp, Homo sapiens
catggatttgctggtgcagtacaactaggcttaatattgtcaagagtttcagatagaaaatgaaaaacaagctaagacaagtattggagaagtatagaaaaaaaaaaa

SEQ ID NO: 699340 - DNA, 102 bp, Homo sapiens
tggtgaatggactgaggtggatggccaggaagctgtgtagactgggaggagaggagcctcttttgctggatgacgagggtttccagttgagtgtgtggagtt

SEQ ID NO: 699341 - DNA, 383 bp, Homo sapiens
  misc_feature (11)..(11): n is a, c, g, or t
  misc_feature (81)..(81): n is a, c, g, or t
  misc_feature (123)..(123): n is a, c, g, or t
  misc_feature (163)..(163): n is a, c, g, or t
  misc_feature (165)..(165): n is a, c, g, or t
  misc_feature (172)..(173): n is a, c, g, or t
  misc_feature (178)..(178): n is a, c, g, or t
  misc_feature (180)..(180): n is a, c, g, or t
  misc_feature (185)..(185): n is a, c, g, or t
  misc_feature (193)..(193): n is a, c, g, or t
  misc_feature (197)..(197): n is a, c, g, or t
  misc_feature (211)..(211): n is a, c, g, or t
  misc_feature (221)..(221): n is a, c, g, or t
  misc_feature (228)..(228): n is a, c, g, or t
  misc_feature (232)..(232): n is a, c, g, or t
  misc_feature (271)..(271): n is a, c, g, or t
  misc_feature (273)..(273): n is a, c, g, or t
  misc_feature (278)..(278): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (300)..(300): n is a, c, g, or t
  misc_feature (364)..(364): n is a, c, g, or t
aaagaacagtncatttctgtctacattccgacaatccaacgaggcggcatgggtcacatccagtttgatgaggtgacaganccagcagtcaccatccatgggcatggttcccaggggattggngagacacagaccatacatgatacaaaatgattctgcagcnantttgaannagtgnancttcngtcctaanactnttgtattaacggcnagggagtagngaggtgntgantgtaagtatgagagtttggtagtgatagagagaggtaantnactgnggnggangnaggccatttgtgngggtagtgtggctttttctgcagttgcttctgttacaaaattcggtcttttcgcttgggcagcntttttttttgcttcacgtc

SEQ ID NO: 699342 - DNA, 373 bp, Homo sapiens
  misc_feature (170)..(170): n is a, c, g, or t
tgctctaaggatcctactgggtgaggagtgatgtctagtaagaatgaggcacaatgggcagagcataagcagtctgataggatgcatgttggagttaacttttcttcccaggtgagcatccaactgtcctgagaagggggcctacatgcccaaatatgcaacatcttgtntaaataggttttcaagaatttccaaagcaaacagtgaggtatttactggtttacagttttatcttctcaggcaagaatgttctggaataaatggtcatgttgacacaggtggtttcagtctacagtcctgataactaagccacggggacctctgtcctcaacacacacagtcactcctcacccaagctagggtaccgagctcg

SEQ ID NO: 699343 - DNA, 114 bp, Homo sapiens
actcctcgagcgaccattctcaccgacgcatcatgctctcctcccctcctccccaactccctcactcccctccttgagtgccgcggggggtgatcccccacgcgtcgaccgtgc

SEQ ID NO: 699344 - DNA, 555 bp, Homo sapiens
  misc_feature (404)..(404): n is a, c, g, or t
ccaccctccccccccccacatctcctgttggtcgctcccgccttcttctctcgcccccaccaaattataccgccctccctctcccccatcgcgctcgcggcattctatttctccccaccccttccgcggccccctccaattttgttgcgcgcccacacaaaacgccccgttcctccttagcgttcatttctccccctctgccctgcgtgcgcaagcgttgtaacccccacttcccttgtgtttacagaatcccccgcgggacaaaagtgttccaggtgcttgagatgtcccccctcacgcgctgtgacgtttcttccaaacaccgcctggttgttacaggttccggggagcacgcccccgtgtaccagatcccctattgaggggccttgttgttgtaatcccantcgggttctttttttaatccccccccttccccccccccaacaagggggacatggtggagggaagcgggaaggtttttttgtggcatcgcacgatttagtttgtggtgtagactggtccccatcccgtgtaataaagcccccgggaaaggca

SEQ ID NO: 699345 - DNA, 254 bp, Homo sapiens
catgccccatagtcactgggaaaggatagcttcagccaggtggacccatgtgctcatgggcctttgcctagagggtgaccagcccggtctcagcccagcccccaccggacccagcacctaccctgctccccagagcatagccgtgaacgaaccccagcctcagccgaggggggtaaacagcctcctgcctgtatttggtggttgtggtgtgaatatggaggcagttgtccagtcagcggcagggtgagcggccg

SEQ ID NO: 699346 - DNA, 87 bp, Homo sapiens
acttagtttgggaaaaaaaaataaattgaaattgttaggcttttggatttccctttcttgcaaaaaaaaatttttttttaaatagta

SEQ ID NO: 699347 - DNA, 616 bp, Homo sapiens
  misc_feature (604)..(604): n is a, c, g, or t
  misc_feature (610)..(610): n is a, c, g, or t
aaaagtgaaattgatcttgttcttagagaaaaattgtacctatctgtttggatttctctactgtggtacagtagcaacaatgatagagaattcattcacatccatcaatacgagtatgaaaacactattttgtaaatgctttgattcaatttacagaacaaaaaccccatttaaatgatatatcttagacagtactgggaaatgctctaatactgtattttcctttacatttaccacgtgcagctataattttgaagcagacacagctacagaatgtacaatgtttaaaaaatttgacaattctaacattattagtatatttagtttccctgtgagctaatactatctctcttgaaactttctagagattaaaaatataattgaaggaggatgggttgaaattgtataagacaggatccctattttttttaaaaagtgacaataatatttttcatgctttagttgcaatattgggcagccatttttgcaaatatgggaggtagataattgtgaaaagagaagtgttaacatctcacatataaagcaacattatagaaaacaatatgtactattaccgtatcacacattcatcatgatatatgtntatatntaaata

SEQ ID NO: 699348 - DNA, 773 bp, Homo sapiens
  misc_feature (365)..(365): n is a, c, g, or t
tggctggggtctacggggaaaatgaagactattctcagcaatcagactgtcgactttccaaaaaaggtcgactttactctgaagggacgcacagtttatcgtgaagggccccagaggaaccctggcggagggacttcaatcacttcaatgtaaaactcagccttctgggaaagaaaaaaaagaggctccggggtggacaacaggggggggtaacagaaaggaacgggcttaccggttcggactattggtagtcatgtacagaacatgatcagggggtgttacactggggcttccgttacaagatgaggtctgtgtatgctcacttccccatcaacgttgttatccaggagaaggggtctctggtngaaatccgaaatttctggggtgaaaaatatatccgcagggttcgggatgagaccaggtgtggctggtcagtatctcaagcccagaaagatgaattaatccttgagggaaatgacattgagctggtttcaaatccaggggtttgattcagaagcacaacagttaaaaacagggacttccaggaaatttggggagggtatctatgttctctgaaaagggaactgttcaagcaggtgatgaataagatctaaaagttacctggttacagaaaagaagatgcccggatgacattaagaccaacttgtgatattcaagtgtttggcatacaggactattgttgtggcacaacaaaccaacaaaaaaaaaacatccggggatctaaggggggggggaaaaaggtaaaaagggcg

SEQ ID NO: 699349 - DNA, 143 bp, Homo sapiens
gttcattgacaccacctccaagttgggacatggccgcttccagaggatggaggagaagaaagcatgcatgggaccacgtgaagaaagcaccgacattgcaacaggaagaaggagcttaatgccaggacctagatttcgcagtt

SEQ ID NO: 699350 - DNA, 903 bp, Homo sapiens
  misc_feature (98)..(98): n is a, c, g, or t
  misc_feature (120)..(120): n is a, c, g, or t
  misc_feature (422)..(422): n is a, c, g, or t
  misc_feature (431)..(431): n is a, c, g, or t
  misc_feature (449)..(449): n is a, c, g, or t
  misc_feature (620)..(620): n is a, c, g, or t
  misc_feature (669)..(669): n is a, c, g, or t
  misc_feature (675)..(675): n is a, c, g, or t
  misc_feature (680)..(680): n is a, c, g, or t
  misc_feature (730)..(730): n is a, c, g, or t
cctagagtaacacgctctgctccagattccaaagtgttgggcgtcagccaccgtgccgggccaagtatgctttttctccctaggcaagcaaatggttntaggactaaactggagtaaganacagcaggacctgagtagtacaaaccattgattggagacaggagaggatggagtctctcaactcactatttacacttcacatttgttttgcccactgatcctcaggacaccaggggtcagtgatttatccaaagtcacacaactaaataattagtattgagctaaaacttgaacccaggcattctaactcctgatctaggaactgggtgaggaggagaattaataaagatatttaactgagtgggctgagagagaactcagaagtgttttcagaggcacagctgtgtgtgtgggcgtgtggntgtgtcggnaagagagttctccggaantgttatccatcactgttttaacaggacaatgtttggaaatttctgagcacaaacgtgaataacaaaacaaagtgcaaggcggctggctggccagtttgttttgagaggtaaatccaggagagccagagtagagaggcaactacctggcttgcctgtaactgcaggcttganccaatgaactcaagtatggtactgtcatcctgcccaatcaaatcttaanggctgngctgngcaccggggctcacgcctgtaatcccagcactttgggaggcccaggtggntggatcacttgaggtcaggagttcgagaccaccctgatcaacatggtaaaaccccgtctctgccaaaaatacaagaaattagccagacgagatgttgcatgcctgtaatcccagctactcgggaggctgaggcagaattgcttgaatctgggaggccgagaggggatcctcta

SEQ ID NO: 699351 - DNA, 1151 bp, Homo sapiens
ggctgtaccggactggaatgtttagtgatatagtggatccacgcgtgtcgtcaagattaatatgattctgctcccgccattctccttaggagagcatggttcgtagctcgtggacaaagatgtgggtccaaggtcctcatcccatcctccctctgccaggcactatgtgtctggggcttcgcatccttgaggtgcaggcacgggctgggacacgcggcttccctcccacccttacctgccttgcgcaccgtcacacgactgcccacgcaggcaaccactcttcagggactctcccatgctctgcgctcaccggcacgcggccctgcgcacactgcgcactacccgcaccaccactctccgccgcgtcgcccgcaccgcacctcgcctccccccgcctcaccctcgccccctctccactccctcgcaccacggcgcccatggccccctctgctcccccctctgcccccctctccacgcccgtcgtcgcccccctccccttgcccccctctgcgccacagctgcttccccactctgcgccacggactgcctcccctctgtccggcccccaacgcccccctgctacgtccccccccaccactccccccgcgcctcgccccttgctaccccccccggcgctacctctcccctcccccgccagtccccccctctcaacttctccctcacttcccacaccccctcccatgcacaccccaccacaatccccaccaccgccctccccctactctagcaccaccccctctcgctcccaaaactcgcctccaccccgacaccacccacaccccacccacccaccgacacacctcgccttacacacaccccctaccacccctcccaccctctcctccgccctcgtaccaccccccaccccacttcatctcccccccccctccccacccccccctaccaccctctccccccccctcccccctctctccttcactactcccccccccctaaccactacacatcttctctcttacctcacacaaactgtcgccatctctcccaccaccaacttctctcgttccttcttactaacaacaacaacaccaccattcctctccgatataaccctcccccctcccttctcccaaccacacctactctactacctaactacactaacaccc

SEQ ID NO: 699352 - DNA, 403 bp, Homo sapiens
cttcctcagaaacacgcagcagccttatcatttaaacaaggacacaccctggccgggcgcggtggctcacgcctgtaatcccagcacattacggaggccgaggtgggcagatcacgaggtcaggagatcaccaccatcctggctaacacagagaaaccccgtctctactaaacatacaaaacaaattagccaggagtggtggcgggtgcctgtagtcccagctactcgggaggctgaggcaggcgaactgcttgcacctgggaggtggcggctgcagtgagctgagatcacaccactgcaccactccagcctgggcaccagacgcagactctgtctaaaacaaacaacacaccaaaaaatccaaaaattctcagaaggctgcccaaaaccccttgagataact

SEQ ID NO: 699353 - DNA, 159 bp, Homo sapiens
gtgaggaaacattgaactgcttttcaacaaagctgtaccattttactttcccagcggcgtatgagggttccaatttgtccacatccttgccatacttattttttgttttttttcattataggcaccctcccgccctccacccctcccaaaaaaaaaaaa

SEQ ID NO: 699354 - DNA, 395 bp, Homo sapiens
aaatcattccacacaccaagaaacaggaaaatgtttccgaatggaaaaaagaccatcagtagatgcaaacaatgaggtgacagatgttggaattatctgataaggattttacagcaggataggctggaggcagtggctcaagcctgtaatcccagcactttgggaggccgaggcgggcagatcacaaggtcaggagatcgagaccatcctggctaacacggtgaaactccattctctactaaaaatacaaaaaattagccaggcgtgacggcaggtgcctgtagtcccagttactcgggaggctgagccaggagaatggcgtgaacctgggaggcggagcttgcagtgagccaagatcatgccactgcagtctagcctgggtgacagagcatctc

SEQ ID NO: 699355 - DNA, 1116 bp, Homo sapiens
  misc_feature (1096)..(1097): n is a, c, g, or t
ggaaagatggacggtgtggggacatggacgctgggtgtagctgaggagactggcctggagaccccataaaccggtgtctcctgtgtctccctccgtggaagcggatcaacccagcccatctgctctggcccccgttctggacccctgcagggtagtggtggggacggttcgaaattgaggcgcgcgaagtgggtaacagtcctctatctcactgcggttcaaatgccccccctttccttcaccggttgtttatcccgagccaggacccaaatcagcaacgagtgccctatcggaaattccaggacacaagacacgctggcttcagatgtggcttgggtggcgacagacacagggcacttgcaaggccttggaacacttgagacgagaagctcctgagttgccgtgacaagaatccccggggaaagaaaggaatccaactggcgtggccaatcgcaggggacaattgccaagtacgagccgacagaagatttcggcccaagcttggctggtctgtggggctcctggtgaacagttgcctcaaggcgggcatgatcagcgtgtggacagtttcccccttctttgtggctggaacacccgttcccagctaaacttttcaacgtggccctaaaagaaattccgtgggaagcctttctccaacggggccgcacgaagggccttcccacgaaaagaaaattatttttgggacggatacacttctttccacacggggctcttgaacgtgatttggggcagggcacacttataacgctcctgtatgcagaacaggacacacacctaaatttaaggggaacgttttaagcccccgggttcggtaagtgttcacatatggaatccttcaacgtgaagagaggattgtccagtgcagagatgagccatgaaaacagcgcgacagaagcatgatgtactgaaggatgcaccaaaatgggagcggtccacccttgaaacataggcatcgggcaaacgcgaaagtgcggtgtaaagacgagtagatacaggagcactcactgatatgatcctgtgtgtcttctctcgtcttcttctctcgtcgctcctcgactgagtgctccgttgatcnnagtggagagaacgaactga

SEQ ID NO: 699356 - DNA, 907 bp, Homo sapiens
  misc_feature (159)..(159): n is a, c, g, or t
  misc_feature (169)..(169): n is a, c, g, or t
  misc_feature (351)..(351): n is a, c, g, or t
  misc_feature (863)..(863): n is a, c, g, or t
agaagagataaagaaaaagaggaaagaaaaaagagaagataaagaatatgaaaaagaagaaaggaggaataaaggagggagagagaagataaagtaaggaaagaagagaaaataggtaaagtaggggaggaggatgagggagaagagaggagatgaagnggattggggnaaaaatgatgtgaatgatgatggaggaggaggtaaaaaaggaaaaagagaaagataagaaggagaaataggataaagtaaagaaaggaaaggatataagataaaagaagaggaggaaaaaataaatgagatgttaagagaggttgaggaaatgatggaggaaaagaagaaaaaattgagaangaggtggaagagatggaggaagaagaagatgatgataaagaataataagaagtgaaaatggaaaaattaaataaaagatataaaaatgagaaaaaaaaagaaaagaaggttggaaataataaaataaatgtgaaaagagaaattaaaaagataaaaaaaaaaaagaatggaaaaatggtattttaagagaaagttataaaatatgtgggagaagaagaaggaagaaggagaaaagagtgaataatagaagaggaatgtgggaaaagaatgtaatgaaagtttgaaagattaaagtaaaaatgaaagaaatgaaggggaaagaggatgatatgaaaaagggaaagtgagtgatgtggagaaaagatgtgtgtatggggtaaatgaaaaaaaatggaaaaaaggggaagaaatgggaaaatatgtgaaaaaaagagggaatgaaagaaggggatgtgatgtgaattaaagagaggaatgatgttaaatgtgtgaaaaaaatgaaagtggagggngagatttgaatgaaaagaaaaaggattatggaataataaatggg

SEQ ID NO: 699357 - DNA, 391 bp, Homo sapiens
cagaactgcatgttcggcggcaggaaaccgaggtccatatagtagttgatttcaacggcccaggtcgcacgatagctcacgtttccgtcggagttacaggtcacgccggcaacgcccgcaccgaacaggccgcactgcgtgaacgagttgtgattcaggaactcccagtacaccaacggggcgacgtcgatgtagcccttgtaggggcaggtcgaaggcgaactgcagaccgctgacgacgtcgcgctttgcgggcgcgaggaagttgttctcggtattcgcatccataccgacttcgaacgagatgttgtgcagcgggcccatggtgaaggccttggtgttgaacaactcgttccagccgaaggtggagcggaacaggccgtagatctcg

SEQ ID NO: 699358 - DNA, 171 bp, Homo sapiens
ttttttcatgtttctcactgcctgtataatcaggtctttattcaaaagaagctgtcaaaatgattgacctttatggaataacaattaagagttatcgagcacgaggcttcttctctgcaggctcttcagggctggttctggtagctgctgctttcacagagctctctcgct

SEQ ID NO: 699359 - DNA, 1180 bp, Homo sapiens
attcagaaacatgcaacagcgacaagacattgccccctactttaacacgtctatgctggggaaacaagcagccttgctagcagattgacgaaaggttgttctacaccgctaagctactcccagagtagactattgtggctcatcgaaactcaagacagaacggtgtctagttaactgcacgagcagcttgatgcccgatactgccctacccttcacaacggcacttactgcacgcaacgctagcgagcgctgctggcgcttactgctattcctggccatgaggcgtgccgacacattgcccaaagttcttacaactttctagcctagaaccaaatcctgcacagctaattgtcactggcgtgaccctgctgcgccttgcacccagaggaaccccagacgtggcatttacacgcggcaactttattgcacacgggccaggccacaaagtttccccacgaatacaaaggaacggaaacaaccccgacaaagcaagtccccccttggctacgaggaggattggccaacagcccccaagataacgttgggaaacttgaacacccaaacaaccaccatttccgttggttgaccctggggcccatgtggcttcctttacaacgatttacaccccatataaggcgaaaaacgccaacccaagcccccgttgtgccagttacacttgcagtcgcacgaaacttggccccgctgcggcccaacgaatttggcaccccactttctggaccccggaatattccaaccgaaaacacccctttggccgcaaacgcagggacagggcgggaacatcaagcacccaattgggcggaactaaactttgccctaggaaatcctatgggcggcgcacactttccctgtaaacaagtggcgcgcattgctcgtgcgccactttacaaggtaccaagggcccaattggagctagaccatgagacgcttggaggcccaatctagacacacccctcataccttgagcagcatgggcatggggccttaaactatgggattacgcaacaaccgggggacgatgtgcaaaccccatattctaccgacccaacatttccccccgaacaaggggacaaaaccccattggcaccaggcctttactcccaagccccaaacagcgcaaaacacgcgactctgacgcgcctcttggttaaagacgcaacac

SEQ ID NO: 699360 - DNA, 294 bp, Homo sapiens
gagcggagcgagcagctcagctaggatcctgcctccccagagctgacagcctcataggaacagacttacagtaacggagtttgagctggatgcataggagatgccagtccattcctttagtgcccgctgccctcccttactgagatgggggcctgagcgagcacctatgtacaggagcacccctctacagagggagagagctgatatgtttgtcaggggagacttgctactacacctgccacgaggcggcatccatccggcagtagactcctagctcagagtgctcctgtgata

SEQ ID NO: 699361 - DNA, 868 bp, Homo sapiens
  misc_feature (1)..(1): n is a, c, g, or t
  misc_feature (63)..(63): n is a, c, g, or t
  misc_feature (87)..(87): n is a, c, g, or t
  misc_feature (118)..(118): n is a, c, g, or t
  misc_feature (128)..(131): n is a, c, g, or t
  misc_feature (140)..(140): n is a, c, g, or t
  misc_feature (142)..(142): n is a, c, g, or t
  misc_feature (163)..(163): n is a, c, g, or t
  misc_feature (182)..(182): n is a, c, g, or t
  misc_feature (189)..(189): n is a, c, g, or t
  misc_feature (191)..(191): n is a, c, g, or t
  misc_feature (203)..(203): n is a, c, g, or t
  misc_feature (231)..(231): n is a, c, g, or t
  misc_feature (297)..(297): n is a, c, g, or t
  misc_feature (338)..(338): n is a, c, g, or t
  misc_feature (340)..(340): n is a, c, g, or t
  misc_feature (418)..(419): n is a, c, g, or t
  misc_feature (543)..(543): n is a, c, g, or t
  misc_feature (549)..(549): n is a, c, g, or t
  misc_feature (560)..(560): n is a, c, g, or t
  misc_feature (601)..(601): n is a, c, g, or t
  misc_feature (612)..(618): n is a, c, g, or t
  misc_feature (631)..(631): n is a, c, g, or t
  misc_feature (634)..(634): n is a, c, g, or t
  misc_feature (639)..(639): n is a, c, g, or t
  misc_feature (641)..(641): n is a, c, g, or t
  misc_feature (643)..(644): n is a, c, g, or t
  misc_feature (650)..(650): n is a, c, g, or t
  misc_feature (652)..(652): n is a, c, g, or t
  misc_feature (663)..(663): n is a, c, g, or t
  misc_feature (670)..(670): n is a, c, g, or t
  misc_feature (697)..(697): n is a, c, g, or t
  misc_feature (700)..(702): n is a, c, g, or t
  misc_feature (706)..(706): n is a, c, g, or t
  misc_feature (753)..(753): n is a, c, g, or t
  misc_feature (775)..(775): n is a, c, g, or t
  misc_feature (842)..(842): n is a, c, g, or t
ntcacccgagggcaaatggaaatttattaattttttttgtccttttccatctttccccaagtngcttttccttgcaaaatgcctganatgacaccagaagggaacctggaagcagggngcaccccaannnngcagcccangnacttaaatacaagctggaggncagggcacaggtgggacangcaagananagcacgaggganatggcttctcagggagaccaaagacttnctttcttgcaggaagcagctgttccagagggcaggggactaggatcctgggtgcagagtgggtaancagagaggcccccaatcctggatggaacccacattccccananaagtagcggcaggggatgagggccttccctggtgggctccagaaacggagtggggagtgagccagatgtgctaccttnnggaaagggaggaggtgctagcagagttagggttaaggctggtgcccagcctctggcacggtgggccttccgcctccgcctgaaatggggacaaaggggcacggtgggcaggcagcgcatgggtntttctntggcagggcanagggcggcaggagcagactccctccaggctcaagacacaancccagcatttnnnnnnnttcccccgccccnganatacncngnncccacngnagctggacggntcgagcngggagtataggaagggagaggaggcantannnagangaaagggtgggctgctgggcccctgtggcctccatgcctgtcctgangtccagcccagggccctggatnccaggtcctggatccctggccacattcctcgccctgggcactgactgcagccagggcagtagaggcnggggagacctcagttcttgggcatga

SEQ ID NO: 699362 - DNA, 186 bp, Homo sapiens
  misc_feature (105)..(105): n is a, c, g, or t
tgtgcaggtgacggtatctttaacaactgatcccacacttgcaactgatcaagagctgtgcttctccatttgcctgcagagcaacgtttatcatttcccgtgcgnatccatttccttctgaagtactgagtgtatccattcttttacggctcctctttatctcctttcttaagccgctggcgctat

SEQ ID NO: 699363 - DNA, 744 bp, Homo sapiens
tggtctgcaggctcatctgtgtccggctttcactccactaatgctgtctcagtgttttctctctctctctttcgagcttggcactccggtacccgacccggacgcccgtggtcgccatcccatgaccggggggccagtggaacagaagacatggccgtaccagcccgtgcccggcctgcggggggggcagcccagcgaagccactgccacaccagccacgccatgcgctcatcctgacttcagccacatgactctattgtttcgcagtccccttggggcctccgtgtcatggtggtgtgagtgcgaagctagctatagaagactgatgacccggtcgcgtcgagagcttctcacacgcacgtgtgagagttggccgagtcgagcactctaggctaccatgagtccgtccgtactggacagcatccgtctacttgcattgcaacagcagcacgagagcaggagagcagagcatcgggatctcaaaaggtgaggtattataagattggtactgctcgtagttgcacttcttactcattccctcattacatgatctctccaaaagttgatattttcccttttctttgaatttgagatctcctataccacaccttctccttacgtttccgacttcccacgttgtccattatgtaccatgtacaccagggttcatgcatgtccatcgaggggtaaagaacaggatccttctttacacgctgcacatggctgacaatagttctcaagcca

SEQ ID NO: 699364 - DNA, 360 bp, Homo sapiens
  misc_feature (107)..(107): n is a, c, g, or t
  misc_feature (240)..(240): n is a, c, g, or t
tgatctccaggatcttgtgaggtaagcggggtcacggtttcgtcgaggccttcaggagcctggtggtcgcccttcaggtagcgccgccaccttgatggcaccttgtnatagtcgcagaactcgaagaagaagtccacaggagtgtcgcgctgctggtgacccgcggagtcactgcccaccgtccagtatttgcctgtggagtctttgatgttgtaggcgccatcgttgaactccagctgnaagacgtcatagctggagcggttggcgtcccaggggtggccgtgacctttgcggcaggcggattgaagccatggttcccccggttttaaactccgcggggtaccggaggctcggaattcg

SEQ ID NO: 699365 - DNA, 246 bp, Homo sapiens
  misc_feature (48)..(48): n is a, c, g, or t
  misc_feature (88)..(88): n is a, c, g, or t
  misc_feature (116)..(116): n is a, c, g, or t
  misc_feature (140)..(140): n is a, c, g, or t
  misc_feature (172)..(172): n is a, c, g, or t
  misc_feature (196)..(196): n is a, c, g, or t
  misc_feature (208)..(208): n is a, c, g, or t
tcttttcctatagtgcaggagaggcacagggagggttttggtcaggangtagtagttggatctgatttatatgatttttaaacttttngaaataatttcaaacttacaaaaaaatnacaagattagcacaaagaatttcngtatgctcatcatccagatgatttccatttanaagagatggtttgggctacgcggnggagaatggccntagggggcaggatcagttctgtcctcattacatgccag

SEQ ID NO: 699366 - DNA, 310 bp, Homo sapiens
  misc_feature (32)..(32): n is a, c, g, or t
gattttttttaaaggcagaaaaacttgaaatnccccccttctggccaaaaaaaatccgttttatgaagagtaagtgggacctggggtcccgggcccaaaaaagggaaattttgggccaccctttttgtgggggcccccttccctgttgggcagcaaaaacagattttccgttccttttttccccccccgtattatagtttaaccaaaattgtttttttcttggaaaaaaaaccttttgttttaaaaaaataaacaagtgaatgttggaaattagtctgttaatgtttttaataaagggtttttggggtta

SEQ ID NO: 699367 - DNA, 142 bp, Homo sapiens
  misc_feature (37)..(37): n is a, c, g, or t
gaaaaccctgctctaggccaggcgcggtggcttgtgnctataatccctataatcccaacactttaggaggccgatgcgggtggatcacttgaggccaggagttcaagaccagcctggccaacatggagaaaccaccatcttt

SEQ ID NO: 699368 - DNA, 417 bp, Homo sapiens
ggggggggcccccccaagggccccccggggttttcccttttagttcccgcccggggaggggggggggaaggggggggggaaacaatttcccccggggggagggttggccccggataccccccgcccggaaaaacccccccccaaagggggacaaaaaggggggccccccccgggggggggcccttttaaaaaaagggggccccccgggggccgggaattgggcccaaaaaaattttttgggcgcccccccggggtttttcccccctccccccgggggggggccccaaaaaaccccaatttggggggggggttttccccccccaaaaaaaaagggggggggaaataaactttgggaggggggggggggggggggtttttttttttccccccccccccccccaaaaaaaattcctttta

SEQ ID NO: 699369 - DNA, 152 bp, Homo sapiens
  misc_feature (25)..(25): n is a, c, g, or t
aaaagcgggaacgttgcccgggctngaaagacaggccctaagggccggacccgcggccggaaaaaaaaaaaccccccccccccccccccggctggcggcgcgctgccggcgctccttcctcctgggctcgcgcctaactcagggaacctcca

SEQ ID NO: 699370 - DNA, 220 bp, Homo sapiens
tattaaagagaagaaaaagagaaaccgtgggactatgttaattaagttaggatactttggttggtaagtaatagattagggatggctgggaaatggttcctttggattaataggcatccattataattagtaaacaggtgttccaataaaaaggatttaccttggattaggttaacaagggcccaggaaaggttgagtttccttgaaggaaggtctttgg

SEQ ID NO: 699371 - DNA, 267 bp, Homo sapiens
gggggggggggcccccccctggggaaaattttggggggggggggcccccctgggaaaccccccccttgagaaaaattttgggggcctttttaaggggttcccgcttttcaaagggggggggtttcaaaacccccaaaggccccccccttggtaaggggttttgggtcccaggaaaatttcccaattttttgggggttttggcccttttttttttttttgaaaacttccccaaattttgaaaaaaaattcccccccttttttttttta

SEQ ID NO: 699372 - DNA, 881 bp, Homo sapiens
tacaagtaacggcaaataggaaaccagaaaagggacccccagggtgtggaacaaatctctgtggtttacccctctccccaaaaaaacgagggcggaggaggtgtggccccttacccccttttcgtggtctcgattctcgggccccctttcttcactcttgggtgcagaacatctcctataggagggcaggggccctcaacactttcccgtgggacacgtggggatagatcgagtccacccagaggctgtgccattgccccaagacccccttctttccccaaaaaagaagttactcgtcgggggcaaagcgggaactcaggggcgccacaaacccacgggaggcgcaaatgagcaggcgatttgaaacacttttgtgcgccgcctgtgagataaccgacgccagcacactcctgcacaggcatgtgtctgaaaaaaaagatgtggacaacctctgtgacccaaaaaaaactaaaccaaacactgtgttccaagacgggctatcttggggttagacacaaatagggccacacactgtggaacacccagaaaaccgttagggcgagaggcagaggaagcacaacaagagcaggaggagtactgtggaaaaccagctaaccacgggtgaaaaaacctcccatgtgcaaaagtgggggtgcccccacatttctcgacaagcaagcggcgcagaaccacagcgggatacaaagtatgtcactgacaacgccacacaactagggagctatcgagggaagaacatgccccaacacgacccacactctatattttgcggcgggccacaaaagcgggtactcactgcgggccccacaaccctgtgggacaaaacaacgtgcaacacaggcgctcactcaaattcaacccaa

SEQ ID NO: 699373 - DNA, 106 bp, Homo sapiens
gctaaaaggagtcaccatagccagtagaggtgtgttagcccaacatacactccgagtgctagcgaagaagcggggatccaaaggcaagtaggaagcaatcatcaca

SEQ ID NO: 699374 - DNA, 102 bp, Homo sapiens
ccggagggcggggcgggtctccaactccggacctcaagtggatccagccacctcggcctcccgaaagggctggggattacagggtggtgagccacggggccg

SEQ ID NO: 699375 - DNA, 161 bp, Homo sapiens
cctttggacactaggaaaaaaccttgtagagagagtaaaaatttaaacacccatagtaggcctaaaagcagccaccgatttaagaaagcgttcaagtacaacacccactacctaaagagttcgcaaacacataactgaatgactcacacccattgggacca

SEQ ID NO: 699376 - DNA, 147 bp, Homo sapiens
cgataaggccggcgatacatacttcacaaagaaggcccctggtcagccaggaagacgcactccaacctgattgaggcctccgaggaagttttgtcaaagagccaccggaagaaaaaatctagactggtgagacccagggagggcagg

SEQ ID NO: 699377 - DNA, 371 bp, Homo sapiens
  misc_feature (33)..(33): n is a, c, g, or t
  misc_feature (75)..(75): n is a, c, g, or t
  misc_feature (108)..(108): n is a, c, g, or t
  misc_feature (206)..(206): n is a, c, g, or t
  misc_feature (357)..(357): n is a, c, g, or t
gtgccttccccacccagcaccatgcggggggtnccatgggggctggtggccacgtcctgtcctcatggagctcanactctagcaacacatatggggtttccatcaaanctctcctatcagctgggcgtggtggctcatacctgtaatcccagcactttgggaggctgaggtgggtggatcacctgaggtcaggagcttgagaccancctggccaacatggtgaaaccccatctctactacaagtacagaaattaggcaggcatggtggtgtgcacctgtagtcccagctaccagggaggctgaggcaggaggattgcttgaattcaggaggcggaggttgcagcgagccgagaattngccactgcactcca

SEQ ID NO: 699378 - DNA, 847 bp, Homo sapiens
attactcctttcatctgtggtatttctgttataatactttaatgtgtgcatctgacaatactgcctcttctatgttgtattcagaaattaatatacttataaaattaagattgattagccaaacttgaattctagttgttaaaactgatgtgtgaatttgatttttcagatattgatgcattacacaccttagctataagaaaaaaaagggtctggattatatgcttcttgcaagttgaatctcgttatttaaacaaaaagtttggggtctgtctatcggagtatttgtaacttctaaattttgaaagttgactgaattaggaattgggatgcttattctttggtagatgcgtgttggctaaaaaccaatttacaaagtctgactgtctcttgggagagggaggtgccttgcaaatttcacattaagaatgtgcctgaggctgctttactctggaatagtctcagatctaaaatttcctctatataaggtggcatatgttaagtttggttcattggaccgtttagaatgctatgtacaatgttgcattctgttagattgtaatatatagccatctctgatttggtctccttaagtgatacggatttgtattctaaaggtgataaactctgaaaatatcagaattctgcgtttacttgaaatttggcgaataaccacgtgggtgaccattggaggtttgtgccaggctacacgtcaaacgccgtaggtcagaacaacactttaacccaagtaccctcggtgatgtttttggctgtacctccattgaatgggcaattcagggggggcccgagacaagtctatacaatagggttggtcaaggatttggag

SEQ ID NO: 699379 - DNA, 695 bp, Homo sapiens
  misc_feature (438)..(438): n is a, c, g, or t
cgaaatttgctcagagttgtccgagcattactgtggacagattatttgagttctgtcatttgaacattttagtttaaaaacgaccctttggtgtcaggttgccattgtttttgttcgacaggggtgtatttagatgaagggcttttggttgttctgttggtaagagagatcaataacgatttattttggccattggtcgaaaattagcattattgtcttcatgcagtattctcaggatgggaaacatgcttcatgtttcttataaataaccctcaattatgagggcgtactttgcactttgaagaaaaattgacttgcattaaagtggctaacaaatatctttcctgggcaggatgtcaaatttgtcctctcctctaataccagtactgttgagctcacattctcccacttttcctcttttcaggtggttcacgtatngggatccatgaaacctcagacagcagacatgttaactttgcttatcttgttattccctgaggtagtcctggggctcttaagagattaccgttcttaaaacctggaaagtgacccagagaggtagatcttagtcccaaaattaacgttacttctaggcataaaaccttttcaaaatcccatcacatttatcaattcgttatcctgaccttatttggggggaacacttggcccccctgcattctcttacactgggaacg

SEQ ID NO: 699380 - DNA, 299 bp, Homo sapiens
aagggcagtgacgcgggagacacagttatgggaacgtaccgggcacagtgcatcgagagcatgacccgcctggtggtgaaggaacggaatcgcaacaaactgactcgggaaagtggtaacgacttccccatccctgctgtcccaccagggacagatccagaaactgagaagcttatccgagagaaagatgaggagctgcggcggatgcaggagatgctacacaacatacaaaaacagatgaaggagaactattaactggctttcagccctggatatttaaatctcctcctcttcttcct

SEQ ID NO: 699381 - DNA, 124 bp, Homo sapiens
tccctatcctggtcgcagtccttggtgttggacagttggaaagttgtgaatagcagtacagaaaggaccacagatggctggggtaactgctttgcataaaagctggctgagatctatattgttg

SEQ ID NO: 699382 - DNA, 108 bp, Homo sapiens
gcggccgcctactactactactgctcgaattcaagcttctaacgatgtacggggacatgtcactgtactctagctggggcgacagagtgagaccctgtcttgaaaaaa

SEQ ID NO: 699383 - DNA, 854 bp, Homo sapiens
ggcgctgtgcccggggcgctccgggaggagggaccaggatccggcgccggggcgcagatactgacaccaagggaatccgggtgccccccccgccgaagccatgcgggccccctatggtaaactggctccagcgcagctcggttgccccgttggtccacggccccatatcctggaccaggctggagattctgacggacgattcaggagatcgggcttcgtcactgagaccgtcaggcctcttgcgcagtccattcccacgtcgccatacccctagtcatcctcggcaggtctcagtcccggttccatctgtgccctcgctcccagccgcagctatgttgcacaccgagggccacagctcttcttcgggcggtgggtcagggtaagctacgcttggccctgtttgcttctggagtgaggctgcctacgtgaatgagtggtgatgccgcagggggagactgccgctaatggaaagcctgttcgggcccgatacgacgatccccagaacaaggcacgcctggtacggcttatcttcctggtagcatagggctgcggaccccaaatatcgcagaccggacttacgggcgcactggcgctcattgccactgctttgcagccgggtagatgggggtgcagcccgacggggtgtagcatcgcttgcttccttatcacacaccagacgcaaagacacccctgtctaggtcccagagattccaccgctggggacgacctcagagagtcttggttccacagggcccattggaaccccgactggaggtgaccagctgaatgatcgcttttggcgcacaagcattggccttgatgacgtgcctattgcaacgggacacacaaggggg

SEQ ID NO: 699384 - DNA, 473 bp, Homo sapiens
gggcacgatagggcaataaaagcaggctgtccgagccagcagtggcacccactcacgtcccttccatgctatggaagctctgttcttatgctctttgcaataaatcttgctgctgctcactctttgggtccacactgcctttatgagccataacactcaccgcgaaggtctgcaacttctctccagaggccagcaagaccacgaacccactgggaggaatgaacaactccggacgggaggaacgaaccactctggacgcaccgccttaagagctataacactcactgcgaaggtctgcagcttcattcctgaagccagcgagaccacgaacccaccagaaggaagaaaatcttgaacaaaacccaaacatcagaagggaaccaactccgaacacatcagaaggaaaaactgaggacatgccgcctaaaagaaactgtacactcaacaagagattcttacggcttcggcggtca

SEQ ID NO: 699385 - DNA, 374 bp, Homo sapiens
tgtagatcatatcctgtgtgtgcgtatgcatgctccacagagataacaggttttgttgcttatcaagtagcctttcagtcctgggccccctcactagctgagagccacacccttccttggcttcaaagccagcccagcactaagccattttagtatgttatggtttagacgggggttctcagaactaccttgggacggggaccaagcgagaaacaagacgactgttttatttggtcctcagaatttaggacggtcatgatggtggacgcgtgactttttttattttataacgttgcagtaaaaaccttaacaatatggacccggtacgctttggggtacaaggattactaaagacctaaacgcagacgtttaac

SEQ ID NO: 699386 - DNA, 764 bp, Homo sapiens
  misc_feature (94)..(97): n is a, c, g, or t
  misc_feature (99)..(99): n is a, c, g, or t
  misc_feature (101)..(101): n is a, c, g, or t
  misc_feature (103)..(104): n is a, c, g, or t
  misc_feature (108)..(108): n is a, c, g, or t
  misc_feature (110)..(110): n is a, c, g, or t
  misc_feature (112)..(113): n is a, c, g, or t
  misc_feature (115)..(115): n is a, c, g, or t
cctgaaacttttccttcaaagagggaatgatctcctggaattcaagcttctacaaggtggctacctggtgttttccacttttgccgtctcctannnngnancnntcangncnngncctttcaacccactgaacacataaacatgctttctccttaactgaacttatggccacgatgaacttgaactctgagattcacagaggagagtttgttttaacagctgcttttacaatgaagccctggagttactactctcaagacccctggttctgataggccatcttttcactgtcctctgcattttctaatgcccagctgtcaaggaacacccactgaagttttccaaaacaaaggcacgaaacacaagaaaggcaagagaatgctaatcaccagatgcatgggcatcctatgggggaaccccttacatgtggaatacggtttttctccccaatttatttttataaatttattgatttctttgctagtttgttattaattgttagagatgtcctgttgcctgaggttgccctgtccgatatggtagccaccagcgacaggtagctatttagagtaatttaaaaattacattaaaaatgcagtttccttgtcacttaaccatgtttcaagtgctcagtattaaccacatgtgactagtggcttccataaaggaaggcaaaaatagagaacatttacatcgctgcagaaagctactagatttttttggccaaggcataagctctttctcataagagaaaggggattgca

SEQ ID NO: 699387 - DNA, 597 bp, Homo sapiens
tggtacaggggaggctacagtgagctgagatccctccactgcactccagcctgaagacagagtgagagtgcagtggcgcaaactcagctcacagcaacctccctttctttcttttttttttttttttggaaagggactcttgctctgttgcccaggttggagtgcaggggtgcaatccgggctcattgaaacctctctctccgggttccaagtgattctcttgcctcagcctcctgagtagctgggaataacagggcgtgtaccaccatgcccagctaatttcctcattttaataaagagatgggtgttacaccatggtgggccaggcgggtctggaactctgggctcccagtgatccaccaacctccacctcccggggataacgggcttgagccaccacgcccagccaattttctattaatcatgtccgttttaaatggcccatggaagcactttggtgagggctatttaaaaatcttaatcagataataccaacgcacataccacgtgggcatcttaggatggtcttttctcatccaacgtgagattcccggtgactggtatgaaagtgatggtcccggggggatctctagagtc

SEQ ID NO: 699388 - DNA, 124 bp, Homo sapiens
gtctcatcacggatcccccactgtggttcctggagatgagctccggcttcgagaacgcctggtctgggcttttcactgtagcacgcgcaagggtcagagtagcataggatgtgcgggagcaacc

SEQ ID NO: 699389 - DNA, 83 bp, Homo sapiens
aatatccccaaagcagcatttatttaccctttttttttttactcgcagcaatgttgcctttcttaaggtcctctatttctctt

SEQ ID NO: 699390 - DNA, 119 bp, Homo sapiens
cttgggttatgtaccgcttgttttaggcgctgctactgtcagtataaaccctcacctgaaaaatgccagcctggtacaccaaacactgagccccttcaacaggcacattatttcccccc

SEQ ID NO: 699391 - DNA, 340 bp, Homo sapiens
  misc_feature (181)..(181): n is a, c, g, or t
cgggcccccccctcagggccttccgaagccaacacttgtcccccccctgggcctggggccttccctctccagctgggtaagaggggtttagaattccccttctctttttttagggcctcggccccgcccaagggggcggcccttcctgacatccccccaggttgggcagcctcccggggcntggagggggggccgccccccccccccccccctcccccccccccccttaactttgggctaggctgggctgggcctgccccgctcaggggtatccggttggttcctattatttatttttttaattttttttttaattattggaataaaggttaggtgggga

SEQ ID NO: 699392 - DNA, 822 bp, Homo sapiens
  misc_feature (822)..(822): n is a, c, g, or t
tggaaacagagtctggctctgtcgcccagaacgggagtgcaggggcgtgatcggggctcactgcaacctctgccttccaggttcaagtgattctccttcctcagcctcctgagtagcggggattataggcacatgctaccacactgggctaattttggtattttaagtagaggcagagtttggccacgtgggccaggcgggtctcgaacttctgacctcaagtgatctgcccacctcagactcccaaagtgctaggattacaggtgtgagccaccacgccgggccagtgtatctgatttctgccttaagtttcacattggcttgggtctcttcttccttttcatggtatgtttaatttaattatacatttttaatttggtagagacgggtggtcactatgtggcccaggctgggtcttgaactccggggctcaaatgattctccggctctgctcccaaagtgcggggattacaggcatgtgccaccacacctgggcccatggtataataaaaaaaaattttttccctaagtaggttataattgagggttccatttatccatccatgtgtctccacggattttttaagaccaattctgtgccaagcacaggcctacaggtggtgaacgggaccagatgggcttaacagacccgtagctgcaaaactacggtgtgctgctctccaccaatttaaatagatccggcttatggggagtttacctctttggaacttttatggaactacctcttaacagaaagggtaggcttcacttccaggcaggagacaaaaattctcctttaaagggggacaaaagggtcccgcn

SEQ ID NO: 699393 - DNA, 158 bp, Homo sapiens
ccccgtgtagtcacatgagtccgcaaaaggcccacacctcaaaaaggttaagaacacttgtcctgcttactgatttagagtaacaaatggcagagtatttctctactgtctctctactcttttttttttttttttcttttttttttattttttttttt

SEQ ID NO: 699394 - DNA, 1107 bp, Homo sapiens
ggcgctggagcagtttataaacaaggtcgctggtcatcctgctggcagcagaacgaacgttgtcttgcacatgttttgtacaaggatgaaataatagataaaagctagtactccatctaaagataagacatgcctgagaatttggcaagaacggggcaaaaacgtgactgattagatgattgagtaagcaccagtgaagaaagttgctatacttttaagcatgcgtggcgactagaaacgtgggtattaacatgcgcattcaggtatactaagcatgtcatatgctcgagttattgtaaaggttattggcagttgatcgacgaacgttaagttgtgcatttagtaaaaatctcctcattccaagcctgttctatgagtaaatgagctgcgtttctgtgctgttgttgacatgggggtggcacgagctactagcgctgagagaacctgttgattccagttgtacatctgcacgtgtcgtaaccttaagttactggcttggtcgtcatttgcgacagtttgggcgtctgtgcgcttctggacatctgattaactagaatattgctctttcccccttttaatttgggatgtcactttgaacccatttgtgtgtagggagcactacagcatttgggttccaatgatgcgaactgagatacatattgtgtggccgaagcatctggcccaggtggataccttatgaggggcagatttatgcggggcgaaacttgttatccggggtaacagacacaggccacgttaatctgcgcaccactgtgcgccaacaacccacggtgtggtcacacacaattacaatcgcgttgtctgtatcacaaaagacaaacacataatgcgacgtatacacacacccactacacgcgcacacaccaaggagacctctctcaacgaaaaaaggctcacgcgagaggaagcacgggagcacaggaggactagaagaacagagaatcgagggagtatgttgtccacagcttcgacgcgggacagctaagaggagaagatatagaagccaactaataacggaactcacgacatgtatgtcgtgatcggtacggcaccacacacgccactaccacaacggccgggtagcca

SEQ ID NO: 699395 - DNA, 128 bp, Homo sapiens
  misc_feature (4)..(4): n is a, c, g, or t
  misc_feature (75)..(75): n is a, c, g, or t
  misc_feature (125)..(125): n is a, c, g, or t
gtcnaccacatttctcgccctattccaagttctacagtgtgtatttctcatttttcaagtttttcaatgatttcntcatttttcaagtcgtcaagggcatatttctcattttccatgattttganttt

SEQ ID NO: 699396 - DNA, 484 bp, Homo sapiens
  misc_feature (106)..(106): n is a, c, g, or t
  misc_feature (148)..(148): n is a, c, g, or t
  misc_feature (220)..(220): n is a, c, g, or t
attttccaggagatggctgacaagtgctcgcccaccctttttttgttcaatgggcaggcggccttccacatggcccagggccgctgggaggccgtttagggccttnttcaggaggcgctaaacaaggatagtgggtacccaaaaacgntggttaaccttattgtcctgttccagcacttgggcaagcccccttaggtgacaaaccgatacctgttccagntgaaggatgcccccaggttccatccctttttcaaggaggaccaggccaaggagaacgacttttcaagggtggggttaccagtacgctcccagggccttaggttggcccaaaactgtcaggaccattaagccaggacaaaggccaggagccagccctgcagccctccccccccggcatccccctgcatcccctttgggggcaggagcccccccccagcccccccctttgtttataaattttttaactccagggtgttccccctta

SEQ ID NO: 699397 - DNA, 927 bp, Homo sapiens
  misc_feature (27)..(27): n is a, c, g, or t
  misc_feature (64)..(64): n is a, c, g, or t
  misc_feature (70)..(70): n is a, c, g, or t
  misc_feature (82)..(82): n is a, c, g, or t
  misc_feature (107)..(107): n is a, c, g, or t
  misc_feature (113)..(113): n is a, c, g, or t
  misc_feature (130)..(131): n is a, c, g, or t
  misc_feature (147)..(147): n is a, c, g, or t
  misc_feature (160)..(161): n is a, c, g, or t
  misc_feature (166)..(166): n is a, c, g, or t
  misc_feature (195)..(195): n is a, c, g, or t
  misc_feature (203)..(203): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (261)..(261): n is a, c, g, or t
  misc_feature (288)..(288): n is a, c, g, or t
  misc_feature (304)..(304): n is a, c, g, or t
  misc_feature (316)..(316): n is a, c, g, or t
  misc_feature (319)..(319): n is a, c, g, or t
  misc_feature (323)..(323): n is a, c, g, or t
  misc_feature (328)..(328): n is a, c, g, or t
  misc_feature (334)..(334): n is a, c, g, or t
  misc_feature (342)..(343): n is a, c, g, or t
  misc_feature (345)..(345): n is a, c, g, or t
  misc_feature (368)..(368): n is a, c, g, or t
  misc_feature (370)..(370): n is a, c, g, or t
  misc_feature (386)..(386): n is a, c, g, or t
  misc_feature (391)..(391): n is a, c, g, or t
  misc_feature (403)..(403): n is a, c, g, or t
  misc_feature (413)..(413): n is a, c, g, or t
  misc_feature (423)..(423): n is a, c, g, or t
  misc_feature (425)..(425): n is a, c, g, or t
  misc_feature (433)..(434): n is a, c, g, or t
  misc_feature (443)..(443): n is a, c, g, or t
  misc_feature (448)..(448): n is a, c, g, or t
  misc_feature (456)..(456): n is a, c, g, or t
  misc_feature (468)..(468): n is a, c, g, or t
  misc_feature (478)..(478): n is a, c, g, or t
  misc_feature (499)..(499): n is a, c, g, or t
  misc_feature (513)..(513): n is a, c, g, or t
  misc_feature (924)..(924): n is a, c, g, or t
ttgatcttatgcaagaagctgcacgancccgcgcccgcttgtcgccacggcacttgaggcagcnggaganaatctgagttantcggagcccgacgcctgagggtganatgaangcgctggcctccctaanngtccggacctgtgatngcttctggcaganngaacnggcgctcctgcccccggggtgacgcgcantcccagcngcncanananatggccccaggccaagcaccccatcaggataccccgtggagggatgcncaccctttcttcctcctgtccccagtnatgggcctcctcagcngcgcctggagcngcntgangggcntggganctctagannantggctggtggaagaagtaaaaananaagctctggtagaagntggcntggagggagaanataggaatcntctggcaatnanccataaannttggggcanaagcnctgaagangaggctgaaganagtggaggcnctggagaggacagagaaacantggggctgaaaacnagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaagaacanaaa

SEQ ID NO: 699398 - DNA, 769 bp, Homo sapiens
ctaggtagaggctggtgttaatcggcgaggagactagtctcgtagttttttgtttttgtataaacccctaagggtcacagtcatcagggggaactaaaatcacacacaaaggcaaatcatgaggaaacgttaaattatttcaaaaggcccacgaggcgtgccaaaaacagggctgtatctatagcacaaaaatcgtgggaggccaaagctaaagcagtaggggctactagcaacttctagctctttcctggctgcttatttggtatggtatggatagagggggattcaggtgagggggttcgggtctctcaggaagttatggccataatttctgcaggtccagtgataaactgggatccatcccagtgcggctctagaaacgtggttcaggaaagtgggaaattctctataatcaccatccgtgagagggaataagtatgttcattcagaatgactgggcggctcacgaatctcacagacctaagtgcatctccacggaggtatatggtggcaaccttctgggctaatacaagggaaatggtggggcactctccccattaccgggattagaatcgtccggggagttgatcacttccacaaggccccaccaattggtcaaacaccaggccgagttctaacagtggtcaattataagggagtaactacccctataatctgaatagtgatatccgcattcgaaatgtaagccatggtcaggtcagtcttgaatcccaggcatcgggccttggacccatccattctactccac

SEQ ID NO: 699399 - DNA, 391 bp, Homo sapiens
acgctggtctcgaatacctgaccttaggtaatcctcccgactcaactcccaaagtgctggaatcacagggcgtgtgccaacagctacagaaattgatgtatatcttatatatactattgtgtgtgtgtgtatatgtagttactcattgttaattccctcagaattaaccctccggcatagatatactacgtctgaagtctcggattattcaacaagtagatctgccacccctcatgctttggatcaacaccagggtttgaccactgaaagtcgtgagacacactacaacggcattcatttgcaaaccccaccgcctcaatagttccaggcaaaccccctgtctgcaggcccccccgaaagttacgcgagcaaatactcaggccgccacacc

SEQ ID NO: 699400 - DNA, 1542 bp, Homo sapiens
  misc_feature (1109)..(1109): n is a, c, g, or t
tggggttaggttgtggttttttctaagagagattcggcaatggcaagggtctctttgacccctttgccacaacctggaaacagctgggcccgggggtccccggtttcagggggtttccgtgggaccacccacgtgtgttctccccaacctctggatggcgctggaactattcctctataagcacacaggtgtggtccacactctcccaggggtcctctggacccaggtgtcaagaagtattgtccctctggcacatggcaagaggcaggagaaggctctacaggttggggcgcctggaggagtgtgtccgcgtgctccgagaccctgtggccgagggcaacgaggttttcctccgcgtggagaatactctgtgtggcccccacgcggagagatatctgtggtgagcccgagttcgagagaggagagggaggaagaagaggggagcccccttcagagcgagagagtgtgggcgcgccagagtctatctcacgctctcagagaaagccgtgtggtccctcctgtgtgaggtttctccaaaaacccccagagaaaatagtggcctgtggtggtgggggacctttataaaagctcttctcccagaggggggccgcggtgcgccagtgtgtggggagagccccccacaattcctcttttaccaacaaagcgcggccaaccccaaatttaaaacccagaggttgttggtggggccttttgtggagaatttccccgcgcttccttacgtgggtggtctttgagtgcccccacgacatttcctcgaggggggcaccccagtggagagttgttcctcacaaggataacaattctcccagcggctttaccccccacaatgtaggcggacacaaacccctctgcggtgccaccaggctgtccccctctgttcctgtgtagaggccccccccaagtatatttgtcttctcgcgggcacttttggcgaccccaacccacgcccgcggggttgggtgttccccccatttggttcccaaccccctttgggtcattcccccttttcacctgtgggcgggaaccgtgggggggtgttttccgcgccccatactgggttggacttaccgagcggggcacggatacgnggggcacggggggggggtctgagagcgaaacctattaggtgtgcacacctacacaaaccgatcaccccacgaataaaaaacgaggcgccgggcgggataaaccagccaccacaccttcttaggcgggggcgggcgggacatactagggggaacccccgcagacggttggcaccagaagaaggagatttgcgcacacacaaagctgcttcgaaaaaggcacggtacagctgtagaaaagacccacggcggcccagacatgctcggcggagagacctacctagcaggagcttggggtaccacatggaggcgcacgtgaagagctaacaacaacagaaggcagccttccccgagaggcgggagcggccggccctatcaacggcccgagtagagcacacgccaacttacatcggagagagggggaagaccgacccat

SEQ ID NO: 699401 - DNA, 890 bp, Homo sapiens
gaattggggtgccaaaggactatcttcaccatttcccatttcatttccaaaatgtagcctcccattttttcccttgggatgagaggttctttttcccagaagtaggaaaggcttttcagcaaattaaaacaaagtaataggctgaatttcagccttacagtgctggaaactgggaagatatgaactataatatacgcatctgtccacacatacacacatactgttagtgtacacacacacaacatgcctgtgcacagagccagactacccttcaaaagtgtgctatgggtgtgtacctctggataaataagatgcatgccaagccaacccacagattttcaccactgtggggcaagtcaccaggcacctgttcaatgagcttgtccacatggattgaagatgctttttaaaacacgagtaaactcatggcttcaatggcgagacttactagtctccatttcaaatgccaactctgagcttctgtacagcacaatctattccctattctctctttgaaaacagttaacccaccttacaggtgaatgaggagagaagactcgtgctgttcatgcattcagtctgcattactctgtgtgtgaccacatagcaagagtaaacttgcacctcagtgcttcagtctcagatggggtttccaacccacagtataattaggggtgtttcagagcatccccagttatctagcacaacactgaaggagcacatcccctcactcatttagacttttttccccattcttacagccactgccttctatcaggtatttgtagaggtttgatttcacacccggtgctagtagtcattgtatgcagtttttgttttgttactgatattgctatgcttttctctgataaaattcatatacgacgtac

SEQ ID NO: 699402 - DNA, 316 bp, Homo sapiens
atttctttcatattgtacttaggtgttgagtggggtctggatgtatcctgatgctaatggggaataccagtctcctattaacctaaactcaagagaggctaggatatgaccccatcgcagtatgagatgtccgcctctccccaaattatgtggtgagccgagactgtgaagtcaccaatgatggacataccattcaggttatcctgaagtcacaatcaggtatattagaaaatatgtaagtgtggtctttaaaactagaagtcagcgtcgagtaatagaactgtgatttaacttgcacaatataaacagtacaact

SEQ ID NO: 699403 - DNA, 609 bp, Homo sapiens
ttcctggaatgggaaaaaatagtccttgctagtgtgctgtaaggtatgatggtatccatcctagtttgtgaccatactaagatcatttatgcatgtatgtcagcgaactggaagacttaatcaataatagaggtatcaagtctatagtgcccatcaggtagataatcccaagtgatcagcctaagtgtgaaggagccatggtcatgagctatcttgcgcttagagtgtgagatagaagcaatgtccacgtctgacagtcctgcatgtgtgttaattgtctagcacaaggctcctggactgtagacagagtccacatcatgacgactcgattgacactagagtatcttaaactcagtggtccgatcagtagaggcatctatacacgttgagagtctcaaacgtcatgtgatgagtgctcaaataaggtacgactacagaatcctttgagtgtagtcatggtctatatcgttagcactgtaccatatagcataacagtatgtatatctcagttgcacggcaatgtatccaatctcaccataaagataagtcatgttcgttacatctgttaggcagtgtattgtcacagactaagcatgtactcaagtctag

SEQ ID NO: 699404 - DNA, 294 bp, Homo sapiens
accgaagaggctgagagcgccaactctctgaggccgggggctctctgcttcagccggatcacacaagacatccccaagtcacagcgcagcgacccggcaggagctagctatgctgctgctaccctccaggcttctagtgctgcctcctcagcctctccagtctccagggccataggccgtacctccaagccccaggagtctcccaaagggaagaggaagttggatttgaaccaagaagaaaagaagacccccagcaaacagaccagcccagctgtcgccatctgtccccaagcc

SEQ ID NO: 699405 - DNA, 332 bp, Homo sapiens
aaaaaggttggggactgctgcttaagaggacaactagaaatgtaaagaagggctgggcatggtggctgatgcctgtaatcccagcactttaggaggctgaggtgggtggatcgcttgaggtcgggagttcgagatcagcctggccaacatggtgaagccctgtctctactaaaaatacaaaagttagccgggtgtggtggcgggcacctgtaatcccagctacatgggaggctgaggcaagagaatcgcttgaacccagggggtggaggttgcagtgggccaagatcgagccactgcactccagcctgggcgacagagcaagactctgtctc

SEQ ID NO: 699406 - DNA, 242 bp, Homo sapiens
tatagtgcttgaatcaggaaactgcagaaatttctgtagtagcgctacattagtgatataaactacgaaataatgcatctcggatataagtcagatgtgactgctattgcatagagttcccacataaagtacagctgtatgcctatgtcacacgtgtcatgaggacagaatatttccatttttcaacttaattttaaggaacacttaatcatttgggctaagtatccattttgggagtggat

SEQ ID NO: 699407 - DNA, 179 bp, Homo sapiens
tccactggagtgacatgagtaataaagacagatcaatagacagtgccatatgcacgaagaaaacaataagaacacaaacactcagcaaacatgagacaacggcaacagatgcatcagaaagtcacgagtctgcagcgagaacttgtagaaaacagaccaaccatattctacggaccgta

SEQ ID NO: 699408 - DNA, 428 bp, Homo sapiens
tcattgacatttgtatttaggtcattaacatttttttgaacggtattagcttgtgattgcgtatctgctaacgtttgtcttgtttctgctaattttttgtccattgatgttttaatatcattaattagaacatcaacgattgagatataattcccagcctcttgcgctgttaaatcgactgcgtctaatacattaacacggaaagatgcccctgacgctgtttcatcttgtttagtaaacttaaagtaagcgtttttaaattcgccttgatcttgtcccatgctttagttggcgtatatgtaaattcgccttgtaaagcgtttgtaactgtaacagcgctatcaacgattttaaacccaccagcagttgtacccatgaatgttgtcgtccaaccagttaagttaaacggttcgcccttgcttgttact

SEQ ID NO: 699409 - DNA, 358 bp, Homo sapiens
gggactagccagatgcgctgataagtcacacagacattgttgggctgtaacagtggagacgagagtgcagctgctgtggagatctggatgctatggcggccgtacccaggcagatgtggtcgcaccatgtaggaacggaggctcaattcgaacttcttgtcatagatgtggactggggagggggcgggattctctaagttaagccgatcactgagcacctcactggacacgagagaaggcaagcccctcggaggacagaagggaagagccacagacttggaggctgtgaaagtggagacaggtggatctggggtggcagcaatgcgtgaaatgccagtgccgtgccccctgccccagt

SEQ ID NO: 699410 - DNA, 254 bp, Homo sapiens
  misc_feature (33)..(33): n is a, c, g, or t
ctgccaaataattttaattacctataaactacnttagaaattttttttttgagacagagttacgctcttattgcccaggctagagtgcaatggtgcgatctcagctcaccacaacctccgcctcccaggttcaagtgattctcctgcctcagcctcctgagtagcttgggatttaccagacatgcacccaccatgtctggctaattttgtatttttcagtcagcagaacagggtttgctccatgttggtgctgt

SEQ ID NO: 699411 - DNA, 344 bp, Homo sapiens
cttttctccccccccttaaaccccccggttttaccaaccagccgatttttggtgatgggggggaaaaaatttatttttaaaggaattaagggggttttccttttggaaggttaaaaaaaattgggtttttttttaaaaggaccgggccaggcccttggttacttttttttgggggtacctttttttccattattcccaaaaacttttttaaaaaaggaaataaccccttggttggccaatggtggggaaattttttccccttttgcctttggaattaaggttttttaaaggaatgggaaaggtttaaatttttaagggaaaaaatttttttggtttttggttta

SEQ ID NO: 699412 - DNA, 389 bp, Homo sapiens
ctctagagatcccccatttgaccgtactgtcgtattacacgggtacgtcccatgctcctcgtgcgaccggacaagcccgggaagcgagccttgcgatcggtcgcactcatttacccggagacaggagaggctctctgcgtgtagtgttagtgcagagcttaatgcatacaggaagcatgagaagagatccccttgttgccacctgctcttgtcctcggagaactagctgtacgagcaagaaggagccgtcgaattccagcacggaaggcgtgaccttgtagtagctctccggatgccaatggttctcccattccagggagacttcgctgggatagaagcctttgaccaggcaggctcaggcttaccttgtccttggccggctcatcccg

SEQ ID NO: 699413 - DNA, 602 bp, Homo sapiens
tgccaacctctgacaaaggccgcttctatgcctttggtagagtgttctctggggtggtgtccacgggcctgaaggtccggatcatgggccccaactacacgcctgggaagaaagaggacctatatttgaagcctatccagagaaccattctgatgatgggccgctacgtggagccgattgaggacgtgccatgtggaaacattgtggggctggtcggagtggaccagttccttgtgaagacggggaccatcactacctttgagcacgctcacaacatgcgcgtgatgaagttcagcgtcagccctgtcgtccgtgtggcagtggaggccaagaacccagctgacctgcccaagctggtggaggggctgaagcggctggctaagtctgaccctatggtgcaggtgtgccactaggtcttggcttattgtggttggagagggggaacacctggcaaaagcaggggagggctgaggctaggcctgtattggctgttgtcatagggctgagccctatgcctggggaggacggcagggtgctgaccattgttcccacagtgcatcattgaggagtctggagaacatattattgctggcgccggtgag

SEQ ID NO: 699414 - DNA, 369 bp, Homo sapiens
  misc_feature (203)..(203): n is a, c, g, or t
  misc_feature (243)..(243): n is a, c, g, or t
  misc_feature (247)..(248): n is a, c, g, or t
  misc_feature (250)..(250): n is a, c, g, or t
  misc_feature (256)..(256): n is a, c, g, or t
cctttctattagctcttagtaagattacatatgcaagcatcccgtttccagtgagtggccctcgtaaatcagcacgatcatgaagggacaagcatcaagcacgcagcaatgcagctcaaaacgcttagcctagccacacccccacgggaaacagcagtgattaacctttagcaataaacgaagtttaactaagctatactacnccagggttggtcaatttcgtgccaccacccggtcacacgnttanncnagtcantagagcggcgtaagggtgtttaggtcacccctcccattaagctaacttactcagtgtaagctcagtgcacaatgctcgagtgctcattccttgggggctgtctgacgtacccg

SEQ ID NO: 699415 - DNA, 325 bp, Homo sapiens
gtgaggcgaattctccgggctgctaggattgcttaacttgaagacggggacttttctcgtgggcgaacgagtgaacattggctgacatcacagttgtctggcacctgttgtggtctctataagcagtttcagagctcacttgccgccagcctgtcccataccaaccgctgtcctcactgcataaccagccccagttacggctgtcttggcgagtgaaactattgagagatggccagttgatgtcaaagttgcagagagcctcccaaagatacacacgaagagaggttacggagagagcagagtccagtcagcgagagagaaagct

SEQ ID NO: 699416 - DNA, 354 bp, Homo sapiens
gaggtgactctgaggatcccagacgtccattctgattctaacagaactagaaaaaacaattctaaaattcatatgggaccaacaaagcctgactagccaaagcaatcctaaacaaaaagaacaaagctggaaatatcacattacctgactttgactatactacaaggctatattaactgaaacagcacggtgtaagtacaaaaatagacatatagatctacggaacagaacagagaacccagaaataaaaccacacacctactaccaactgatctatgagaaagctgacagaaataaacaatgcggaaaggacaccctattcaataaatgatgctgggaaaactgtccagccac

SEQ ID NO: 699417 - DNA, 104 bp, Homo sapiens
ggaccaaaatacccgattatgagaggcactaagataactcctgccattgcgccttcgtctccgcggcctcgttgtcccacggcccggcacgcgcgcaggtttgg

SEQ ID NO: 699418 - DNA, 228 bp, Homo sapiens
tgctagctggtaaatgaatactgcagactgtgggtagtaaccctccagtgcagaagggcagtgtcaaagccaccagtgataccagcaaaaacccctgcccgctccaaagccaccacacagatctgatgaaactccaaagtcagggagatcgcagcggatacgagcagccccggatccccagtgcactcccggcagccgctcccgcatccctgtcgcacagggatacca

SEQ ID NO: 699419 - DNA, 182 bp, Homo sapiens
tcagatggtcgcacggaccccaggaccactggtgcgtgtgatcagagctgactgtagatgggattccctggacctaaaggtagctgctggagagccctgacaaggctggagagcgaggtgtacccggaacccctggcgctgtcggtcctgctggcaaagatggagaggctaggagctcaggg

SEQ ID NO: 699420 - DNA, 617 bp, Homo sapiens
  misc_feature (14)..(14): n is a, c, g, or t
  misc_feature (75)..(75): n is a, c, g, or t
  misc_feature (102)..(102): n is a, c, g, or t
  misc_feature (124)..(124): n is a, c, g, or t
  misc_feature (148)..(149): n is a, c, g, or t
  misc_feature (157)..(157): n is a, c, g, or t
  misc_feature (189)..(189): n is a, c, g, or t
  misc_feature (211)..(211): n is a, c, g, or t
  misc_feature (230)..(230): n is a, c, g, or t
  misc_feature (250)..(250): n is a, c, g, or t
  misc_feature (266)..(266): n is a, c, g, or t
  misc_feature (288)..(288): n is a, c, g, or t
  misc_feature (329)..(329): n is a, c, g, or t
  misc_feature (341)..(341): n is a, c, g, or t
  misc_feature (371)..(371): n is a, c, g, or t
  misc_feature (386)..(386): n is a, c, g, or t
  misc_feature (392)..(392): n is a, c, g, or t
  misc_feature (402)..(402): n is a, c, g, or t
  misc_feature (430)..(431): n is a, c, g, or t
  misc_feature (452)..(452): n is a, c, g, or t
  misc_feature (553)..(553): n is a, c, g, or t
  misc_feature (615)..(615): n is a, c, g, or t
tgtttaggcacgcngctgtgggatgctacttctaaaaaaattgttggccatttttcagaatatccttttggtttnaaatacgggtcaggaaaaacaaatgangtaaaaatacgtgaataatttnctattacagaaatgaaaaactganntgcatctnaaagtgcaagaggtgaagtaatttaacccttncacgcagacgatatggcaatanacaatatattgcttgagcngtttgagaaggctgggatgnatttttgaattgacanagaaaattataaattacattgnattaggatccataatcactgatatagagtacacaaaccagntgctaaaaaaanacactggtttaaatttatgagttaaaaccncacaaggtacagtanacaatnagcatgcttnggtgccagaatttgatttcgacgtttgnnaatactagcctgtcaaatgancgcactcgaatgccattagcagcacgagcacttgtcaacggacttgcctaaagaggattaacttcagagtcggttaacactagtgcagatatgctctgaanatgttcattaggtgatgcttgtgaacaaggtaaatttttggtgaatgggttaaaaggcaganga

SEQ ID NO: 699421 - DNA, 1026 bp, Homo sapiens
  misc_feature (251)..(251): n is a, c, g, or t
  misc_feature (1026)..(1026): n is a, c, g, or t
gtggacagctcaccgtaaggttggtaatggcttacaggcttcccgagacgtacctgactcctggtcattttgtgcctgctcctgcctagacctgtgctttcgagacgggcagttgccattcccaaaccatttcgcctatctccagtgcattgtttgacgaaacgcctagtgactccagcgacccaatcagtgcgtgcgagccatgctaggactatatgacacgctatccagagaggtataaaacccgcagnaccttcacctcatgtaatctacagcagatctagttcacgaacaccactctcaagcagggtaaggaagaacacaaccaagtaaataccaatccgtaaaagcatgactcctggattctacccatgactgctacattccaggtacgtcggctcgtgagcccagtgacacgttacctacacggaagatagtcttctgcacaaactagtgctgtgtagtatcgggcgcactcatgaacacgcagagcggtcgtatagacgcctcccgtagaatggacgcctatgacaggcaacggcaatcgctacaactgcgatgagtagggtgacgtgcttgagacagattgaggagagctccccttggagcttggtgccagatactatcaacgcctgagccttacaagcgaatggttctgacgacaaaaactctaacacaatcagaattaccgcgactaactccacatgaagctaccggggcttgctactacgtgggttcaagggaagtgacagtcgtagactctggtctaagaaaagattcctaggggcaactattgactatggcgacgtcccttgtttgaaggggcccgttgttcgtttattaaacttagcccggggttgggcattccttggttgatcctttgccccaagtggcctactccttggcccttggaaagttagcactaccacttggcgcccaagcctttgtgttactcaaactcaatattcactatctacgagcggccaccactcgcgggggcggggacatcacacgagacggtagacn

SEQ ID NO: 699422 - DNA, 747 bp, Homo sapiens
ggaaggagccagtaaggatgtgtcttcagttggagactgacttcagcttgatctcatgggagctctggagcatgaatcatatcggagttggtcccaccttgaggaaaggaggccagccttttgcattcccatgacagctggtcattggttataggctgccctagcagagtataccgtggtctaacttcctgggtgagggaactctcaataggccaagggcaattctctgcgttggaagggtacacttacgtgcttatgagcattttaacagccaacactcagggcagctggaagacaggttcacctacctagcaaaggggacctgggaggggcatcaacaatgtccacaacattggaaggcttgggaggcatggatctgtggtggtcatggatgtaaaaatggacataaggcagatgggattggtgctgatggcgtctgagctggatttgctagctgcccttccgtatctcttccaacatgcccctccaacatgcccggtgtcccagaagcctgacctctatggttccattgcctgggcttcttcaccctctgattttccagttgccactgggacatgccaacaagagatggcagggtgagacaaggtctggttccttaaaatctttgcttcctccaggcaccagttggaacactggctgcattctctttgaggccagagccccttgtcctgcagggcctttcctattactgagctcttgttggggttccataacaggttcccaaca

SEQ ID NO: 699423 - DNA, 124 bp, Homo sapiens
ccttgagacaggcatgttagcacttggctcagcatgttgtcaccattccaccagaaattggcacaaatgctactgtgtcggggttgtagccaacttttcttaactgtaacgatgctagacttcc

SEQ ID NO: 699424 - DNA, 819 bp, Homo sapiens
ccattgcccggtaaggcccggcagtgtgacggaatgaagcagagtcgcagggcacggagtgtgacagatcaagagcgtggagttcagaatgacacgagagaacaaggagttcgagtgatactcggtcgactcccttcacgatcggatcgatgaacgccgaggagctgtataactacatggtaccccgattgaactatctacagacggcgctagaagcggaggccaagcagatgatctgccgtcgccgacgagaaccagaaccaccacctggagcccgaggaggtgctcaagtacagcgagttcttcacgggcagcaagctggtggactactgctgcgcagcgtgcacgaggagtttttgaagcgcccggccgctgccccgctgccacacccaccactgcaccacctggtggcggcctcgctgggtgactcctgggctcctgtggctgtccctggaccccacctcttccctgccgcccgccaccggccgaccgaccgcggattgccccagttgatgagcgtgcgtgtccccatctgcagcagcgcaccccgagcggggcattaggcatgtgacagcggtcggggcgacggggactgggctgtggcccctgcggcgccagaccttcctaacctggtaccctcgaaatccgtggcatctcaccttcctgagaacggaaatctcgctttcagtcactctgccgaagggcgcatgacgggcatcaggagcggaaacctatgggaccggcactaccaaggccgtcgtacgtggggaaaaaacactctccatatctttgaaactgacgcttataacaattgataac

SEQ ID NO: 699425 - DNA, 870 bp, Homo sapiens
  misc_feature (826)..(826): n is a, c, g, or t
ctctctttctctttttcttcttaagacggagtctcgctctgtcctccaggctgaggagtgcagtggcacgatctcagctcatgaacctccgcctcccagttcaagcgattcttctgcctcagcctcctgagtagctgggactgcaggtgattgccaccaaaacccagctaatttttaaattttagtagagatgggattttgccacgtggtccagcctgtctcgaactcttggcctcaagtgatcagccctcctcagcctcccaaagtgtggcattacagggcatgagtcactgcgcccagcctgtggggttttttttgtggaaaaaaacaaaaaaaaattcatcatcctttccttaaaaatgtttttttttttaaggaaaacatttttccacacaaaagggctcggtttaattcacatggaaatcctctatttaaaaagtggctaaaggtgggaaatcaactggtggttgaaccataaggacctttttacccagtttgtgttatgtgatttagttcccaattaatgttttccaagaaatgtttagcaccaagcatttctcaatcacatttaaaattgatgctaaggggtattttgggaaaactttaacaaggggttgggatcttggtcaattttatcgtggtaaaccgtgaggctggaattccaaattaaaaattcattggtgaatacgtatgggctaatggtcgagtgggggtggttaatcccaagggcgtgagaaaatggtcaaccaatgaggggagttaaagacggaatttggtttaacctaccttaaaagtcaattggggggttacagcataaatttgcganggccgttttttaaataacttgtgggcgacaaaacaaaaaattcg

SEQ ID NO: 699426 - DNA, 143 bp, Homo sapiens
tctgcactgttgtcataccacaaatgatgatatgaggagggtagagccatcttgactgcctctgcccatgccccccgatacagcgaccaggtatgaacaacagtgcaggtatgaacaacagtgcaggtatgaacaacagtgca

SEQ ID NO: 699427 - DNA, 449 bp, Homo sapiens
  misc_feature (3)..(3): n is a, c, g, or t
  misc_feature (11)..(11): n is a, c, g, or t
  misc_feature (88)..(88): n is a, c, g, or t
  misc_feature (96)..(96): n is a, c, g, or t
  misc_feature (169)..(169): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (448)..(448): n is a, c, g, or t
aanaaaggggnccctaaaatttcccccccccaaagccaaaaatttgaaaacccccccattgcaaaaaattgggtgcccttaaaagccnctgtaaanaatgaatgggtttcgacttgccttatatagccttaaaaatacatttcctggttatcaaaaattgaggcccaancgtggtggctcatgcttgtaatccccagcactttgggaggctgaagctagtggatcgcttgatctcaggagtttaagaccagcctaacaatcatggtgaaacctcatctctaccaaaaatataaaaaattagccgaacatggtggcatgtgcctgtggtcccagctagttgggatgctgaggtgggaggattgctcgagcctgggaggtggaggttgcagtgaggcaaggtcatgccactggactccagcctgggcaacagagccagcccngnttnatna

SEQ ID NO: 699428 - DNA, 502 bp, Homo sapiens
agaggtatccccaagatgtcagatggactgtgtgaattatttggtaatgtgttactatgtggcttgatacaataatagatcaaaaaaggtaaatgacaaagatgtgtacattacagcatgctttttaaagacattatgcatttgtgctcactattccctatatatgcttgtttccacaagggttctcatgcctactagactccagctggaatttctccggagaagaggcagagacagtttggcgaaaaagacacagggtaatgagggggtgttgagaggagaaagccgtccttgccagttaaggatcagccctcagttaaaggtcagcttcccgcaggctggcctcaggcggagtctgggtcagagggaggagcagcagcagggtgggactggggcgttctacatctcattcaggtcaagcagggtctggtccagcatcctttgtgtacagaggtgctcctctttggtgcatttcagtttatcttccaggtcatcaattgtc

SEQ ID NO: 699429 - DNA, 379 bp, Homo sapiens
ctgtttaagccatgctgagcttctagtgttcctcttaccttttgccagacccaatgctctctgaattatcacagagcgcttagaacccacagaagccggcagaagatgacgacctttatagatgcatggctgtttggcctgtcgacataggtgtcctgcaggcacgagcacgtcaagcagtcagactctgaagctgccctaagcctagactcacacagatgggacgaatatgaagcaggaacctgtgaatcagcccagagcctctgcagcgtctccttgaacagagcgagctcgagtcaggagagacaggaccgagcctggccagtgccctcggtctctagtccttgccagtcatcatctgtctccaagaggccatagg

SEQ ID NO: 699430 - DNA, 296 bp, Homo sapiens
gtcggtccagagtgatgtagaaaaagaagaggatagaggtgaagactaaatgtggacttaggaatgaaaccaaacttgccgaccaaaaccacctctgagcactctctgaggggcctgccagtgtggctcagtgcactttggtggctactgagtaaaggaaaggccaatggcttgaccacgaggtaaaaaacacattgtgttttgtttgctgtagaactttcctttgggatctttgtaaagatcagtctgtgtgacgtgatgagcagcgtcttccacatccttacattcactctgta

SEQ ID NO: 699431 - DNA, 299 bp, Homo sapiens
  misc_feature (48)..(48): n is a, c, g, or t
gcaggtctaaatttagtctaaagccaccatcggaaagaggaaattccncctttcctgtaaattaaagtacttatatgagaaagatatttaaaagttcatgtaagatgaagagccaatcttggaaaggtagcattttggaggaaagaaggttaaaagtaagggagagatggcctctgggaaacttcataatgaaggagaaagaaaaaataaggaaaggagtgaaatttaagatctcccttatgaaagaaaataaacaaattcaagtatgcactgcctctcacctaccaccttgctacaga

SEQ ID NO: 699432 - DNA, 154 bp, Homo sapiens
  misc_feature (82)..(82): n is a, c, g, or t
taacactactacagggcgatgagtgcgcggaggaatggaatggcttttggatgcacaaactttcattttatttctacgatgntagatatggtcagtagagagactgaggtggagtagaataggcgtagacagaagtacgagttaaggagggcgc

SEQ ID NO: 699433 - DNA, 219 bp, Homo sapiens
ctgggattacacgtgcccgagcccatgcccagcatggtgaaaccccatatctactaaaaataatttttttaaaaattagccagtcacgttggtgtctgcctgtggtcccagctactcgggaggctggggcacaagaatcacttgaacccaggaggcagagtgagccgaggttggccgatgcactgcagcctgggctacagagagcgaagactctgtctc

SEQ ID NO: 699434 - DNA, 399 bp, Homo sapiens
ggtgctgaggtcattccttggttactcggaatctgtgacaggattttttcttttctttcttctgtatgttttttttttccttcctggagaaaggggtgtcactctgtcacccaggctggagggcagtggtgcagtcatgtttcactgcagcatcaaactcccgggctcagttgattctctatttcagcctcccgagtagctaggactacgggtgtgcaccatcatgcctggttaatttctgtatttttggtagacgtggggttttgccatgttgcccagggtgttctcaaactccgggactcaagctatcctcctgccttggtctcccaacatgcggggattacaggcatgagccaccgtacctggccaagagtggttacctttcaaagttcaccttgc

SEQ ID NO: 699435 - DNA, 855 bp, Homo sapiens
tgtgagtcttgaggcatatgagatgattgctttcttactatatgtcgcccagcgggctctgcgtagcaatctggtgctcctagcgagatcataattcgtgatctcgataagcggaactggacaagcccgaaagcatgggaatactgagtgggtgactcaagccctgcgagacgcctgtactttctgtccaagactcatcgctgcgagttgagctcggcacctctgttctagcactcttaaaaggagagataaatctacccttctgcttgtgtactctttctgatcatgtagatcacagtgatcacctgttaaacatgtcagaggtgaagctgtccagtagttctcgttcaagggtgttcatcacaatttcccaagaggccgcttcggctagcccgccgcaccagtagacgttctgtccccgatctggtctgtaggggtggccaatccgagcaacctgccgacctagcccatccagcgtggggccttgtcctcgctgtacatgcagacagtagactcacggcgtcaggttttgccagtgcgaaggcagaggtactggttacaccgtcggcgtctgcaggctgctccctcactgtgcgggccatctggtcaaaggccaccaccttcaagcaaccctccatgaaccacagcgacatttggttcccgccatgtcccctgctgtcactgctcatatccctgacactgcatttactttcccctatctgatgtttctctgtagtgttgttcagatgatgccccaccttctgcttgcccgagagcaggggcttggcatgtcggcctcagtatccccagtacagagaaagggcttagcgcccaggaggcagtgccctcgggaag

SEQ ID NO: 699436 - DNA, 844 bp, Homo sapiens
  misc_feature (168)..(168): n is a, c, g, or t
  misc_feature (500)..(500): n is a, c, g, or t
  misc_feature (507)..(507): n is a, c, g, or t
  misc_feature (563)..(563): n is a, c, g, or t
  misc_feature (580)..(580): n is a, c, g, or t
gggtgacactgcagtgctcgagccccgtgcagggtgagcttgcgggagtgatcgaccgacagacggactgcacgccgaggcactgctgcccccagcccctgcgccgtggtgccacctgcagcccgaccccgtgccgccagtccagccgcccctcgcccggtgcctagngtgcccggccccacacctgccatgctgctctgtggcgccctgggtccgccatgcgctcctgcctgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggctgccaaggagagggcacatcangcagaangaaacacagcggttttgaagattgaactctcagaggttcttgagaaccagagcagncagtgccgagctgaaangaggcggtggaagagccatcatccaaggatgtaatggagaacaatgagaggattccaatggacgtgcagagaaaagttggtgaagccaacagactgggagccatggccccagtgccctccctggagcccatgcagtgagtccaatggctgagtgggaacaatcagtgcccctggggaggaagatggaggatgaggagaatgcaccaaaaacccaccctcaagtcagcctccccagacagaaataccatgccacatgccgatgtg

SEQ ID NO: 699437 - DNA, 364 bp, Homo sapiens
gaggactctacgtaatatgtaacaatttttttgagacagagttttgtgccgtccaggctgaagtgcagtggcgcgatcccggctcactgcaacccccacctcctgggttcaagcgactcctgtgcctcagcctcccaaatagccggaaccacaggtgtgtgccaccacacctggacaattttttgtgtatttttagtaaagatgggattctgccatgctggccaggcctctcgaactcctggcctcaagcgatctgcctgccccagactcccaaaacccaaagtgctgggattacaggcatgggccaccatgcctggccgaatgtaacaaattttttttttttttggaggttacattttacggt

SEQ ID NO: 699438 - DNA, 501 bp, Homo sapiens
  misc_feature (14)..(14): n is a, c, g, or t
cagggttgaaaganagccactagcctctctaagccttcatctctgtagctcattatccaaaaggtacagttgttcttctaggatccagtgttaaccctttggatcaatctccggggcaatttctggatcagtcgagggaccatggcccatgtttattgaggcctggttcacatgagcatcctgcagctaagtagcagggatggctgtgaatacaagtgaacaacaatcccagcagggaccgtgtgggacagaggagatgccacatctgcccccgtggaaagagagccactagacaagcaaaaacaatagctagtgattaatgtgttagcctgcctttaaagaagtatttctgatggcataattttgtattcctctaaaataagttgtagtcagagtaggagtaggccagtacccactggagaagaagtactttcttgagcagcgggggtcagtgccctcaccatcaattatagtaccttaatctgcttaaacaatacagtt

SEQ ID NO: 699439 - DNA, 1426 bp, Homo sapiens
tgccccaagccaccaacctctgcctgtcaccccatgactcccagtctggaccttacccattcagcccattccctgcaaaccagtggagtatccgctgcagctgctgcacagccccccatgccacagtggtgaagacggcactggcggacaatggccaagcgcacaccagccggaatgacaggagacccaagaccagacccacatgcacaaacaacaccagaccaaaaaccaaccagcaaccacgcacaaaacacacgccacaaaacaccccatacacacgacaacccgcaccacccaacaaaaaaaaaacccaagcaaagaaccagaagaggcacaacaaccacacaccacagcaggaacgggacgagcagcggagcaagcaagcgcgcagcgcccacccggcaacgcaacgcgagcaagggaccgagagaaccaaaggaaacaacaacacccagagggccggcccgaacaagaaagggagcaagccgcgagggcgcggaaccgagaagaagaaccaagcagggaagaagaagaaaaaacagcgcgagaggaaaaagaagacacgacaagcgcagggcgaggggaccgcgagacaccgcggacaaccacgcggagcggaggagcgagacaagaccccaaacggacagagaggacaaggcaaggaaggaaaggagcgaggaagcagcaagagagcaaacgaaagaggacagccgcgggggcccagcgaaaccacagacaagggagacaaaggaaaggaaacagaaggacactcccaccaggggccccggccggggacggtgagaggagcaccccgagcacgagcagagacacccaggaagcaaaccgagagccaggcgacagaaacaaaggagaaaaggcagaaagcgagcaggcaggcccgagaaaacaccccccgggccacccgacccgcaggagcccacgcggacgaccgggagcgcggccagcccgcgcagggaccactacacgaacccagcagccgcgcagacagcaacaacagcccacagcaaccaccagacgcggccagcaacgcagcaccaccggggcggacgccgggggggggaaggaaaacggaggtgcgaaacgaagggacgagcagatggaaccacagcgcgagagcgggcctgaaccggggggcacaggagggccgaagaagaagaggggccggggagcgaagacggagaggaaaagacccaagagagccaaaggcaacgacgcaaaacacacaccaaaagccgaggacgaaagtcaagggagcaccagcacacccaaaggcgcagaaagaaaacggaggggcaaaacaacccgaagaaacaaagcagccggaagaagggaagagacccaagaggcaaacgtgaagaacgagaacgaaacagaaaaaaaaaggaaaaaaagaggaaaagcgaag

SEQ ID NO: 699440 - DNA, 211 bp, Homo sapiens
gagtaaacatccagtctggtcacacatattgcaaactcacaccacaaagagttgcacacacactgaacgcagatgctggatcacagagacacattcttatgcacgcacacactaggacgtaccagacacagtcatgcacacaccgacacatgctcacactgacgtacaagcacagcagtaacatgcacacacaccatgcgtgcattgccag

SEQ ID NO: 699441 - DNA, 812 bp, Homo sapiens
ggtctcggcgagtcacgatgatggcggcaccatcctgtggtgagctagcggattccctgcttgtactcgaccgacacccctcgacgccttctgcagactccgtggctggcgctcggcgcgtgaggaagcacggcggcccgagcttcgctgcggaaagtgccgaagatcgcggagtgcagcggcgcggtccggggcacgggctgggggagagggcacgctccgcatgggcgacatgtgacaaagcccggaaacgcacgaaaacaagacacatacctcacagcacacagccgccgaaggacgcagcagtggacgaaaaccgcggggggaccccacgacgcagtgaccaaaacggaacacaggagccacagaagggacacagcgcacccgtggacgcaaggagcacccgcgcaaaggccggaagcgcagaacaacgggacaagggacagccacacgagacgcggaaagacgccacgaaacgaagcccggaacaaagaaagcaagagacaagaaaagggaaaacaggaagaaggggagcgcacacagaaggagcagacccagagaagaacagcagcaagccaggcaaccagagaagcacaaggacacaggaaaagaccaagcaagacgacagggggagcaaaccaacagagagaacagaccccgcaggccgagccgaaacggaagagaacaccagggacacagcacaaaccgacggaggcgagaacagaggccaggcgaagcacgtcgcacacgcacggcagcgcggccacaccgcacagaacaagcaagaaaactcagaaagagaagacaaccaa

SEQ ID NO: 699442 - DNA, 1361 bp, Homo sapiens
accatgcagtgcccctagcttagagcctccctcaattccaccctggaccaccaccccccactctgtgcctgaccttgcagcgcagtctctgtgtgccatctgcctgtgcaattagctccacttgcgtgcatcatgtcctcatattggctcacacattgacaaccgtggcaatttgctggggccaatctcattcaatcagctgccattcaaagtccagtcaaccttcacctctctcagcggcaggctcggcggcgccaacacaggtctcacatcttctgctcatttctagggagcttttctccgcttgtacctctcctccggcgcttctcttcctaacacacatttgcttctctcttgtgcaccagggctttcatcgcctccacatccccatcttctcctcatcttccagattgcacgaattcaacaaaacacaacacacacacaaacacacacacacacaacacacccaccaccacacacacacacaacaacacacacatgtgttgaagtcttcctatatagctcaataccatatatctactctactactcttgactcatgacctggtcccccacccatccactctccatcgcacacaagcgtaccagcccaacctatctctaatctattgctgacgcacccacccataccgactccaccacccctactatcactacgacctaatcaacaccatccacatataactcactacccccctcacatccaacctatatccttccacctcctccctcatctaacactctctcctccaccatcttgctctctatcaccaccacactttgcatatctccccgcacaccccacatatcccaccaagtcatctaaaccgatacaatttattacatcattttataatacaccaactctacaccaacacaacacaaatcaaactcctccgttaccctcctcgcccacccgacaccactccgaccttctcgctcattctcacagacaccctcctacctcctgcctatccttcccccaaccacatcttttttccctcacactcacatctcctctacacacaccaaccacctatcaaaccacaatcacccttttcattcatcacacttctctcttcacactccacctcagtggcacacattcactcccacatcacacaccatcgtacctccatcctgctgacctctgcctctcatgtcatctcttacttctaccacacaccacacactgcagcgtcatccaacacacactcgctaaccatctcctctctcccctcactcctcagtacacaccacctcgccacacaaccccaaacaccagccccccatctcatccctcatcaaatcctataccactgctacaccgcaccacactcc

SEQ ID NO: 699443 - DNA, 370 bp, Homo sapiens
  misc_feature (136)..(136): n is a, c, g, or t
gagagggttacatttagtcagaatggtcttgatctgacctcgtgatcggcgcgttcggctcccaaagtgctgggattacaggcgtgagcatgtgcccggcccaaatttttttacagtctcttaacaaggtcctgtncttaaaagaaagttacaacaacaattaggggggggactattcacagttgtacagtgatggtcagttctacctgtggtgctggaatgaggggagtcatagggtgcatatgagaaatggcttattacaagaggagcttggctgagtgctgtggctcacacctgtaatcccaacatttgggcaggctgaggcgggttggatcacctgaggtccggagttggagaccccgtttccaca

SEQ ID NO: 699444 - DNA, 617 bp, Homo sapiens
gcatatcagtaagtcattgctcatcaggtcacccatcaattctggaccatcttccaaagggttgtatatggatcatgacttgaaagtgccaaggttcatgctcaatagctgcagctcacgtctacaagtgtagattattgctcggatgatgtgcacatggttacaaggtcagctagtagcactgtatgtcttgctctcactcaatatagggtctgtagggcacgcataggtattgtagagctcatctccattctcgatatgggttcacgagatctcttgatccatgtgcacagtgactgtgggacaatgagcatacatcagctctggctctacctgttgtctacgcattacaagtggcatagatggcaatgtctgccagtgcccccttggcatgccgtagctattaggactcgctgttcatgcagttggcaccattgaagatgagacgagttcatccgtgtcaggcataggtggtatcgatgacatcatggtacgcggcaatgatggtatcagtgcctatttgcagctgggcatcacagttgcatcgtaacagtacgctgtccatcagccgttgcaccattgactgccacacggacttcatgtcctcttgagtttag

SEQ ID NO: 699445 - DNA, 975 bp, Homo sapiens
cctcactcagtgctccggctctctcctcctcctcttcctcctcctccacttcatctcctgttttgggcgccccctcttaccctgcttctacccctggggcctccccccaacacgccggtgcccctcagcccctgagtagctcgagggccagacgagccagaaggtcccaacagcagtgccaaacagtcgcaaatatgtctacccaaccttggtcttccatcactcagggcgtccccctggataccagtaaactgtccactgaccagcggttacccacatacccatacagctccccaagtctggttctgcctacccagccccacaccccaaagtctctacagcagccaggctgccctctcagtcttgttcaagtgcagctcctcaggtgggcagcccccaaggccaggcagtctcattatgggacacacgtacccaacatgggaccaggtgggcacatgggcaacagtacttaccaccggccaatgagtgacttcaacctggggaatctggagcagctccaccctggagagcccatcagaccaacctggtgctggatacccccctggcatttctgaagggcctggatcctcagcggcgtgcggggccacatgggctggcccccaggatcccacaccttcacccacccagaaatgacccaccggtcccggccaggcctcaggcctaacacagccctcccaggggaccgccctcaccaggaatctccaacgggaaatgcgccagccctgcggcacggcctggcccgaaggcgccccacccgcaatggcacgcatcgccggcccaccaacaaccagcctcccggagccacacgcgcctgcacaggccaacccgtacgagcgcccccgcgccgcagccgactcaccggcagcgacatgcccaggcgcgtccacccgcaccccacacccccgcatgggcgcccacgcaacagcaggcggacgcgaacaccactgcgcagct

SEQ ID NO: 699446 - DNA, 122 bp, Homo sapiens
gctggctagctcctccaagatcctgattcctcgtgttaccacactggccttgctctatttcgccccacaggctgcacagcaactccttgctcctctgtgctctcattttctagttctgccag

SEQ ID NO: 699447 - DNA, 178 bp, Homo sapiens
catcagagaggaactgccaggaccaccctgccaggagtgtctgggtccagctctgaggtccgaactgtcgtccaccaagctgttcttgctgtagagggtgcctgggcccggccccagggagtctggggcgtagagccggcatttgtctctgtagtcacgaagctggaggctggtgcgg

SEQ ID NO: 699448 - DNA, 511 bp, Homo sapiens
cgggagtgactacactatctgctggaggcatagatcggtcaggatgcttgaacggtgtcagcttggatgcaacggctcgatgcgcttctctgtccgttgcttggccttagagacctcagtgccagctgcttctttcctgctcggatgcccgggggcttcttctttacacctctctgcttcctgggataaggactccactttgcgcgagagaagctgttcactctgcatcagctggtacaccccaacatctacgtcattgactggagagaccttggcacgtggccctcgggcaaacttcacaatcttctccccgttctgctcgaggactgtgaccctctcctccttctgcagctggagcaacaccaagtagaaggtcctctcatctgggcaggagttagcacagagggtgctgagctctgacagggccaccacggggtgtgaggaagagggcgcgttctgataccagacgatacacctcctcagccttttcctgtgggaaaggcaacattgg

SEQ ID NO: 699449 - DNA, 403 bp, Homo sapiens
  misc_feature (376)..(376): n is a, c, g, or t
gctcgacgagagggtatgagtagatagtactataggcatctaatgggtagaagccacggatcctgctaaatatcctgcaatttacagggcagctccccactgcaaagaatcatccaatcccgaatgtcagtagtgctgagggtaagaaactgaagccaaagttagaatcttgcctctgtcagttaaatagctgtgtgatcttgggcaagttaccttccctctgtaagattgaatgagctaatgtatataatgtaggccgggcgtggtggctcacacctgtaattccagcactttgggagaccaaggcaggcagatcacctgaggtcaggagttcaagaccagcctggccaacatggcgaaaccccgtctctactanaaatagaaacattagctgggcatggtg

SEQ ID NO: 699450 - DNA, 933 bp, Homo sapiens
  misc_feature (29)..(29): n is a, c, g, or t
  misc_feature (67)..(67): n is a, c, g, or t
ggcaggtgcctgaggtcccagctactcgngaggctgaggcagaagaatcgcttgagctagggaggcngaggttgcagtgagccgagatcacgccactgcactatagcctgggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcacttatccctcaaaaacaactctaggaggtagggccaagtaggaccatcatccctgcatttcacatggagctcagagaggttaagcaagccgtgcaaggccacacagctcataaatgcagagccaggatttgaacccccgtggcctgaccccaaagccgaaaccactcggcactgcaggttcgtcccttttctctgagatgggggtatccaatcttttggcttccctgggccacagtggaagaactgtctggggccacatataaaatatactaatgatagctcatgagctaaaaaataaaacaaaatcacacacacacacacaaaaaaacacaaaccaaaaaaaaa

SEQ ID NO: 699451 - DNA, 393 bp, Homo sapiens
ttacaatccccacgatcactattagaatactacaaataatattagcttgggagtgtgtggacggtgcacctatagtcccagctgctaggtatggctgatggagggaggatgcttgagcccaagtgagttgaggcaacagttagctatgattgtgtgccactgcactccagcatagggtgacaataacgagactctgtctcgggggcacccaagaacaagaaactgaattgctgagttctattgctgtggtacattattttctaacttagtaaaccagtttctcagcagtgactgcttcagacattctacaacaatttgaatattctgagtattagaaactttgactaccatttcacacaccaaccagttcacttgtgaccccagatgttgtca

SEQ ID NO: 699452 - DNA, 254 bp, Homo sapiens
  misc_feature (37)..(37): n is a, c, g, or t
gagatcggatgagacgtattacacgaagtaaccgcanatgcggaagggcgaggggattgcgagtaccgagtttccgcgcggttgaggtactggggaaacggaatcccccaccggccaatcatgttggtggtggggtctctccggtggccagcagtggttgtcagtaagcgggcggcactccctttccgatacgtcttttcttttttcatttttgagacggatgtctcgctttgtgtcacccaaatgctggagtg

SEQ ID NO: 699453 - DNA, 603 bp, Homo sapiens
  misc_feature (580)..(580): n is a, c, g, or t
cgaacatctcgtggctagaacttccaacactatgttgaataggagtggtgagaaagggcatccctgtcttgtgccagttttcaaagggaatgcttccagtttttgcccattctgtataatattggctgtgggtttgtcatacatagctcttattattttgagatatagcaaaaacagtactaataggaaagtttataaaaatgagtgcctacatcaaaaatgtataaaaccttccaattaacaacctaataatagaactagaaaagcacgagcaaaccaaatggaaaattagtagaagaaaagaattaataaagatcagagcagaaataaattgaaataaaaaaacacaaaacatcaatgacatgaaaagttgttttctttaaaaaataaataaaatcaacaaacctttagccagaataaagaaaaagagaaaacccaaatagataaagatgacaaatgggacatacaaccaataccacagaaattcaaagaatccctggagactactgggagcagctatacgccaataaattggaaaacgttgaagacatggataaattcctagacacacagaaccttncatgattggatcagggaagaaac

SEQ ID NO: 699454 - DNA, 105 bp, Homo sapiens
atcgacgatcaaggtacggcatatatttacagtaggaatagacgtagacacacgagcatatttcacctgagcaactttcacaaaagctgccttctgtgccaacaa

SEQ ID NO: 699455 - DNA, 309 bp, Homo sapiens
  misc_feature (298)..(298): n is a, c, g, or t
cgagacagagtcttgctcagtcatccaagctggaatgcggtggcactatctggtctcactgcaagccccgcctcccgggttcactccattctcctgcctcaggctcccgagtagctgggactacaggggcccaccaccacatccggctaattttttgtatttttttttagtagagccaccgcacctggctttttttttttttttagctgagacagggttttgctctgtctctcaggctgaagtacagtggcacaatcctagctcaagcagttagaataggatttttgaacataattangcacaataaaa

SEQ ID NO: 699456 - DNA, 117 bp, Homo sapiens
aggagtcagactggcctgggcaacacacatgagacccatctttaccaaaaaaataaaattacattaagaaattagctgggtacggtgacgtctgcctgaggtcacattcaagaagct

SEQ ID NO: 699457 - DNA, 235 bp, Homo sapiens
tcacttaaaacttttgtttgctcttttggtttgaaactggaattttttttccaggaaggattatcccatcatatttctgtttgaaccatcgcatggcctcctctttggtgattcggtgtttgtccccaatttagcctttcctgggcttcttgtcttcgatgctgaaacctggcctaccgagcaccagttagaagttcaggccttagataccaatgcttgggtcatattttatacc

SEQ ID NO: 699458 - DNA, 889 bp, Homo sapiens
tctggaacaaagagaagataggaaggaaaaaaaaaacagaggacggactgtgaaaactccgtttgtgacacgaggccgcggggcaaatgagatgcatagacgcggccaatttaccataagccaaccggacacggggaacccggggagcaccccgcagccctttgggaaacgcccgtgggtctaatccagcatggcggaaaaacaccacggggtcactcgcgacagtggacccacctgaaccatcggtgcttattcgccccactgtgctgcaatatacccccctggatcggtgttctcatgctgtgcaccgaaaattcataggaaggaggaataacgccccggggcaccccacctgctctcaaggttctcagagctcctgatacaggcaccgagagggtgttgacaccgccgcctgagaacagggggcagtcccacccagcacccacgaagtgatgcggaacaccctgcaacggcgagtgttccacaccagaaaagaaggggggccctcgggccccaaacgacccggggccaaagaagaccccacacgatgtggcgtcgcgaatagaagcaagcaacaccagccatcaaatggctaaaatgaccccaacagtttgctttagcacgtctcgggggcccccctggccagtagtgaaaacccctgctattttgtcgacccccaggagaagatataattggttctctagacgtgcagacactggcggagaacaatggacaactagaaacaccaaaagaggggccccgtttggcaaggttccgccgccagacgcagagactgtttcttcggacccaagaattagcgtacccccctacggagtgggtctctttaatctcccaccaaaaaccccctttttgggaacccaacaagaca

SEQ ID NO: 699459 - DNA, 546 bp, Homo sapiens
  misc_feature (475)..(475): n is a, c, g, or t
  misc_feature (489)..(489): n is a, c, g, or t
  misc_feature (491)..(491): n is a, c, g, or t
agttggagccgcaccactgcactccagcctgggtgacagagtgagactccaactcaaaaaaaaaaaaaaaaaagatcttggggaggcagacagccccccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatggaggtatgttctgtggcagacatgtcaggacagtcctccagccctctgctcctgatggttntgtgacattgggtntnttgagggcagtggagtgtcacacagctaataaagtacacatttcatgttggaaaa

SEQ ID NO: 699460 - DNA, 408 bp, Homo sapiens
  misc_feature (4)..(4): n is a, c, g, or t
  misc_feature (59)..(59): n is a, c, g, or t
  misc_feature (69)..(69): n is a, c, g, or t
  misc_feature (87)..(87): n is a, c, g, or t
  misc_feature (97)..(97): n is a, c, g, or t
  misc_feature (350)..(350): n is a, c, g, or t
gggntttcacctaatatttgtaaaagcacctaggaaacaattttgtatacatcaaaatnaaatttgcanctccttataattagaatnaaaaaatttnccacaacaagtttactgttcataaaattgcgtagtacaggctaggcatggtggctcacacctgtaattccagcactttgagagaccaaagttggtgcatcacaaggtcaagaggtcaagaacatcctggccaacatagtgaaaccccatccttactaaaaatacaaaaattaggtgcgcatgctggagtgtgcctgcagtcctagctactcaggaggctgagacaggagaatcgcttgaaccccaggagtcanagggttgcaagtgagctgggatcactccacgtgcacgtctatcctggtgacagagtga

SEQ ID NO: 699461 - DNA, 277 bp, Homo sapiens
cgctccgcacatgcgtgcatggtggttgcattctccacatgcgggtggggcatggggtcatggtcattagagttgaggtcatagctatcctcagaggctatagttgggtgcaatgtcctggatggtgtgttccactccgtcatccactaccaccagcgtcacccctcgcccagtcacattgcgttcccacacacccgtcacgttgatgtccctgcccgggctccgtcggttattcaggtgccattgctgcgggtacttgggggcgggagacaatgag

SEQ ID NO: 699462 - DNA, 299 bp, Homo sapiens
ccataagcagtggttgttcttaaagtggtttgggttttcatttgacaccacagtacagttttctcttttacaaaacccaatgagtgcttgctgtggcatttggatgtgtgttaatgtatttgtttggtctttaaaaaaataaaacctttcttaatttaagctctcattctttaaaggatgagtattttttagctttaactgtgagttcaccttgtaaacaactgtgttgaggacagcctggtacatatatacaatttgtcatcggcctatggattaaaaaagggtaataattctttgta

SEQ ID NO: 699463 - DNA, 1217 bp, Homo sapiens
tcacagggcttccttctccttcttttcctagccacccaaattattagggggttaatttcaacctaataaaagcaatggggggggctctcatggccgggtaattcccaggcactttgggagaggcttgagggcagagacagagactcactggacgcctcagggagtcgagaagaccagccggggcaacagggagaagatcccagtctcataaaaaaaaagatacaaaaaaacagcagaggggcagttcgaggcggaggggcggcgcgtggaaaagaagcacgacgaggacacacacacagagggaggccctgaggggccacacaagagaggtccccctgtgagacacccaagaaaggccgagagaggaccacgagaggggggagccgtggagacacgaaggtgcaccccagtgagaacctcgcaaagcccggtggcacaacctcggacgacaaaaagacccgggcatatcaccccgagaaagacataaaaaagaaacaccgagaaaaaacagcgaggagcataacacatctgcagccggaggggaaggggaaacacaaaagggagcgcaccgacaaacaaccggggccaaacagggggagcacaaaaagacgagaacaacacacgagaacacagaagagaaatatagggtggacaccacacacagcgaggaaaaaaaaatatgcgcagcggaaaaccacaccaacataaagagagagagagagaaagacaaaagcaagagcacgcgagaaacaaaccacgagagtcaaacacaaggggaaagaaacaaaaagaaaaacatcgggggagaacagccagcgaagaccacagaagaagcacaggaaccagagaaaggaaagaacgcaaagagaggcgagtaaccgcggacacaaccacaagcacgagcaacaaaggcggagtagagaacaacacacacacaacgcgacgaaggcagtaagaaagcaacgagcaagacaccagcagaagagcaaaaagaagaaaagaaaacagtaaaagacatagaaaaaacataacgaaacaaacacaacagcacaaacagacagaagatagaaaaaagaaagaaagacaaaggaaaagaaaagacacaagagaagaagcaagagaagaagaaagacgaagcgaaagaagaaaaaaaaagaaaggaagaaacagaaacgagaagaaccaagcaacgaaagaagagaggcagaagaggagat

SEQ ID NO: 699464 - DNA, 362 bp, Homo sapiens
tttgaaatatttgtccagttgagtagctgctgctgtacccccaggtgttgtaacacaactttattgattgaatttttaagctacttattcatagttttatatccccctaacactaccttttggttccccattcctttgttgtattgttgttcccaagatgtacttatcatgctgttttatatcgttcctaagtataggtgtggatcatgttcggtctgtaacaacagttgctagtactttctggcagtgatacactctgtgctgacaaattattgctccctgatatctgtaatgcaagtcagcttacatctttctacctcattttttctagtctgccaatatttgagacaattgatacttat

SEQ ID NO: 699465 - DNA, 154 bp, Homo sapiens
cggacccgaacccaggccgaaacgggctccccgtcttaacgatttggcgtctcccatcgaccaccacctctttgtgcagcagcccgcgggcagaccctgatccgagggcaacgctcaccagtcccacagggcgacccggaaaaagatcggacaa

SEQ ID NO: 699466 - DNA, 623 bp, Homo sapiens
tttagctaaaaccacaagatgatacagtggaacgtggttggagtgctagtcaggtaaaaccttaggttttatccattcgtttgagactcgagctcgctttctgtgatggttgacatatggtgctgcattaatttccaggggccgatttccttactgaatagccacgtcagcaaatttcagaccaacctggctgctctatcaggcacagattaatgcaatataatacaatatgccggaggcaaacgacaacccgggccccactgccgacctcttgattctcccaccttccctcaagaccctaggaatttaatgtgcttatggctactggacagacagaacgaggcagggtgctggggcgaattggtacccgaaatactagtgaagtttatctactttattatttttctttagatagaatagaattagaaataataatgtggctgggtgcggtggctcccgcctgtaatcccagccctttgggaggccgaggcgggtggatcccgaggtcgggagtttgagaccagccgagatcaagcccctgccctccagcctgggcagcagagtgagactcttgtctcgaaaataaaataaaataaaataaataatagaattagaaacaatca

SEQ ID NO: 699467 - DNA, 679 bp, Homo sapiens
ggctggttgatgatctatgctggctgggcgcggtctgtgctctggaggctagcgtgcttttagtctctcgtctcgtcttcttactgcacgtatcctagaggttgctgtgctcagcgactccgggatggcatcgaatctccgaatggaacactgcgaacgagtgaggcccccgtgacgttccccgaagaactattcttatcgggttgtgaacgtggatcaatgccgagcgaatcgattatcacgtttgattaccgtgcagtaaactcgatgatcatgatgcacgccagttatctgtaagaacggtcagtttaggggctggtgcaaaggatgagttgcacattgttgaagcaagacggcaatgaattacgaaggcagtccaattaacacgtaacactggacaacttctgacaacactgtctgtacagaccaacggtttcccttgggggcttttgaaataacaccaccagatggtcttaaggttgaagtgtggttcagggccagtgcatattagatggacaggaacttaggtagatgtggaggaaagatgcaagagtacaagaagatgaagaggaaggaaggatgtgaacactcttaagatatatctggaaagaggtctgcacatggaggtggtagcaaaggttccacagaaacaagtaaaagttgcagcttgatgaagata

SEQ ID NO: 699468 - DNA, 160 bp, Homo sapiens
tggtcgggctacacgctgtaccacacactcagcataacagagactgagaacctgtagccctagccactcaggaggctgaggtgggatgattgctttgaacccaggagttatagtgctacagtgcagctatgacttgcactcattgcctgtccaatcctgg

SEQ ID NO: 699469 - DNA, 372 bp, Homo sapiens
tgggtgttgtgatgtaagccatgtctactttagggggccccacaagacgagtaatgctgtggttcttgcagactcatagaagtgctgccttgatggtcttggacaagatttaggagaattatctggattacctgacagaaactcctgtttctccccttactttctccaaagcaaacagagtctctttctctctctgttctgagtcacctcagctgaaagtggagtgacacacacacccctgtgggccagcactacaatgactgcactggatcagatctgaaacagcacaatactgcatctcgcccatggcctgctgtaaccattccctggctactgcctatgttcactcaagtctctggggctcgtcgacgc

SEQ ID NO: 699470 - DNA, 251 bp, Homo sapiens
aacttgtcacgaattccatcttgtaaaggatattaaatgttgctttaacctgaaccttgagcaaattagttggtttgtgtgatctatacatttatgtgggtggcttctagtttctacttctaagggataagtattaatagttcagtttatggctttttttgtgttgtatcgttgtacggtttggattatcttaaattttgacggacactgtggtagactttctgtttactaatatcctttttgttttgtat

SEQ ID NO: 699471 - DNA, 364 bp, Homo sapiens
  misc_feature (29)..(29): n is a, c, g, or t
  misc_feature (33)..(33): n is a, c, g, or t
  misc_feature (92)..(92): n is a, c, g, or t
  misc_feature (96)..(96): n is a, c, g, or t
  misc_feature (108)..(108): n is a, c, g, or t
  misc_feature (119)..(119): n is a, c, g, or t
  misc_feature (132)..(132): n is a, c, g, or t
  misc_feature (141)..(141): n is a, c, g, or t
  misc_feature (146)..(146): n is a, c, g, or t
  misc_feature (165)..(165): n is a, c, g, or t
  misc_feature (197)..(197): n is a, c, g, or t
  misc_feature (231)..(231): n is a, c, g, or t
  misc_feature (233)..(233): n is a, c, g, or t
  misc_feature (237)..(238): n is a, c, g, or t
  misc_feature (241)..(241): n is a, c, g, or t
  misc_feature (249)..(249): n is a, c, g, or t
  misc_feature (261)..(261): n is a, c, g, or t
  misc_feature (266)..(266): n is a, c, g, or t
  misc_feature (269)..(269): n is a, c, g, or t
  misc_feature (280)..(280): n is a, c, g, or t
  misc_feature (289)..(289): n is a, c, g, or t
  misc_feature (319)..(319): n is a, c, g, or t
  misc_feature (330)..(330): n is a, c, g, or t
  misc_feature (335)..(335): n is a, c, g, or t
cgggccgcgcctgggcgaacggccggagngggntgggctgggcccgggatggcggtggccctggcgccggtcccggtggcgccccgcgcgantacntgagctggtgcnagggaggtganacctcctgcagcncccaacatncgggnaggcacaggccccaccgtnacattggccctgatgctggcggtgtcatgggncatggagctcaagcccacagcaccacccatcttnantggnnggncctttgtngtagcgtgggangtgcncanacaggactgtngcccacgcntcaaggtgccactggacctgaatgcatttnatgtgcaggcntaaantaatgagggttttgtgaaccagaatatta

SEQ ID NO: 699472 - DNA, 212 bp, Homo sapiens
gttaggctggtcgcggctcaagctgggcagaggacatggttgccatggtctggaaaggcctgtccttggaaagctggtccttcaacttggactggatttcccgttgatttccttcgggccaaaacctggatgtgactagaaacctgttttcgagttcgggtcttccccgttctcagcttgagacactcgactctcaagctggagacacgcga

SEQ ID NO: 699473 - DNA, 536 bp, Homo sapiens
  misc_feature (530)..(530): n is a, c, g, or t
  misc_feature (533)..(533): n is a, c, g, or t
  misc_feature (536)..(536): n is a, c, g, or t
cccgagaattccgatctcatttccttggcttcaggataggcctaataagaaaacaaataattccaattcatatatgaacattttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggactcactgagaattcagtgctcactgagaattcagtggactagtantantan

SEQ ID NO: 699474 - DNA, 246 bp, Homo sapiens
cctacccgagaagacagccgcagcctcaatgcctttgaccccacactcccgagacgatgacgcattcctagagcagggagagccaccctctgaggcaagaagagccctgctgcccagttgccagtcctaccacggcggggaaccttcctggctccagcacacgaccagataagggggtgtgtggcatgaattatgtggaccactgcaaagaacaacgtcccgtgcccaaggagcccatcatctcag

SEQ ID NO: 699475 - DNA, 446 bp, Homo sapiens
  misc_feature (192)..(192): n is a, c, g, or t
attcgcggccgcgtcgacctctgcttggacctccccctgttctccttgccaccagcaccactctgctctgtctgccctggctccaaatccctcctcctctccctcattctcatgagcctttctgtttgctgcccctctccctaccttgctgtctgtccttcatctctctgtacatccagcttttctctacanttctccagttgcttttctcctcctgctttgttatcttttgttttttcacttttgctgtctcttggcaaatccctgaccatcccctactttgccatctgttatgggtctttctccttcttcttttatctgagctgttgtaactggagctgttgtaactgcccattctggacgtggtaaaccgaatcagtagcgggcgtgcgcgccacttttccataatgtccacgttgctatcgcgttcatttgtacttgcgtca

SEQ ID NO: 699476 - DNA, 235 bp, Homo sapiens
tttattggtttattaattatcagtcaggtattgctctatatgcaaaatgattaatacggtctgcaatgtcgtctaggattgttttcttgtgatttttaatctgaattttctatttattattaaaaatggggtattgatgtctacaattatattctatgtattatctggctttacttgtgtcaatcattgcatttatatatttaggagacctgcatgtaatatatacatatacata

SEQ ID NO: 699477 - DNA, 1011 bp, Homo sapiens
cgcgaagggtaacgaccgagcccggggatcctctttgcgggaccacgcgagagtgccccccgcgaaggggctctcccaccagagggctcccaccacacagatgacgcctgcgagaggaaagttgcagcaagggccaagatgtttgcccagaagggctctccccaccgggtgccccggcaccccccccgtgcaagcggtggttggcccgccgtgacccagagggcgtggcccacaccccgaaaggtaatcacggggcggaagagcatgaacacaaacagtcgaaggcctaacaaaaccccctttgtggcccgtggcagtattccgccattggggcggtacctggcatttcagcattattcaaataagtgatataagcaggccgacgcctggttagtcccggcatggatggcggtccaaatacggcatactgcggaccgtcctttcatgggtatgcattaaccatggtttgcggagccgcgagctgcaaccaatgtcgtgggactctgaccagacacgtgctgcactccccacacagcaccgttatggcgagagcgtgcatgcttactctttcaattgggggggaacactacaagatgtttgtttctaggcgactagcacaggactctggtggcgacgactgtgagatctatgtacatagtatttcgccaccccaagcggatgtgttagtagtacaagttacggccggttacacgtcgggcatcccacccgacggaatagtgatgctaggcctatgacatagtgggcggagaatacaggaaaaaattaaatacattttggcacacgggaggtgacttgggagtagatcgttggatagtaaaaccgagatgagagtacactctcttgtgtaccaacatagaaaaggacacaaacatgacccatggttagaagacgatgttagggtagacgagacagcacgcctggatggccgccggattcgatgacagttcttgtccgccccaatcaaaaaacaagaataaaccgccacatgac

SEQ ID NO: 699478 - DNA, 650 bp, Homo sapiens
  misc_feature (490)..(490): n is a, c, g, or t
  misc_feature (540)..(540): n is a, c, g, or t
  misc_feature (632)..(632): n is a, c, g, or t
  misc_feature (650)..(650): n is a, c, g, or t
ccatgctggtggctactggcactcctgcatactgagtggggccttgcgccgtcggaattgaatgctatgatgctatgctcttgaatatcgatctctaacatgactagcagctgatgataccagagacctctgcggaatcttacatgagagattccgtgattgatggccaactacctggagccttgcgaatcacctgtctcctgatcataccggattacacgatgatctacggacagtgtaagacagtgagacatcactgtagacaaccagacatcacaggtggcactgctgatatgagcattccaactcactatatcttactgacgaatcagctatacctggtatgatatacgctgagtacttgaagctgacgaaactgtatcacgagctcttgatgcatgaggcatcaagggtaacacatgactcaagtattcgatatctgcaggatatatagtgattagatagatcgccttgcaaagactctgtgcanatccatgacatcactggggagtgtcaagacattgccaatatgggagctanacatagcagactgtactatattatacctgtgagagctaaccagcagttctacatatactgagctcgatgggccctgtatatggcatgactgngttctagactagacttgn

SEQ ID NO: 699479 - DNA, 292 bp, Homo sapiens
tgatgatccagagactgtcatattactcagtgcccgtgaaattgatcaggaacggctaatggagttcgcccttgcatgctcccaaaggtgcgtatcggcatactgcaacgctattcgcgccaaaagtatgaaggccgagagcgctgcataaatgtgtctaactttaatgccgagcatctaaagccacaccgttgatgacaccggcgtagtgccgccatcgttttcggcgcagattttgcgtaaaggtcaattcaaggagaatgacagtgaagtggatggatgatgagctgga

SEQ ID NO: 699480 - DNA, 889 bp, Homo sapiens
ccttgtcagttgtgtgttacagtagcgtgagacgtcccctccgtgcccgccaggtgtaacacccatggggtccctcccctaagcgcggcgccgtctattgtagaggcccccatcttgtgcacaccattacagtttcctcccgtcgcgagaattgcgcggtttcccctatcgccggggtctgctttgttactacacgaggtactcctgaggggaaccagcttggtaaaaaccccgcctggttctccccggcgggtatcaaagtgcgccgcccctttttgggcccgggattctccccaggagaacgtggcccccaaatttccccggagggcgccacctctttgccccggctacaaaaaaggctgtaaagggaattacgtggcgcaacccccaaaagagaagcaccaccatgggggcacccccagccaccggaatactagtggggcatgttttgttctcacaaacccagtggtagtctggatggacccgcccaaaccctttttctcccaaaaggcgaccctgaggagtttttagagcggtttgacatccaccacagtcggcgtcaagcgttccaaacatatgtgaaatgttagggttcccgaaatatcaacaacaaaagtatactctgttaatcccctgccatttcatattgtttacaaccaccccccgggcacttcttttaaatgaccacacttatggagagcattcgtaaacccgcagtcttcctcttagcacccataaaacaacattctcgcagaaaaatccctctcttccccacggcttccaaaaaattggatttatcacgcacagagaagtttacaatggggatattcacccacataaaaaaaatttgggctccactgtaaaaaaattaaaaaaaagcccaaaaaaa

SEQ ID NO: 699481 - DNA, 82 bp, Homo sapiens
  misc_feature (54)..(54): n is a, c, g, or t
gcacgagcctttgtgactcaacacgctgcaagaatacagtctgcattaaataanatatatcagcattgtggtctgggaaaac

SEQ ID NO: 699482 - DNA, 606 bp, Homo sapiens
gataaactgggtgagagagtcagaaaactccccagataaacaaccgtaagacttcatacaaacacaatactctgatactgtagactcgatcacagtctggcgaagggctacctgaacaagaagtacagttgatctcatattctggcatgccagcttcttatatcttttctcatcgaccatctctaaaacttcagacttcctgatcctgacttggtatcactggagaacagtccaattatcctcactcgtctcagcgtatacacgaagagccttcaacacccacttgaaaattgtcctcaacacaggacagcggtgcaaacacgacgtacaggaatgctatgtatatcaagtggttctgtactctatctattaatatgtcctctatgcatggatctcgtatcactctgatgtatgtctgtctcctgatatgttactggctaccaaaacctcctaggagtctcgcagactttgtccaccaattcaggtcttaaaacatactgggtcatcacgcatgtcagaccaggataaagcaatactggtataaacagatcgcactatgcctgagctagaaagagctttcttaggtgaaagaggtcaaacgattag

SEQ ID NO: 699483 - DNA, 592 bp, Homo sapiens
accagagaaaatcttcctttggctgggtgcagtggctcatgcggtaatcccagcaatttgggagaccgaggcaggaggatcacctgagcccaggatttcaagaccagcctgggcaacatagtgagacttcatctccactaaaaataaaaattaaaaaatatcaaccaggtatggtggcatgcgcctgcagtcccagctacctagcaggctgaggtggggggaatcaccagcatctgagaggtcgagctacagtgagccaagatggtgccactgcactacagcctgggcaacagagcaagaccctgattaaaaaaaaaaaaaaaatttcttccctcaaatttatttttttcccaagggttcccctccctcactcttatatctccagtgaaaagcctcttccaagtgatcgttttggactcctccctcttcctctcgggcctccggtttgtaaactcccaagtccttccaattttacctccaaatcgtgggcctcaaacctcaaaccctcaatcatagctcagatctccgtcattgaaagcccagattctgggcagtccggtaaatagggtcccagagggcaggtgtccggggg

SEQ ID NO: 699484 - DNA, 581 bp, Homo sapiens
gaaggggcagtgagcacttgggctaaggatagctatctactcctcgggcattgtcttcttacagagttgagagctcctctgcacttggtgtatgccatcggccagctgatagtacttggcaactctgatcaatcaacatgcttgcagatggttacaatctggcggtttccccatccacgataatcgcttggctgtatctaaatgccagttaactgagtggtatggctcagcgctagcgctgagcatacccaaagactaaagattatggactattatgagaggaaggagaaccagatggagcggcagaggaaactccagatgtccacttggatgaatcaggcgagattcaaggtcctcagagcaaggagatgaccttatcacagacctactaattgaggcaaaccagagactcagcaggtgggtaaaggatacacccaggtcccaggtgcggctggatggcctggtcctccagggtttgtaccagttgctggagccccgaatgattgtccgtggcaggaaacaagatttccctctggtaagggctgcggtgcagacggcatttcctatgtacaaaatgggca

SEQ ID NO: 699485 - DNA, 147 bp, Homo sapiens
aagctctttagactcctgtcagacagtcgaccaagcccaaggacattattgaatctggagagtcctggggccttgtcgtgtgaaacagacttgaaatactacataggaggaaagacattaaaaataaatgttcacttgtctctgcac

SEQ ID NO: 699486 - DNA, 108 bp, Homo sapiens
tctcccaacctacaatatgcggatactgatcccacaataccggcacgttaaagcgccactccccgtcaacaaaagatttcagcagaaactgaatcacccagccaccgc

SEQ ID NO: 699487 - DNA, 335 bp, Homo sapiens
gaagaaaaaagaagtttctttattacaatttggtatctcatcccgaggtcagggccccttgcttagtgggaaaaaaaacccttttggactgattcttggaacagtacctgttgtcctaaacccaacttttttgggatgcccggatttcttgattttgatccagtagctggtcattttcctgccttttacatttaggggattcaagctttgttatttctcttagctgggcctgaatgtctgtctttctgcagggcccaacttctcctttagtgagggcagccaccccgccgtaaccagatagagcagccttccctgcctacttgagcaaagaaggg

SEQ ID NO: 699488 - DNA, 271 bp, Homo sapiens
ccctggtatcccacccatccgttgtggtctgatctgacccttgtatctgtgccgcctcacacgctgggcccgctccgtagggctgtgacaatgcagtcagagcagaatctgtggaggcactcctatggtggtcatacgtattcttcaagcatgtccagggcagatagggcacattgagttctagaatagcaggtgacccgagggggaaaccaggcaatactcttgtgcccatcccatatataggcttcccctgcgggggtcccggtgcagg

SEQ ID NO: 699489 - DNA, 458 bp, Homo sapiens
cgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaaatttatgtattgaaatatacttaaaaatcgagtgctttcccttttgtgtaatatttcctgggggacctcgtatttaggtgtcttaccgtgaattgagtctccaaggtctccatgtgaaacaagcaaaaagagaattatctgtaatgttgtaatttgtacctaagttttttcccagtttcctctgcttcctcaaccctttccattcataaagggttttgtttttcaaaggaatttgtcctttccttcaataatttgctttaaaaaaaataaaagataatgatttaatgc

SEQ ID NO: 699490 - DNA, 225 bp, Homo sapiens
tcgttgggctctcatcgtccctcttcatagcagcctcccaggcttccgtgcctctttggatacatccagtccctccacttccttgacgtcctcatacagcaaggtttacttcctcaatggcatttgctatctgctacgctgtcaacagacgtacctcgagccactgttcagtatcttgtgaggttcaggggacctactcgcttgaattctcgtagttgcatacgt

SEQ ID NO: 699491 - DNA, 174 bp, Homo sapiens
  misc_feature (80)..(80): n is a, c, g, or t
agacacgtatatattcgtaagcgctagaatagcactgaaacagaaaacagaaagaagcacatttcgaagcgcttctggcnaacaacagcgggacagactcgctgatgagttcattgttcactgcctgtctcccctgtccgggacacaagctccaggggggtagggggcttgtct

SEQ ID NO: 699492 - DNA, 358 bp, Homo sapiens
  misc_feature (39)..(39): n is a, c, g, or t
  misc_feature (56)..(56): n is a, c, g, or t
  misc_feature (58)..(58): n is a, c, g, or t
  misc_feature (75)..(75): n is a, c, g, or t
  misc_feature (83)..(83): n is a, c, g, or t
  misc_feature (108)..(108): n is a, c, g, or t
  misc_feature (113)..(113): n is a, c, g, or t
  misc_feature (120)..(120): n is a, c, g, or t
  misc_feature (180)..(180): n is a, c, g, or t
  misc_feature (189)..(189): n is a, c, g, or t
  misc_feature (232)..(232): n is a, c, g, or t
  misc_feature (247)..(247): n is a, c, g, or t
  misc_feature (253)..(253): n is a, c, g, or t
  misc_feature (267)..(268): n is a, c, g, or t
  misc_feature (280)..(280): n is a, c, g, or t
  misc_feature (282)..(282): n is a, c, g, or t
  misc_feature (300)..(300): n is a, c, g, or t
  misc_feature (313)..(313): n is a, c, g, or t
  misc_feature (326)..(326): n is a, c, g, or t
ccggaacaccattcttcgccaggccgggaatcacaagcnccgggtggataaggcantncttcagcagcggcactncaagccgnaatcagatgagaaggcggcggtttnaggcnagaagcnggtggtaggtaagaaaggaaagaaggctgctgttggtgttaagaagcagaagaagccgcnggtgggaanaaaggcagcagctaccgagaaaccagcccgggaaaagaagccngcagagaagaaaccnactacngaggagaagaagcnngctgcataaacncntaaatttgattattccgnaaaggtcaaatcnttttggacagcgncgtttgaataaagaggggattatacaggcagt

SEQ ID NO: 699493 - DNA, 755 bp, Homo sapiens
  misc_feature (36)..(36): n is a, c, g, or t
  misc_feature (65)..(65): n is a, c, g, or t
  misc_feature (72)..(72): n is a, c, g, or t
  misc_feature (92)..(92): n is a, c, g, or t
  misc_feature (99)..(99): n is a, c, g, or t
  misc_feature (106)..(106): n is a, c, g, or t
  misc_feature (110)..(110): n is a, c, g, or t
  misc_feature (113)..(113): n is a, c, g, or t
  misc_feature (120)..(120): n is a, c, g, or t
  misc_feature (141)..(141): n is a, c, g, or t
  misc_feature (159)..(159): n is a, c, g, or t
  misc_feature (161)..(161): n is a, c, g, or t
  misc_feature (170)..(171): n is a, c, g, or t
  misc_feature (191)..(191): n is a, c, g, or t
  misc_feature (194)..(195): n is a, c, g, or t
  misc_feature (200)..(200): n is a, c, g, or t
  misc_feature (223)..(223): n is a, c, g, or t
  misc_feature (264)..(264): n is a, c, g, or t
  misc_feature (267)..(267): n is a, c, g, or t
  misc_feature (287)..(287): n is a, c, g, or t
  misc_feature (290)..(291): n is a, c, g, or t
  misc_feature (302)..(302): n is a, c, g, or t
  misc_feature (308)..(308): n is a, c, g, or t
  misc_feature (312)..(312): n is a, c, g, or t
  misc_feature (319)..(320): n is a, c, g, or t
  misc_feature (327)..(327): n is a, c, g, or t
  misc_feature (334)..(334): n is a, c, g, or t
  misc_feature (363)..(363): n is a, c, g, or t
  misc_feature (369)..(369): n is a, c, g, or t
  misc_feature (376)..(377): n is a, c, g, or t
  misc_feature (400)..(401): n is a, c, g, or t
  misc_feature (403)..(403): n is a, c, g, or t
  misc_feature (409)..(409): n is a, c, g, or t
  misc_feature (438)..(438): n is a, c, g, or t
  misc_feature (530)..(530): n is a, c, g, or t
  misc_feature (550)..(550): n is a, c, g, or t
  misc_feature (599)..(599): n is a, c, g, or t
  misc_feature (675)..(676): n is a, c, g, or t
  misc_feature (680)..(680): n is a, c, g, or t
  misc_feature (716)..(716): n is a, c, g, or t
ggatcctccatcccatccaactatcatcttcctccnctccgcctccaccctcccataaatcactntccaccnctccaccatcactttcccanatttttntccaccncccnccnccaccancccaaaaaacatctgcccctntcttcttctctctccttnanatttcaaanntccccttttctcgcttcttnctnntactnctccttctgactgtccaattctncgttacaaccttctctccttttcaattctctcccttctccnccnaaaaactctctctcttcccnccnntttcctcctcnttctcntaantcacccnntcctccntcttctnctttttccctattttctcccttcctcttntctccnctttctnntgttctacttcactcttctcccnntnactcanttgccgcgcgctgccgggggagcagcaanctctgcacgccctcacccgcggccaaagcgcctgcgtgcaggagtctgacgcctccgctccccatgctgcagaggcagggagccctgaaaanccagagagcacggagataantgaggaggagctcctggataatttccatctgatggccccttctgaagangatcattccatcctttgggacgccatcagtacctatgatggctcgaaggctctccatgtcaccaacatcaaaaaanngaangagccctgccgaatagaactctacagagtcgtaganagtttagccaaggcacaggagacatcaggagaagaaatt

SEQ ID NO: 699494 - DNA, 449 bp, Homo sapiens
ctgttatacataggtaggctgatggtaagctgaccactacctaggtcagccgtggggcgcaacgtctctttcaagcagtcgtgactgtatccatgcgctcaggggcatgctagaggcctgggccgctgccacgttcgcacaagcccgtgtagagaagtgaatgctgggactcagacttcagacagagaggactgtaaggagggcggacaggggcctggagatcctcctgcaaaccacgcccgtcctgacctgtagcgccgtctccagtgggctgcttcctcctggaaatagacgcgggtgtgtcttgtggcagagctaggatctgaactgcctccatccaaggccaggttctccgttagctcctgtggccccaccctgggccctgagctggcatcaggaatatttaccaacgagtgatagtcttttgcttttggcaaacctctacttaa

SEQ ID NO: 699495 - DNA, 251 bp, Homo sapiens
tgacaaaatcattttgaaaatcctttctggtattgacaaaagcacagtcctcttgcagttccgacgacaaacacgtgtggttcatacactacaatgcaggccacttcggctttggacgtgcccaattctttacacatggactcgagacctgacatgaggaatgtccccaccatcgtgcttgacgaggactcttcatcttcaacggggagggtggacagtgcaacttgccccatgatcaccgagtgcggccg

SEQ ID NO: 699496 - DNA, 383 bp, Homo sapiens
aaaacttctcgctccccgccccaaataacagctttaaaaagcctaacaaagaatgtattcattaattggtttaatgaagaataaagtaataaaacacacctaccctagctccgaacctggtaatcagtctgcatacaaactctttgggaaagaaacgaaatgtattgcacatgtaaaatatgaaacttactctctgtgtgtaggcatcctgtatttttttgactctaaagaaattctttctgaagcttggtgaagctgtgcaatagctcatgaattagtgtatttttttctttcttttttaaaaatatgtaaagtgcagtcttctgattcctgcatattgtatatcctgatatgtttcctagcagttaataacataattacgt

SEQ ID NO: 699497 - DNA, 171 bp, Homo sapiens
cgaaatactgaactgcggtgcggtcgatttcggttccgccgcgggcctcgcagtggtgctcgcgcgcgcgaacggaacccgatccatacggtctacgtgttctcccgccccgagtggaccgcgctggtggtccgcaaggattcgccgatccgctcgctcgcggacctgaag

SEQ ID NO: 699498 - DNA, 535 bp, Homo sapiens
  misc_feature (40)..(40): n is a, c, g, or t
tttaatttaatattcccctcttgaaaagggatgacaatanagtcacatacaaaaaaattaatccaactggcctttcttgtttttctaaaaacttttcattcaaacatttcttattatcatttattgcacatagcatggattaatcaaataagtttaaaataaaataatagactagagaaaggtgctttattttaaaaacagaaacaaaaagaaggtacgtggattatctgatgctacatcacactctgggagagacttcccttctttcagagagcctctcatttcttaatgtggatcattttgctctttccccctgataatgctcacttactctctttcataatctccccctctttcacttgttcttttctttccaatcatccaatgatccatcaaggtactttggtgttcagtgctttctcatatggttcaactcagatcatgtagtctttctcacccaaccaattcaactactgtttcctgagaccccactatgtccttgactctgtaaggagttcctgaatacaaaaaaaaa

SEQ ID NO: 699499 - DNA, 350 bp, Homo sapiens
atactccgttgataaaactgaggatgttaccagctagaatataaattactaaagtgagagcaaaccattttcaatgttctgtaaaacagagtaatactgatctgcctaggtaaatatttttccctaggagcttatgatgaaatactgtagcaaaggcagagagtagcaatgaaatgataaagcggatgctggaattgaaatgtgttagctctttcagtctactttttaaaaaggggtttattttttaataaaaagaagtttgcattgggggaaagggaacaaaaccatttatttaaagttttgtccctaaattaattttaaaaaaaatttgggggaaaaaaaaaacattt

SEQ ID NO: 699500 - DNA, 299 bp, Homo sapiens
agaccacgtatagtgtccacatagtaactaccaatcacaacagtgtcaaataaacacatgtacatgggcagaaagcagcaagcgatatcaaccatcattccaaacattcagacagttgaaaataacacctcatagatatttaagtccagtgcaaacaagaagacagcggagtgtgtgtgcacatgtgtgcacacctttaggtctgcactgtcaacaacagacacagagaagcccaagcagcacgcagtccacagacgggggcgttagagtcgggaataccaatgggtcaccctgcatca

SEQ ID NO: 699501 - DNA, 126 bp, Homo sapiens
  misc_feature (55)..(55): n is a, c, g, or t
aaggtactctagaggatctccaccttatccgtggcgaaacagcagactccgtctncaaaaaaaaaaggatggatggaccgaaggactccttgtctgcatgcgtctccatgaagggtatgagatata

SEQ ID NO: 699502 - DNA, 187 bp, Homo sapiens
tgtgcggatctggtggcgcggcacccatcccctccacattcccacagcccaggcatccatttgtcaacaaatcctcaccaaccgcaccatcaaaaaaccagtgggtttttttttttttttttttttttttttttttttttttttttttttttttttttttttttttttttttttttttttttttttt

SEQ ID NO: 699503 - DNA, 651 bp, Homo sapiens
tgaaacagagccttgctcctgtcacccaggctggagtgcagtggccgatctcagctcactgcaagctctgccacccctcccgggttcatgccattctcctgcctcacagcctcctgagtagctgggactacgggtgcccaccaccatgcctggctaatttttggtatttttagtagagacggggtttcaccgtgttagccaggattgtctcgatctctggaccttgtgatctgcccacctcagcctcccaaaatgctgggattaacaggcatgagccaccacaccgtggctatttgccggtatttccaagtacacacacacttacacttacacgcgtgcgtgcacgcgcacttacacacacacacgaagctatttatggtgtgtgtgtgtgcacagttcactcttgtttgcccaggcttggagttgcaactgggcgtgactcttgggttcagtgcaaacctttttgtccgccccgagttcacaaggtgacttcctccctgccattcaggcctcccagaatttattggggaaataccgggcatttgttcacaccacgccccgggaataaatgtcggggtacttatcaggtagaagatggggggttctacccaagtgttgggccacaggcgtggctctcaaacctcttgacct

SEQ ID NO: 699504 - DNA, 1192 bp, Homo sapiens
agcggaggttccggcgaaagtgaccggaagtaaccgccgggccaagatggctgcagaggaaggggtcgcgagtgctgcttcctgcctgtgcggtaggctgtgtgggcacctgcggccatgtgggcgtggttctacccgattgcttgttggttgccagtccccgccgaggcggatggggcagctctggctcccgggcgctggtttgcgcacaacatggcctggaggctcttgggggaagcccttgaccgtgcttggcagtggccatgcccttcccataaacggttgctttttcttttttgacgctctttgtgcaatgcccctgggtaacgggggagagtcgagcttgcgttgcccttgggacgtgggccccccatatcatgggacaaccatttatcattaggtggagggaggtagcatatcttccggtataactaagtgaggtaccaacccatatccttgcacaatagaaggcccaccaagatagcttggtctgttccggcatttcatatgtgggatgggaaacaacaaattatccagttgcaaatcccttgtcctatctaatttcgttacattggaaaatttttttcaagactttgtggacaacgacggcaagtgcacaacaaggcaattgggcttggaatgggcagggaccgcccatttgtgatgtgggtaaattcacggcccttggtatacagcataagtggggcgaaggcgcccacttttgggacacacagaaagggccgttccaaattttagggacgcgggaatccctgagcagtaaatacacttcaaggcataattatatcaccgtttaaagtttggcctcgcgttgatgtggaaacggaaaaagttccgccgtttgggttaccagaattttatgtagaaaccgaatagattaaacaaaccacaagccagacttttacacagcatttaagcccgtggggattgccaaactatctcacacaccgcaatcacaaagttaggttgagatataaaaattcaccacgtttcagacctaagtttaatttataaagtaaattttttctacaccccgtgggaaaactaagcgagacaccgacagttagtgcatctgggacaatatcttatatagtgaagtagtagtatacatacaccaaaaaactaagttgggatctatccaagcaccacattttatcgccccccctagtctgtg

SEQ ID NO: 699505 - DNA, 107 bp, Homo sapiens
acatttactcatatattggagaaatacctagattctatagcagtgtaatcctatttaatgtgctgtactagcaatatcatgttaactagagaaaacagttacagatg

SEQ ID NO: 699506 - DNA, 728 bp, Homo sapiens
gcgccgctgtccctggagcagcagcaggccttggacttcacatgtggagaacgtggagaaggtatgagggctctggggtgggcactccagtgacagagcagaagttctggggactgtcactgatggcagagctcaggcctgggctgggtgcccgctggtatggtgcccccagagcagccgtggacatttgctctcttgctgggcaggcagtattgcgaagtgccctaatgggctattattgtctttccttacaggcaggtcccctgtggatagatactctagggtcttgggatggtcccttcagggtgctgtgacttgagccttccgtccagacgtggctatgttccagagtccatgggaacatgcatgagcgagtgcatgtaggaaactggggaatcccatggagacctgctagtgtcagtctcctggaattatacgtgatgccaaaccatcctggacctggtttggttgagccacagggctcagaacactaatcgtggaactaagaacatggtctgggttgtgtgtgacgtcttcggagaagggtccttccttgatggtgatgtgaagccaggaccagtcctgaccagagcaggcctggaggctagtctcgcttcgttctgtgctgagtccaaggagtcctggccctgctgggagccttacagggctcctccctactcgactgcccacatagctccctgcatggcctcccaggctccccgatgaca

SEQ ID NO: 699507 - DNA, 417 bp, Homo sapiens
  misc_feature (16)..(16): n is a, c, g, or t
  misc_feature (24)..(24): n is a, c, g, or t
  misc_feature (46)..(46): n is a, c, g, or t
  misc_feature (63)..(63): n is a, c, g, or t
atggttgtatgacctnagagtgtntaccgtgtgtgtgccatgcatntgtgtgtgcatgtaccnacaaacactgaattatttgctttggggatgtgaggaaattatagattgttggttttaaaaagattatatggcagggcgcaggttgtcacgccatgtaatcctagcactttggaaaggcgaggctggtggatcacctgaggtcaggagtttgagaccagcctgaccaacaaggtgaaaccccatctctactaaaaatagaaaaactagccaggcatggtggtgggcgcctgtaatcccagctactcaggaggctgaggcaggataatcgcttgaacctgggaggtggaggttgcagtgagccgagatcgtgccactgtactccagcctgggcaacaagaatgaaactctgtctca

SEQ ID NO: 699508 - DNA, 1782 bp, Homo sapiens
tgccactcgttctacatcaatgatatactagcaatagatccatcatgcagatacatgagggacaatacgtaggtgatactcgcgtgcacaccgtcgagtactaggtccgctatgtatggcctatgaagcgccaatagttacgtaatcgcctggtcgcagtcactacggcgtacgtcatctagtaacaccgttccagaagactcgcaacagtccccttgcattgaggcactaaatcattgggatctgccgcattagacggcacgagcagctcacgatcgtctgtagacactcggacttcgactagaaagcactagacaacggcgtcgcggcccattaggcaaccctacactatagatctaccaaaatcactatccaaacccacacatcacttgcgacacataaggaactaaccagtacacaattcaaaccactaaaaaaacacttacacctcccaaaattcagactcaaaaagaacacttaaaaatacaggtgccacagacacaccacattatgcatcacatactacacttatacaccgaaacgtgagagcaccaattagacacttattcacaccaaagaaaaaaaacaagaaagctccaaaattacatgtaggaaaagatccaagaacggaagcaaaaagagccgaaccgcacgaccacacgaccgacatcaaaagttatcaagttatcacgagcacatgtccgaattccgccacgttccgctacaacgttataagtgtatacatggtaaaacccgcacaaaagttcgactacccaaagccgaagcgccattagttgctcagaaggcacgtgggtagaacggccccgaaacacgccgctgtcagaaccaacaaccacggtaaccccccaccagaatcacacagccaacagcacgacacgagcagcagtccacgcagagacagactacgcatacaacagctagaaggcccaatcggaacaaatcacagaacacacgacacatatcaaacgcaagcacccacaaagagacgaaaacagacaacaacacgagacacaacccgcgtacagtccccgaaagcaggagaacccaaccatacactcccaacggaacacaagaccaaaacaagaccaatatacgacatctcatgtcgtacaagtcacacatagaaatacactcagcacggtagaacaaaaacagtactagccgatacatcaagtacaattcagaacaagtaacgaaccagagcaaccacacgaggacaccatcacgtaacatgtatgataacaattagtcccccgtcgagaagcggcgaacgccgaacgaaaatgtcgaacatccgcccacacaaccgaaagtggagacactaaaccaatacaaacacggaaaggcagcagacgacgaccggagccaacaaaacagcacccagctaaacggccaggagtgaaccacacaacaaggagccgaatacaaagcaacgacaacagaaaacgaaagagaaacgcccacacccacacataaggacaccaacaggcaaaacaaacagagcacacagtacaagacacagcacacacgatacggcgcccaccaacgaaacgactatcgcgaacaagcagacacaaccagccacaacagcacaactccacaaccgcgcgagcagaaaacaagcgaaagatggcacaacaaacacaaaaagatgagcgagaagacacacagcacacataagagcgcacagacatgacagcagcaacgaagccgcgaacagacaccaacaaggagagcagaagaagcaaacacacagcaacg

SEQ ID NO: 699509 - DNA, 889 bp, Homo sapiens
catctggattgtgatctgttaaaattgttgcccccttcccggtcccccgcctgttatcgttctttcccgctttcctgtggtgtcccttcccaccttggagaggaggccacacaccagtttttcttggaaaatttcctaaagctttatgtctttaaagaagaaattctgttggggaacacagacatttctttaaggatgacccgaatgctccgtagttatttatggccacaacacgatgttgtctaaccaactttctctgtttgcttggtcaaaaccagcatttggggaactccaacatgctgttcatgttaaccatcaaatagtttatgaagactttgaccaccaaggtgacagacacgcaattataaatctgctaaatatgtattaagggtatttattattgaacagtccctttcccccaactcgactcctatggccattatggactccctgtttacccagaacatttaagtgcctcagcatctgtatgatatagtggacaggtgctgacataggtacccgctgacatgatgtgtcactagactctgtgggatgattgccacatacatggaacacctgggagatgctggaaatgtactcgggatcgaagatgaccaagatgtgttttcattcacagtggaggctacatcaagacaaggggaggtcccgccctcttgcaagtgtggtgagaggctctactagccaagacatgggcaccggagtaggtcccctgtagcaagcgggtgctgtagaggaaattcagtgacgtacatggctctggttctggacaccaaatctgtactggagaggaaatgactgctgaataaggcgattgtatgaatatttcaaatgcctgggaccacttaagttaagtaatgatatttccaga

SEQ ID NO: 699510 - DNA, 481 bp, Homo sapiens
cgccctgtgctttatgcgcccacaccagcaccactcagccctcacatgggtgccagtatgctcacagtcgcctgcacacagaggagcacacagtggggccgggggtgctgccgcgtcctgctctcccccagtcccagcgagcacaggagttaatgacagagtgtggggctcaaatgcccaggacacactgtagccctccacagcctctcagggcctcagtttccacatctgtaaaatggctcagtgacagctgttacacagttgtcgtgaggatgtaacaacttcacacatggagaccccgagaacagcactctcaggaggacccgtgcacgattcatctttcagactaacagacgagctgagcgacggacgagctaagtgatggatctgagaacgggagtgatcgggaagtgaacagtttcatcatctgctgctgctattcaattgtcagggttgaaataaacggaaagccagccaaaaa

SEQ ID NO: 699511 - DNA, 368 bp, Homo sapiens
taaggaaaaacacgagtggaatggaatgcaatggaatgcaatgaatggaatggaatggaatggaaaggaatggaatggaacggaatggaattcaatgtaatggaaaaaaagcgagggaatggaatggaatggaaaggactggaatgtaatggaatggattggagacaacccgattccaacgcaatggaatggaatggaatggaaaggaatggaatgaactggaatggaattgaaaggaatggaatgaactggaatggaatggaatggaatggaatttaatggaatggaatggaatggattcaacctgagtagagtggcaagaaatggaatggaaatgaatgcaatggaatggaatggaatggaacgga

SEQ ID NO: 699512 - DNA, 148 bp, Homo sapiens
ccctcccaagataaagggaaccttttcttaccacacacccccccccttatagtccgtccagggggggcctttttcggatttttctttaccaacccggcgggtttcaacccccagagaaaacaccttttgataaattccaaaccatttt

SEQ ID NO: 699513 - DNA, 481 bp, Homo sapiens
ccgggtcgcgaagacctagtctggatctgtcacccacgcttggagtgcagctggcacaactctcagctcactgctacctccacctcccagattcaagcgattctcctgcctcagacctcctgaatagctggactacaggtgcctgcaaccatcaacgcagctaatttttgtagttcaagtagaaatgggttttcaccttgttggccaggctggtctcgtactcctgacctctagtgacctgctcgccttggcctcccaaagtgctaggatttacaggtgtggagccagtgtacgctggccaagtagttattcttccacatgcttaaggagacccgttctgcagattcttggaactttctcgttgtagctccctcctctttttgtgtgctaccccacgaaactctagctgccttggcttcctcgaagtctcatctgattcgcaagattatatcaagtcaatgagactgcccagctccactat

SEQ ID NO: 699514 - DNA, 677 bp, Homo sapiens
  misc_feature (14)..(14): n is a, c, g, or t
  misc_feature (75)..(75): n is a, c, g, or t
  misc_feature (77)..(79): n is a, c, g, or t
  misc_feature (89)..(89): n is a, c, g, or t
  misc_feature (93)..(93): n is a, c, g, or t
  misc_feature (99)..(100): n is a, c, g, or t
  misc_feature (108)..(108): n is a, c, g, or t
  misc_feature (117)..(117): n is a, c, g, or t
  misc_feature (245)..(245): n is a, c, g, or t
  misc_feature (374)..(378): n is a, c, g, or t
  misc_feature (392)..(393): n is a, c, g, or t
  misc_feature (399)..(399): n is a, c, g, or t
  misc_feature (404)..(405): n is a, c, g, or t
  misc_feature (459)..(459): n is a, c, g, or t
  misc_feature (476)..(476): n is a, c, g, or t
  misc_feature (521)..(521): n is a, c, g, or t
  misc_feature (572)..(572): n is a, c, g, or t
  misc_feature (578)..(578): n is a, c, g, or t
  misc_feature (669)..(669): n is a, c, g, or t
gttgaccagggctntctcgctgtgctcctcacatacagaaggcaagccagcaggatgctccccgaaacctctttnannntgggccttcntccnagttcnnagagaatncctcatggnctagtgatctcttaaagaccccacctcttgatgccgttacattggcaacacttgaatttgaggggacacatacaagccatagcaaactgaacatttctcccatgccagaaagcaccatgttctttgtnagtaggtggtggtagaggggcactgcaggataaaggggcttctttcacttctaagatgatactgtgacagttaattttatgtgttaacttggcggggccacaggtgcctagctactgggtcatacttannnnntttttttttttttnntttaanttttnntctttttttccaattataaggtcaaacattattctaggtgtttctgttagggtnttttatatgagattganatttaaatcaatcagtgaactctgagttatgcagattgtcctccncgatgttagtgggcttgacccagttaggtgaaggtctgaagagaaaaaaanaccgtnctcttcccagaacaagagaattctccaacagaaacctttggactggaccttgcaccaacagctttcctgggtttccagcctcctgcctcanactccagc

SEQ ID NO: 699515 - DNA, 887 bp, Homo sapiens
atagagcacgctcaggctgtgttctcaggatgaccgagtgggagacaggcaggaccagttggtggcagttagactcccagtagcatctaagctctttggtgaatgtgtgagctaccgatgatgtgcaggatcgatgacgatttccctgcaggattacattgcagtgaaggatggaagtatgccaagtacctgcctcacagtgcagggcggtatgccgtcaaacgcttccgacaaagctcagtgtcccattgtgtgagcgcctcactaactccatgatgatgcacggcctgatagatacggcgaagaagctcatgattgtgcgcatcgtcatagctttgttcttcggatcatgcatacatctgctcacaggcgagaaccctctgtcagcgtgctggtgtaaacgccgattcgatcaaacgagatgggttctcccggggaggaactcctaaacgcaattgtggcagcgaccgggggactgtgagaggacaaggttagtgagtatgtgtgccccctgatgcctgtgtgaaccgaggcatcttggatgttgtggacaggcgcatcgtgaaggctgtcttccggaacattaagagcattgtgaatgactggtgatgagctcatcagtgctggcaggggctccatcggaggtccatagtggccattaagaaacgaaggacggagcttggacgcgttgtggggcaacgtgcagacggatgaatttatcctgactgtgtgcccagataagactgtgttgccttgggggcggtccctacaagtggtgggtagagtctcagagaagcaagcctcgcggagaaaaggtgaatatgcaggaggggccgggtaagaagcccggaggggacgccgtaaaaggggctaaaagtaaacggggg

SEQ ID NO: 699516 - DNA, 982 bp, Homo sapiens
  misc_feature (426)..(426): n is a, c, g, or t
  misc_feature (441)..(441): n is a, c, g, or t
cctttttgagaatcggatctagtatttgtaagctcctggaggacataatatcattcacggttatagccataatgcctggtctgcttctattatatagtaaatggtcaacaaatgtgtgtgtttgaggaggtggtggcttttaaaattgaccacactgaaaaacatgcaggttcaaacaatgcaaaagggtatacagtgtacaataaatctgccccagaagcagccggtgtcaagttttcaagattttccatgcatataaaagcttatctattacataaaaagaacatcatagtacgtgagctgtaggataccttgcttttttcacttaatgatattaagtgatattaagtttggaatgattttctatctgtgattatagatttactttatttctttcagtggcttcagtttctgttttatgatatnccattattgaagcantctcctgttgatgagtgtgctataaacaaggttgcaacatctttgttcttgggtctttgtgcgtgtttttatctgtaaaattgctaagagtggaatttctaggttaaagctttttgcgtttaaaaatgtgtagatactgcaaatcaattgccctccaaaaaggaccacaccaatttatacgcttataaacaaagcctgtgagtgtttcttacctgacaccctcagtcccactggatactttaaaactctttcatccttaccaatctaatcagtgaaaaatggaactgcaggttattggttttcccttgctcatttaaaaaatgttggtgtgaatgatttggggacccttggtctatcaaagaaattacctttttgtcgtatgtattctatgtgtattccctagtttgtcttttaactttaatttctgcttgtaaagatatttctgtacagtgttttacatttcaatgtaattaagtggatcagtttttttatttatgatttctggagctcaataaatattaagtgaatccaaaaaaaaaaa

SEQ ID NO: 699517 - DNA, 1204 bp, Homo sapiens
gtctctgtacgagcagcaggacgccggtctctgtaccgcaggatgggtgttatgttcaacagtgttcaagcacatcaaggcctcacttttcacagcagcatcacccaagatgcaacatttcagcacagcacgcacgcagcagggtcacacacactgcattcattcatgctccggcacaacgcttggtgagaaccaagcatcaaaacatcacacatcacacaccaccacccacacacatcaccaggcatgcatcagattcggttgtgcaccaacaccagcagcatcatccattttgtccagcatatgcgtatcatagccacgtcatcagcagagtgggcatcatgcatcagtctagcgccagcgtcatgccaccacgcacactgccacaacatcatggtagtagcacagagtttggaccgtagcaccaacatttcatgcatgcacagccatcatctggtcacttggcctcgcctagcgtggccgcagccaggctttatctccaatcagagctaagggccaatggggcacaacatgcaatcttcatggcaaagagccccacagatagggcaaggcgtcgccacatgggatagcatagcaaattaaccgcaatcggttgggcacacatgcccatttggcaatcgggatcacacgcccaaggattgcaacatataccaccctaggccttcataaaggggaatgcgccaggcacttatggcccacaggcacacccttacagcaaactttagggcgcacactacagcagaacggttcacagggcgctggccccccttgaacaaggggggacgactgggtcgggaattatggacgtggcttttggttccatcataccaccatacaaacaggatgacacccgcagacagcgtacttcacccaccatggggtcttcattggcagattcttcgacaacatgccaaacgggtgcactattttgtaacatgggcgcacggaacaaggattaacagcatagggggaaaaggcaaaggaagtaatattggggagcgccagcaaaattgggtttgggacacgacgtataacacaagttgggcgccgtgggagtagacaattggtgaaggggacaggactgtgaaatgactgtggatatttacaggaagagaaaaggcacggtgatcctatcatcagactatacaagttaacaggaaaacaagagtgactagagtcgcta

SEQ ID NO: 699518 - DNA, 397 bp, Homo sapiens
ctccagcccagatgctatgaccctgcagcgcctgccttttctaatgcagacctgcggctgttcttaactgactctgggaatccgctccaggtccctccctgagcctgcttgtggcaggaatgcctgagctcccattttaagtcctcctcccgcctccctggggcccggatgggtgtctgctttcattcttgcagctctgggatttgaggcaccgcgtatcactggatggtgcagtgccgctaggcacatgggcttgggtggaggaaaatcagtctggtgaagatcaggcagtaaccgtccaggtgcagtcgtcacgcctggaatccctgtgctttgggaggctgaggcaggagttcaagactagactgggcaatatagtgaaactttgtccctatta

SEQ ID NO: 699519 - DNA, 448 bp, Homo sapiens
  misc_feature (22)..(22): n is a, c, g, or t
  misc_feature (100)..(100): n is a, c, g, or t
aaagaccactctacttcctgtnggttaaatcgatgattcctaagtggtactaggcttagatacaaaagtcaatgataagaatatcttgcataaatccatngcttcttacttagataaaattcttatttaaaaatttttaatttgcttaatgccctatagcttacaaagcactttttaaatcataattttgtttaatccttagaataatgttataagataaacaaaactcatcaatcccattttacctgtgattgcacactgtgattgagctaataaatggaagaattgagataccaactcagattttgtagcttctgtttcaagtgattaacctgtagcaacaggcttttgaattatttttgtgttctatatccctgaagataaagattctgtattaaagagccaagattttatatctcacaaattaaaaacttaaaagacatgaaaa

SEQ ID NO: 699520 - DNA, 541 bp, Homo sapiens
aaatttaatggctctgagagtgggtcaataaagataggtttggctctgaggctctcatgagattgccagtcaggatgtagggtgtggccgcagtcaatctgaaggcttgaatatgcctggaagacccacctccaagatggctcactccaatggttgggaagttgatgcccgctgtgggcaggatgtctcagtagctccctgtgtagatcctccatatggcttcttgaatttccttataacccagtggcttgcttcctccagagcattcaatccaagaagagctcggcagaagcagtaattgtcttttatgacttttgtttttggaagtcatacactatcttatccctatattctaatgctcatacatgaccaaccctgacgagcttgtaaatgggtgactacacaaagtcattattattagcaggtgatcattcactggggggcatcttggatgctgactactgtatgctgtaaccagtattggtgtaatatttggtggagtaaatccaccagtattccattttttatttcaataacctct

SEQ ID NO: 699521 - DNA, 296 bp, Homo sapiens
taggatccagctccacagagatcgagacatctggcacatgtgaaactctgtctccactaaaattacaaaagaaaaaaaaaaaattagccaggtgtggtggtgggcactgtagtcccagctactcgggaggtggaggcaggagaatagtatgaacccaggaggcagagcttgcagtgagccaagatcacaccactgcactccaacctggggcacagaatgagaccctgtctctaaaaaattttttttaaataaataatttaacctcttctaataatgatttggttgcaggaaatgta

SEQ ID NO: 699522 - DNA, 457 bp, Homo sapiens
gttggccgctgactcaaaagcgtaagcctgcagttaagctacatagtaaacggaagatgatataccatttgcttaaactgtttaaaacagcagagtcgttaaaacttcaggaagggtgactgcaagggcattttacttcatgatggaaaaatatttgataaatttgaagaaatcattggcagaaaaacttgaaccagtccacaactaaagacgctattaaaaataaataccttcaaacacttgactatattacgcatggctagatcatacattccagtgtatctgaatatgaaaatatctccatctagtgtaagctagttgaacagatttagacttcaatatccaaatgtagattttacaggccaattctggcttatgcaagataacaaatatgaaagagaaaaatcaaagctacagaaacttattaaacttcatttataaatctcaaaaaaaaaaa

SEQ ID NO: 699523 - DNA, 345 bp, Homo sapiens
ggtcggtgttgtcacagtcttcactactttcttgaccgtggtctctgtgcgccaagtggtcccatcatctgagtgtctccacagagactacacacatggctccctcaggatcctcctcggtgtaggtctccacaatctgccccggttcttgcatcctgggaatggtgctatatagaaggtgcctgtgatcttggggtccgttaagtttcaaatctgaaaatttctgtctttcaaggtcagcttggcccacaaaccggcggttctcaaatgtgaagttctaaaaatcagtcctttaagaaagaaactcgccacctcttcctcctttcggtatctctcgtgctcttc

SEQ ID NO: 699524 - DNA, 391 bp, Homo sapiens
tacgagtagccagtccggtgtatgtcattaattgccgcaccgcaacggtgctctgaagtgtctgcataatgagaacttaattgacaaagagtctgcaagtcttcttctggcatttgcttgttctcttatgcggacttcatgggaccgtggtagggaccgccattgctggagcttctgttacgagaccacaggaccacgtgtggcttcctgtgaagtctgcccaatgaagcaatcctgattgatttcacgattgaggcattgaagcaggtgcacgaggatgagtctggtgaggcccagctctctttcctcactggtggtccggtggctgccgccagctcgctcgagagagataccgagaggctcagggagcttttgctgtatggccgtaaga

SEQ ID NO: 699525 - DNA, 103 bp, Homo sapiens
tggagacactgagataaagacatcggcagagataaagggggatacagttaaatgtagcaactctggagttcattttttcccacggtagcaaaattaatgcttt

SEQ ID NO: 699526 - DNA, 525 bp, Homo sapiens
gggtagaatctactccagggtatctccagagctaggataatgctccttaatgcaatcccacggcttatgaccatggcagtagaacaagtcaatatacaacactgggatgcgttaagtgtgctttcctagcagaaagcaccaggttggagtcaccagtccacatgctaatactgggaagtatttctagaagggggtgctcaatagagggcagacatgatgcaagttcttcatactagaaaggtgtcctgtgtgtgcttgcacagctggatgggggcacacaggagcaagcgcagaattgggttttctccagtcaagtctaccctgatgtgatctgtgcacggccacaatattatctggctgcctttctagaagatgctgtagcagggtaagaaatccaaagttatggtttgggccagctgacggggatacgaacctttggtctgaaaggccctatgacttggcctgattcgccattcactattaaggagggactacgtctagccaagaggctcatctagagctgct

SEQ ID NO: 699527 - DNA, 428 bp, Homo sapiens
  misc_feature (179)..(180): n is a, c, g, or t
caggaactggagacacagcacaggcagctggccccaaaaagcctgcgtgggacgggccggtggcacatgctggaggccgcccgtttccgcctgggggccagctggcggatggggccgcactttcccgtggatccgtccgccaagcagggcatgccattgggccgcatccagggcaaagnntccagttcccgtacccaccatcctccaccggcccactgcccatgcaccgcggcgggcacatattgtcccgcggcccgggtggctgcagcttaggtttctccccggaaggaaagcttgaggcgcacggttgcggtcggccggctgcggggggaccaggggccacacctgccgcggaggttacagtcggtaaagtagagcggcgacacgaacttctccacccgctccagcgtggtgcgccagtgcttcaa

SEQ ID NO: 699528 - DNA, 138 bp, Homo sapiens
tacatggatagcggatgacgtgtagtaattatctatttgcctaaatgggtttgtcaggtatccatatataacaaagaagtctgtgtacatatagtaaaagacctatcagtgttccaccatgcacttctattttttagg

SEQ ID NO: 699529 - DNA, 418 bp, Homo sapiens
gggctcggaaccagtggacttggggtgtatgtcatcagagatgaaaaaggaggcattacaagtgatatttcagaaataaaaaatacaagctactttgggtaactgaatgccaataaattagttaacctagaggaaatggataaattcctagactcatacaactcactaagattgaaccatgaagaaatccaaaacctgaacagaacaataacaaacaatgagatcaaatccataatacatctttcaacaaggaaaagcccagaacctgatggcttcactgctagattctaccaaacattcgaggaagaaataataccaatcttactcaaacttccaaaaaataggggagaaaggaatactttcaaactcattttacaaggccagtattactgtaataccaaaaacagacaagaacaca

SEQ ID NO: 699530 - DNA, 1034 bp, Homo sapiens
  misc_feature (45)..(45): n is a, c, g, or t
  misc_feature (92)..(93): n is a, c, g, or t
  misc_feature (101)..(101): n is a, c, g, or t
  misc_feature (108)..(108): n is a, c, g, or t
  misc_feature (111)..(111): n is a, c, g, or t
  misc_feature (133)..(133): n is a, c, g, or t
  misc_feature (220)..(220): n is a, c, g, or t
  misc_feature (510)..(510): n is a, c, g, or t
  misc_feature (540)..(540): n is a, c, g, or t
  misc_feature (1007)..(1007): n is a, c, g, or t
  misc_feature (1014)..(1014): n is a, c, g, or t
  misc_feature (1017)..(1017): n is a, c, g, or t
tagcaacgatccaagagagatgcatgacacgctattcaaatgctntatatatattttagacatctcactttgcgcccagccgagtcagtgtnnatctcaancagtgancanttgcctcccgggctcaagcgantctcctgcctcagcctcccaagtagctgggattacaggcacctgccaccatgcccggctaatttttgtaattttagtagagacaggnttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaatcgcaaatcttgaaattaagaaggcaaaaatgtaaaggagtcaaaactataaatcaagtatttgggaagtgaagactggaagctaatttgcattaaattcacaaaccnttatactctttctgtatatacatttttttnctttaaaaaacaactatggatcagaatagccacatttagaacactttttgttatcagtcaatatttttagatagttagaacctggccctaagcctaaaagtgggcttgattctgcagtaaatcttttacaactgccccgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaanaaatggntgntaaaggggtccggctca

SEQ ID NO: 699531 - DNA, 870 bp, Homo sapiens
  misc_feature (843)..(843): n is a, c, g, or t
  misc_feature (850)..(850): n is a, c, g, or t
  misc_feature (853)..(853): n is a, c, g, or t
cggcaacgaggataaagcgcggtatttcccaatatatttgaccttaagctcactacctcgcctcgctcaagcagaggcacccatattatcactaagatcatcccacttctatacaataactctcacaggagaagtccaacgtatgttgcccccaatctaattattgccaccccaggcggtgtgtgggaccttcagttaacaccaattttatcgtggctccaatttttttttgcatctgaactgtgaagagacccaggccgagagacgtattataatttccccatcttctaagcccaatccaaatggcgtctggaagtccaattggcaaggaacacaggtcttcatggaatctacaaattccacaccttttattgacacagaaaatgttgagaatcccaaatttgattgatttgaagaacatgtgagaggtttgactagatcatggatgccaatattaaatctgctggagtttcatgtacaagatgaaggagaggcaacatccaaaatagttaagacatgatttccttgaatgtggcttgagaaatatggacacttaatactaccttgaaaataagaatagaaataagggatgggattgtggaatggagattcagttttcatttggttcattaattctataaggccataaaacagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaanaaatggntgntaaaggggtccggctca

SEQ ID NO: 699532 - DNA, 237 bp, Homo sapiens
gggagacaggcgggagtcaccatgcccagcctaaaccaggcaagataataaataaccttggtaagggacgtggggcacttggctggaagccactctttagggtaccaagccagcaaggattccttgtgagcatctgacacaagagagaggcaaccagacaaataagccaacaaccctaccaacaggcctaagccacttggtcggaaagaaaaagaggaagaagccagaactgtgaca

SEQ ID NO: 699533 - DNA, 212 bp, Homo sapiens
tcgaccttcatcccgtagtgtgtgcggattagacgaccggtgactgtataggttggggctagcgtgtcccaggggtggatgtgtgactttgcgtgtgtgtgcagtactgtgtgtgcgtaagtagcaggtctgtggctgtgcaggtgcaatttgtgtggccccgtgttctgtgtgagagaggagagtgtgactggctgtgaggcagagggtaa

SEQ ID NO: 699534 - DNA, 484 bp, Homo sapiens
taatgatagagcaaatacagttaaactgaacaagtaggatgtcaaaatactgtcatagaatccagggccaagggtatgtgcatgtgactgtacaatgcttgccactagtctgtttgaaagtattcatattaagacattgcaggaaaatattcctactgatcacatgcaatcctgccttggtggcaaagactcttgacaaaaacatctcctttcaaggaagactacaattttaagagctacgtagtgatggagatgtgaaaaagtaggcagtactaaggtatcagatgactaatgcaaaaagacagaaagttataaagggtgaatttaaggtttctaaaaatggcttcctgatgctcctcccacttagcccaactccaaacttttactgtaactatcatttgaaattaaaacacacacacacacacacattatgtataatttttttggcttatcaagaaaaaaaaaccacattatgtataaaatc

SEQ ID NO: 699535 - DNA, 142 bp, Homo sapiens
cgcacccatacattcttccatcttatcattagtgaaaacctcaccaagtatggcaggctcttcagccagttcggtcaaggtcatgaatccatattcacaggggtgaaggggagtgttgtgggtactttcgtaatgtctcttg

SEQ ID NO: 699536 - DNA, 928 bp, Homo sapiens
  misc_feature (928)..(928): n is a, c, g, or t
ggcattacacgaaggcggtggcgatggcggtggggatagtggcttctcgcagtactccgtggacctcactgacccggtcgactgaccggctccaactacccgggattcagtattagccttcggctcacgtggttcctcgtgcacgagaggcgggttccggagtagccctcggtgaagccccagaccacagctatgagtcccttcgtgtgacgtctgcgccgaaacatgttctgcgatgtccagctcaaccggcgccgatgcaagaggaatgcagtgaacaacggtcttctggcagagagatggtagagtgcttcaacaagatttcgagagagctgactgtcgggtcggtggtgatctctgcgtgcacggacatagatgttgtcactgcaggtatagaccttgatggacatggtcttcggacatgcctgcagcccgaaaggagatgatgtggtccggatcagctggtgacctccgtgacatcatcagcttcgataccaaggagacttcacccgtcctcgagaggtgcccaagccgtgattgtggcgtcatgggggctgataggggaggtgtggaacttgtcaccgctgtgcaatcaggtactgtgccaggatgttcttccggtgcaagaggtgacgtgggttggctgcgatgtccgaaactgcgcgcctgccaggtcttcgggaacccactgtcacgagctgctcacggccgaatgatggtgaggaagctgcgcatggggggcgcggggtcccaacacagctgtgtgcgcgccacgctgggcgcatccccaacccgcggggagcaacaggaccgcggtcccggaccggcgggacacctcagggcgcacactacacacacctcggcgcgaaacgacccctccgtcggcgcgggggcgcccaaggagtgcctcacccacaaagccatccgn

SEQ ID NO: 699537 - DNA, 445 bp, Homo sapiens
  misc_feature (14)..(14): n is a, c, g, or t
ctaatatggccaangggttgttttagcctcccccaaaaagcccccttattaaccccagaaaaagacaaggtgaggcctcacattgcccccaaatgtgggacaaatattaataataccttaaactttatgttgataaaagattgggggaaaagctttcctcatatagatcaagaagaatttcaaaagattctaggagaaggcccaggcacagtggctcacacctgtaatcgcagcactttgggaggctgaagcaagagattgcttgagcccagaagtttgagaccaacctaggcaacaaagtgagaccctgtctctataaaagtaaaaactaaaaaattagctgggcatggtggtgtgccctttggtcccagctactcactcaggaggctgaagagggagaatcacttgagccaaggaggttgagacagagtaagaccccctctca

SEQ ID NO: 699538 - DNA, 762 bp, Homo sapiens
  misc_feature (41)..(41): n is a, c, g, or t
  misc_feature (128)..(128): n is a, c, g, or t
cttcagctgctgtcgttggggtgcttccagccagcctggtnttcccttcctgtggctttgggaggggaaatgagcatgggtcacctgcctgccactgtctgcctcctgcctcctctgaggcctccctntgtcctgcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccggagggaagacagggttcccatgacggccctctgcaggtaccctgcatagccatggggcagcctggattcagggagaccaagccagagccctgggagttggcgagtcggagcatccagctgggagccagtgagggtgtggcctccaggaggctgcggaacctgggaactctgcggagacctcgcttggtccttgctttcacaggaaaagcaccagaaagccctagccctgtgggaatcagccctgagggggtcggtctgagggtgacgtgcccaggggttctgtttccattagaacagaatgtctctcgtccaagagactacaccttcctaatatacgtgccgaattcgtgcag

SEQ ID NO: 699539 - DNA, 1406 bp, Homo sapiens
gcctgtactatgtctacatggtggctgcgtggcagctggttctgtaccaagtgccgagtcaagtatcctagcaggaattaacgggcctagcaggctggccaggtcacataggtcatttctgtcttccagtcatgtgtcttacaaccgtggatagcagttgcgaaggctgatcggtcgggcatgatcatggtctttgtaccctctactgtcactgcataccacgttctatattgttcacgcactattgtgagatagctctcaccgacaactggctacccaatcacgggctggtacagctgcggcagatacgcttcatgctaacactatcgcttggccatgacctcatgccgttggctgcggcactatttgaggaccacttcacgcaaagaccactgctactatatacttacatgccccaatggctgtccaaccttcctactacctcacctggcctacacgctcctggcatactcatcccgctgcgcctcgtccacccgcgactacctcatgactcaactatcaagcacaggcaacatctggacgcatgagctatctcgcaaagttccaccgaccaatgagcctcctcttccttgggcaccttctataccaacaggtggcgagagagcactccagcctggtgaccagctacaccacgagtgcagcactgcaaagatcgggtgcaccttcgcctgacgatgtacaccaacattgacccctcatcaacgttgactaccttcacagccctgggggcccaataccgtgcagcagaacacgcgtcacatattagggcacctggccgacagaggtggcagacatccagggccaagcgccggcacaccgtaccacccacatcacgcaaacaccacaccacgcaccggaacactcacacaacagaacgcacagaccacacccaggacaccaacagcgcagcacaaccccacacagcaacacaacagacaccactcgaaacaagaccgaaccaaccatcaacctgcgagtccacacaacgtgccaccatgcacacggcgcacgacacacaacaaactaacaagacccccagcagaaccaatgacgccacacacaccttcaatctccccccgcaatccacctgcgcacacccgccaaggctacatcatgacccactacacgcatcatgcactcgacctctcccacactctgctcattcacatcacaacatctaactactcaccacacctaagttacctacaacgacgacaccaccaccccgctaccacccaccactcaatcacagccactcacaccacatcgacacattatcgacccaccccacatctctaattcactcacgctgatcttaattacaatcgataaattactcatctccgaacaccagcatataaacaatcatacagcaactatccata

SEQ ID NO: 699540 - DNA, 2114 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699541 - DNA, 109 bp, Homo sapiens
  misc_feature (3)..(3): n is a, c, g, or t
  misc_feature (82)..(82): n is a, c, g, or t
  misc_feature (85)..(85): n is a, c, g, or t
canggctttgctctaaggcccctaacccggggcttggccagccctgccaaaggaggccacggaggagcaggagctcgtaccnggngtctgctgaccttcgtgctggcgc

SEQ ID NO: 699542 - DNA, 1789 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacaccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699543 - DNA, 409 bp, Homo sapiens
tttctctacggtgttacacagcccaagaggtctgatattggcactgtagcccaagaggtctgagccctggtgtgtttccagatcgatcctggatgctctcactcactcattccttcactcatccagctagctaaaaccttttagctgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagc

SEQ ID NO: 699544 - DNA, 2222 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcagaggccgccacacttccccagagaaggggacgccttgaaggctccgcccgggaccccctagggagcgttcgctcggaccccttccccagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699545 - DNA, 1884 bp, Homo sapiens
agcgttgaagcagcggcagcagcagctgcacggggagcgaccccacctcacttcccggaagaagccagagccgcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699546 - DNA, 1946 bp, Homo sapiens
  misc_feature (41)..(41): n is a, c, g, or t
  misc_feature (128)..(128): n is a, c, g, or t
cttcagctgctgtcgttggggtgcttccagccagcctggtnttcccttcctgtggctttgggaggggaaatgagcatgggtcacctgcctgccactgtctgcctcctgcctcctctgaggcctccctntgtcctgcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699547 - DNA, 1739 bp, Homo sapiens
cggcatggggttgtaaggggagcggggacttggaggcagccacctgttcttgggtccctgctctgccacaggggatcccttgtgggtggggcggcctctgcctcctccctgggtggaaagagaatttaggaatctgagtgacatgtgctttcttccccaggttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699548 - DNA, 390 bp, Homo sapiens
gagtcaagaatcctcatgggcttccagtgcctggttcaaggtgtcaggatctatacagcctggcttctctactgcctgaagggaaatgagacaagcaggactaagtggaaacccagctccaagaacagcattcaacccaggatgcagggctgacacagaagagccagggcaactcaccaaaactatgggaactcccacctgatgtgcctttaaaccaggccccctcctgcctcaacctcctcttcacccacacgtaagcaataaaaacccaggctaataagatcgcaagacagagaacatgtgggtggttatttatgtttcatacccttctccattaagttacatgttggcctaagtccttctgaaaataaatgtctgttttaaaacaaa

SEQ ID NO: 699549 - DNA, 1403 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaactaccgagacagctgatgaggctggctcagtgtgtgacggaggcccccgggagtcagcagagccgagcgtagtgcaaccttccaagtgtgaagtgacagccttgtgtgtgatgttttctgccttccccaagtttgcactttcgacattaaagtttactttttagttaaaagttttaaaaaa

SEQ ID NO: 699550 - DNA, 789 bp, Homo sapiens
acggaggtacataggaacatggtgaacccggcaaggcaacggctgcaaaggtcgatcaacaccatggtcccccaggtacacaggcgttgtcaagtcacgacactctgctgaagctcagcggagctcccaccctcttcggagcgtcctctggaaacgcggggccaacatgtctacgaggactggctcgaccctcgggggaatagtagcggtgaatttgatggcctccaaagttccgtggacgacaacgatgcccttgcctcttgggtcatcgtaggctctcttcgtggaaggaaattataacagacggagatggacaaatgtggagcatagggtgaaacccagcacgagtgacacgagccgctgagccgcatcggggcagaagcgacagcacattaactaggaggaacttcggatcatgcaggccaagctgagatgccacggtgatgcttgtcataacctcagagtggagaggcagaaaccagtgtgcagagagctgggagactgactgctgtttccagaggcgtcgttagtctcaccgcaacagtgatgttcgtagaagcacgagacgcacatgttgatatgctcctggaatatttccctccggctttggcaatttgcaactcccatctgtggacccatcgtgcacaagcccagctgacggggagcacagggacaggtcggctagggtgagagtgccgacctgcagcatgacacagagtgtctgcagctggggacacaagctgcccgggactctaacttccaggaatacgacgtaggcacacaaggagt

SEQ ID NO: 699551 - DNA, 1485 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctctgcaggggaccgtgactacaggccagctgtgagtggtcccctacagaggctgcccacccaaggtttggttggggtgaaacatgatgacaacacacacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaaaaa

SEQ ID NO: 699552 - DNA, 101 bp, Homo sapiens
aaggattcaagctttggtcagccaaagtgctgggattacaggcattgcactgcgcctggccagcaactgtgtttttacaaagctcctggtgactctgacca

SEQ ID NO: 699553 - DNA, 930 bp, Homo sapiens
  misc_feature (4)..(4): n is a, c, g, or t
gcgnaagtggcttctctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccggagggaagacagggttcccatgacggccctctgcaggtaccctgcatagccatggggcagcctggattcagggagaccaagccagagccctgggagttggcgagtcggagcatccagctgggagccagtgagggtgtggcctccaggaggctgcggaacctgggaactctgcggagacctcgcttggtccttgctttcacaggaaaagcaccagaaagccctagccctgtgggaatcagccctgagggggtcggtctgagggtgacgtgcccaggggttctgtttccattagaacagaatgtctctcgtccaagagactacaccttcctaatatacgtgccgaattcgtgcag

SEQ ID NO: 699554 - DNA, 1318 bp, Homo sapiens
cgctgtttgtatagctacgtactttaactgctgcgtccaggtcgcgtcgtgtctgtggtggtgcatttctcctcttggctcgtgtttagattttcctgcctgctcttgcgtgcctcgtgtggttgttttgcacttctcgtttgtggttgatgagtagcttcttaccttgtgttgggttcccccccccctcccgctgacgtttttgcggccccactactacgtcctctcttcttagagcccccgtttcctccctttttgtcccagcacacggcgggttgtgtgggctcccgacaacggttcgggggggtgtggggttatacacgtgtgcctctccttttagaggttcttttcttgcgaaattcgaagagtgtgtatatctttatagggatatattggcacagaatctttgtttgtatttataaccctttccaacagaacttttgtaagaaaattccaagaagtctcccaaacttcccgttcagttcacattcactgccccccacaaagcccccttgttcccgggaatttctccttcccggtcgaattggtgcacacataatgctgcgagttttcctggatctttagacactttgggagccctcctgtcgcccccagttgatgtgtgcccgcgtgttcgagacgtgctggtggacccctccgtgtctggggttcttccctctctagagaggttttctactgggactgtgtcccagcttgttgcacacactgcccggtcttccggccccctgtcacccctgcacgcgtgaagttcacttaccctgaaggaccccctcactcatgtgtcacttgccttgggctcccaacctttctggctgcctcctaaggatgtaaagcgtctcaactttcttaaacacgtgtaccacagtgtgcacaatgtccaccaacctcttttatctcgttctctcccacccttcacagtttaagcgtcacttcccaaaccaccaccccttgccaaagctttgtaactgccccacccccacagagtgattctccacggcacgctcagatctctttcctgcctttgccctgcacctgttccccggtacttcctccctttattgtagcacctcacgctccccacgcccatctgtacactccctccacgaggcacgcgatctgatgaattggtttttgaatccccgaaagggtctgcccactggagttgccacgtcactcccggtagatggcgtatgattttgctgaattttataatataaaatgaaaacccaccttaattaccactgatgcttttattgacccttgaccactggcctaaataaaaagactctgactttta

SEQ ID NO: 699555 - DNA, 184 bp, Homo sapiens
ctggaacccttgtgggagctgggagaggcatggcagagggttggatttgttttcagtggacatattagcacattctttgtgggaaatcacctgggacctttctctttatttgcttaaagtgtctaaccattaatgtaggtccagtgtctgatagtctaatgtataacaaaaatgtctggtattt

SEQ ID NO: 699556 - DNA, 861 bp, Homo sapiens
taacaagttatcatgactaagacactggtgacttgctgtcgttctattcccgctcctagggttaccaggtttaaaatacgccgtcttttgccagcttttcatatatggcccttccctgtgatacccaatccggtgcccacttttaacaccgcgcggccttatctgcccccacgcaacgctctttattacacgcacaaggccacccaaggcactaaattcggctttcgcagactgaaagggttttttttggtccgcggggctctttttaactattggccctaattgggggaaccctcccgcgtgtgccagcagggaaacccgtgggggttttcaaaatcttatgtgaagcctccccgcagtttcctcctccatatcatccgggccctccagtgaggtgtgaggtgcaccaccggtcgtctcctccaggggggactcctgtttgggcaactttttcgccccagccacccagtttttcggagggtaaccaggagcaagacacggtgtgcttctcccaagctcgggcccgaccaaccggttgttctcccagccaggtctgtctatggcactattatgggggaacaaaccatcttgtgccagacgggcgtgcccaccactgcaaggagtatttaacccgggacgccccccgagccctattgtgtgttgcccccctgcgggtgtactgtggcggcacgaaaccctccaccgagacactctgggtgggcccccaggggtctccacacctccccctgattgcccttcacctcggcggtgctcttcataccccccttgtcgggcaccacatacaccagggcccccccggttttcaaccccaaaccccccttatcccggaaaacaataaca

SEQ ID NO: 699557 - DNA, 145 bp, Homo sapiens
attaatgaatgattgattcgtgctctgaaaaatgttgtctttacgctaagttaataacacgcaacatactgctctgtatataggtggaatctgtcatcatagtgatatttcagagcttctgctcctctcaaaatcacattaagca

SEQ ID NO: 699558 - DNA, 155 bp, Homo sapiens
ccacagctccaaagcggtttattacaggcttgacgcaccgcgccggccggtcattcattcttgcaaaagcatttatagagcacctactgtgtgctcacagtaaagaaacgtgatcttatcccagtagaggtagatattctgaacaagaataattc

SEQ ID NO: 699559 - DNA, 916 bp, Homo sapiens
gccttgtccttgtgaaacaccctcggttggtaattcagtccgtactctcctctcctctcttcttgttcgaacatgtgtgcgtggactagaatgcagtacgagtcgttcctaggcacttcactacggatacacagtcgcgtgcgcttgctccgagacccccgaggaaaaggtgcttgcgtctcttcctactctctgccgactgaattcgactatcaagtttccatctggaggagagagcttgaaaattaaatatcgctatgtggacggtggaaccccgttctagctgttgcgcccatagtcccagatcttggccactagatggtaattcgtgagcacattcttgtagtgtttgtcccctctcaatacgattcttggaaaaagacgaatcaggatatactctgcaaggaggcatcgtatgcaacgtggcttgagtcgacaagcgcaacagtagaatcaagcattgtacctctttgcaaccgtgcatcgactaccaaatggatgcaacaagaggaatagcaacatttctcgattgcgatactttgagtatccgtctcctttgttttgaccctaggtatgtcctagacatgtcccagtttaccacctagaatgctggtctgtttcccagatttacgtcgttagctttgaaccaggcagttttacacttaaaacatgagtttacggttccaagattttacgactcgttcaacagacgtacgcttgtgaaccatcttggatgagagttgagtagaggacgttaactttatcggtaagctttaagcttgagtgatttcacataataaattgcatttgtgtgcgggttctcttattaaccaagattgaaagttgtctaggttctttgcttaaccaatccacacgtcatttgcattcgtcgttcctaatttcacaagtattgtcg

SEQ ID NO: 699560 - DNA, 958 bp, Homo sapiens
agcggatagccacgcgcccccgacgaccgcccgacgtgcatacccgatatcctattaggtatccaagtaccaatataggcaactactaaaggatcagctgagtttataatacttactaaaggacagaacatgacctccgccagaaaaaatattacagtatgttgtgggtaagatgctgttggtcatggggctgtagcctaacagtaagatgtagatagaggggtacttgagcagatatatcgtgtacacgaagtaaataatctgagtgattattaaagaagaacgtggagatgatatgaagatagcacgcaggcgtaatctattgaaaaaccagataatctccaatatggaaaatcagcaaatcttataccaataatgatatttgtcaggtcaccaatgctaatacggatatggctgattctgttaactgggtcgtcaaggcatatgaagtccggacttaatagaatgctgatcgttagcaaagacttgaggtatttaacagcaatcgctagaggatatgatggcagtctgaaacttgaattaacgtaagaatgcgtgacgttatggaacaagagcaatggatgaagtatgattatagaagaaggttggatgcattggtgatgagatttggatgctgtagaacgttcttattcggatgcggaagatctgacactgaattacagccggtgttcatactgatcaaaaccaaggatggagattatggatgcatgaattcggcatgtgagagactaatggatttctcgtattcgcatcattacgacattttcgtaaattaccaattttttggggacttcgggtattcttacttttcaaactttgagataacagctttaggtttatttcactttcttgaaggagagtttcattactggatactctcttttcacactttgctgatactgatggagaaatcggttctttggtctcaattttggtg

SEQ ID NO: 699561 - DNA, 786 bp, Homo sapiens
  misc_feature (247)..(247): n is a, c, g, or t
ctccgtgtcatgcattgccaagaaaacattctcttgagtcaccttctgtgcccagcatatgtcgtaggcacctagcaacctaaaataatgttggtgggagggtctctgaacgaccaagtgtcaattaagatgccttcgacttgcccagtgcctgtcaaccgtgctgcctgtcggagaggaatcatgtacgagacggtgggaacacgatctgtgtgtcgatcgagggtaacatcttgcacgtgacatncgccgaaacaatgaatggtccccttatccgactggtgtctacgacccaatcgtgcatatacatggcctcagtgaacgtggagttcgccgtacttgtgcctgaggagtgcatggattctcccagtgtactaattgcttgtcccattgcacgatgctggtattactgaaagagcgacatcctgcctagaacatgtgccgtacttccggacgcgtcatgggaccttgttccttcttgcttgatggttcttaagcgcgttcagggggaatgctatataactatatgatcaacgagttatcgtctaaatgagggagtgtgtgaaggtgctctccactctactgtacgcggtgtagggctggggtgtgaagtattggatgagtcatgttcttatggtgagcctaccccattattaagtgcctatcatctgttgacttgagattccctaggtgtgacttgagaactaaaagacgaaatgccagaccccctaagatttggagaacgccgggacccccacttagggcaacaaacaacacttagcaatc

SEQ ID NO: 699562 - DNA, 1037 bp, Homo sapiens
  misc_feature (40)..(40): n is a, c, g, or t
  misc_feature (401)..(401): n is a, c, g, or t
  misc_feature (466)..(466): n is a, c, g, or t
  misc_feature (1015)..(1015): n is a, c, g, or t
tgctgcgcctgctctagggctctggagagtgactaacaancagccctttgctttctaagaagttgatctacttccagctgcaccgggccctctagatgatcgtggagtcccgtggtagccacatggtcgagatgacgttgcagtgggacctcaatgcctggaccaagagtgccgaggccttcggtcgagattgtggcagagcgtcctggcactaagctcatcaggccctggcacccatgggcccctcgcaagagccccagggcccctggagcaagcagggctctggcagcagccggcccatggagcgtgcaggagggctatgggctttgggtctggcagatgatccctactcacagtgcggagccccatgtgtcaggtgtcgagacggtcccgctcaggtnagggcgaggtgagcggccttatgcgcaaggtgccacgagtgagccttgaacgcctggacctgganctcacagctgacagccagccacccgtctatcaaggtacttcccaggcagtaccactgaggactacaacctatatatgttattagaacgtggctgctgcctgctgcagctaccggccagccagtggactgcgcctgcaggaacccctggtgccccacccctggctggcatggccattgtcaaggaggaggagactggaggctgccattggagcccctcctactagccactagagggccctgagaccaaacctgtgcttataggctactatagcggaagggtacctggtgctagagggtccccgcctggcctacaacctaagtggcagcaccagctcagtggcttggaaggtaggtaggctacctgagtggtacctacaggccccaggtggtggcccgggaacccttggatgacagttgccaccattttgccggtgtctgccagaagccaggcgatactggtaatgtgcaaccagtgtgagttaggtaaccacctggacttgtcacctgaccggccctgcaggatgtaccaggtgaggagtggagctgcancaactcttgccatgtgcaccct

SEQ ID NO: 699563 - DNA, 196 bp, Homo sapiens
gggtcagagggcaagcgatacacagtgtactgaggatggggcgtgaaggcatcccagtgccagtgacctgagaagcagtgcacccaagtgaagggatgcttagctctgacttagaccaggatattcacacgaagaactggccaaagatggaatccaagggacctgcagcagctcttcaaggatgttctagggctcc

SEQ ID NO: 699564 - DNA, 233 bp, Homo sapiens
taccaccagaaactttctaacaaagtcccaggcttgacaatggaaatgttcacactataggaaactgcagtgcagttccttcgaatgtgccctgactcacactactacaaccctggtcatcacattcccaaggccccaggctccttgccccagcattgtcctcaggcacgtacctgtcacaatgggagcatttaaaaggcttggcccccggtgtgctttcggaaggtgcctgg

SEQ ID NO: 699565 - DNA, 608 bp, Homo sapiens
  misc_feature (34)..(34): n is a, c, g, or t
  misc_feature (294)..(294): n is a, c, g, or t
aaaaaggtaacagttactatatttaccaatttanggaaattattaaatttttgaaagatactagttttaattttggttcattttttagagacagggtctcgctgtgttgcccaagctagagtgcagcggcccgattatagctcactgcagcctctaactcccggactcaagggatcctcccgcctcatcctcctaactgggaccacaggcgcatgtcaccacatctggctgattttaaaatttttttgtggagacagtcttgctgtgttgcccaggctggttgtgaactcttgnctcaggcagtcctcatgcctcagcctcccaaagtgctgagattacaggcatgagccaccgcacccagcccaaataaagttttaagaaattacttggccaggcatagtggggcctttgtagaaaaacatagcttttctatgagaagatgatcaatattttcttttcttttcctttgaatttggaattaccattttggaactgttgtcaacaatgcataataatatatcagaatgcttcctagtatattattggagaaagaacaaacaaaagtttaaattgatataaaatgcatataatggaacaagcaaccctgc

SEQ ID NO: 699566 - DNA, 328 bp, Homo sapiens
  misc_feature (28)..(28): n is a, c, g, or t
  misc_feature (34)..(34): n is a, c, g, or t
  misc_feature (78)..(78): n is a, c, g, or t
  misc_feature (123)..(123): n is a, c, g, or t
  misc_feature (150)..(150): n is a, c, g, or t
  misc_feature (204)..(204): n is a, c, g, or t
  misc_feature (209)..(209): n is a, c, g, or t
  misc_feature (213)..(213): n is a, c, g, or t
  misc_feature (228)..(228): n is a, c, g, or t
  misc_feature (241)..(241): n is a, c, g, or t
  misc_feature (275)..(275): n is a, c, g, or t
  misc_feature (284)..(284): n is a, c, g, or t
  misc_feature (294)..(294): n is a, c, g, or t
  misc_feature (299)..(299): n is a, c, g, or t
  misc_feature (315)..(315): n is a, c, g, or t
caacagccggggtgatgttgctgaaccnggaggncatgcgccagtccccgctctacagccgcctgctggagccggcgnaagtgcagcagctggccgacaagtaccacttccgcggccacctcngggaccaggacttcttcaccatgatcngcatggagcaccccaagctcttccatgtgctggactgtaccccgaaccggcagntgtgnaccnggtggagggaccatnggtacagtgacgncttcgaggcctatttgaggtgtgagggccacgtnaagatctancacgggactngcaanactggcatcccggggnagtagggggtccc

SEQ ID NO: 699567 - DNA, 838 bp, Homo sapiens
  misc_feature (526)..(526): n is a, c, g, or t
gaagttcacacggtggcagccagcgtaatcaggtcgctgtgtcgtgcttccttctacatgccaatatgaagaggcctcacgttatcagagaggctaacgttagaacgcattgaccgtgcccttaccgacggtgcagtgacatactgccaccataataggctctcgaggaagagtctacctccgtatacatctcatgacaagtgcgtgtcctaaagatagccgtgagtttccacatatcgaaagtctatatggtagaatgatccccaagagtggttccctcacatagtagcctccctattttagtgggagcgctcatatcattaaggggaagcgcgtggagcatatagggtaaagattaagtaggtgctttcgccatgcattatttaaaatcaagtcaaggtacgtaagccttgtacaaggtgctgaggacggtgatagcatgatgaactagcaaaaagaggcacttgtgacatccgtaactcgccgtgtattattttaaggccaattcaaaaagtgtgtggaaccnttaatgggcaaacaaggggacggttggggggcctgtgtggcaaaaaagcggtgagaaatctaaagcacaacgttcgcgcgcaaaagcaggaagttcacaagaaagcgtgttactgcgcaaggagagctttaacaacgaggggtgactctgaaaggccatcccgagttgtttggtcctaagaagggttgtttgtggacttgcccagaagaattccttctgtgggtgtgcgagagttgtccctcaagtgttagacaagagcggccattgtggtccagaagctgggcacagagaacaaagctgggtagcttaatt

SEQ ID NO: 699568 - DNA, 972 bp, Homo sapiens
catcttcgctgagcgttatgaagtcatgggaagatgatcaagttccaaagtttcactatggtactcatactcaacgtgcaagttagttcttgcatggctgctatgaatagaacccgttgtagcaacttatttcctaaatttgcacaggaggcgagttgatcatgcagatcgaactttttcatcaatttccagagcttggcgaaacagtcagcgtgatacctctgatattaaggagttgatccctgaattgtattatctccctgagatgtctgtcaacttcaataattataatcttggagtgatggatgatgggacagctagtgtctgatgtcagtaacttcctccttgggccaaaacctcagaagaattggtctcacataaacagattggccctggcagagtgaattgtttcctgccagcgtttcaccaatggagttgatctcattgtgggctataaacgagcaaggaccagaagctgtcggagccctcaatgtgtctatgtacgtagagctatgaaggagctgtcaatctgaatgcaataactgatcctgtgttgagagaggctgttgaagctcaaatccgaagtttggacagactccttctcaatactcatagagcccatcctcccagagattctgcatgcaagtgtatctcctcctgagagtccattgatgttcacagacaaggccaagaaggagttatcatggtcctcagtttccctcactcacggttactcacgggtggcgcaacaccagctgctcggactcccgcgggaatcacggcacgtacaggtatttgggggaaaacagggaaacctccggcacaaggggcgaacagaccgcatcacggcgggaaaagacctacagcgacacgaggtagacggaaatagcctacaagatacaaggacccggggactacaccactcttggcgggaaaagataacaccatacgggggggacacgctgaaaaaaa

SEQ ID NO: 699569 - DNA, 353 bp, Homo sapiens
attgtgcagtgataaattcgtgaggactgtctttaccgtgtgcaacacatggatgtcagacattagaggactaccggggcatgatggacactctaccagaggataagccaggatctgcagctctccatcctccccggtagctccagctgcagggctgagactgcttcctatcccctcagctctgatctctgccactacctctcttgtgtgagaaagtggaacactcctggtatgccatgcatttcataatgggaggaggctcctgtaaggaacggtgtgcgcctcgtttacagttggtgggccctccagcatggtttctgactctgtcagcccccatgcgtgaattgccaggt

SEQ ID NO: 699570 - DNA, 398 bp, Homo sapiens
ctactactactaaattcgcggaagtacgaccacagggacaggatgccaggacattcacatatcgctaagttccgcccctcaaacacagacgagctcatgtagtaccagtatcatcagaaccagctacactcggacatcttcagcttaatatttggtgggagagccgggttggcgaggaatacgaggaaggagctcagctttagcaaggtggagctgaaggtgaagacggctagggatgacagtgattcgctgcgctcttctgcccgaggctgagtgctctctcaaagtcaaactcaaatagtttcattggcatgaccattcatgtacagtcagtgttgtcaaagacaaaacaacaagcaacaatgaagctaactgggacggaacgtcgacgcggccgg

SEQ ID NO: 699571 - DNA, 196 bp, Homo sapiens
  misc_feature (117)..(117): n is a, c, g, or t
accggtgattccagacgcgagacccaaactgacttgcttctagaagaggggcgagcccggcgcaaggtctttcacgtagctaagtcatcgttgcttccggcttcttacctgttctcnccctttgtaaaccggttacctccatgaaaacccaggctctccttccaacagtggttctcaatggaggctcacatgtgct

SEQ ID NO: 699572 - DNA, 363 bp, Homo sapiens
tggtgggagacagccttccccagttgcatatggtacactattcgctcaagctgcctaagcataacatggtaacagatgctgccgcctagcgaggaggtgcaggttcccttggagaggtaattaatcctgacggcaaagtagccggacttgtttaatgctacaggcttaaacattagaggaagctaccctaatgtgtgctgtgggtttaaactgacaaaggattccttaacagaaaaacaccaagatgttagcagtgtagatatttcagacaactgtgcttaacctagtggctgccactttgtaggtgtgctcttatttgattgttaaagaaataataacaaagatttcaaggtcctcccacca

SEQ ID NO: 699573 - DNA, 333 bp, Homo sapiens
  misc_feature (61)..(61): n is a, c, g, or t
  misc_feature (63)..(63): n is a, c, g, or t
tggtcatgcctgtaatcccagcactattgggaggcgaggcaggcggatcgctgaggtcagnanttcaagaccagcctggcatcatggtgaaaccctgtctctactaaaaatacaaaaactagccgggcatggtggtgggcaactgtaatcccagctactcgggaggctaaggcaagagaattgcttgaacccagaggcggaggttgcagtgagctgaaatcgtgccactgcactccagcctgggcaacaaaagcgaaactccgtctcaaataaaaaaataaagtctagagcagaagttctccctgtacagtgttacctacccacaatcacctg

SEQ ID NO: 699574 - DNA, 192 bp, Homo sapiens
  misc_feature (33)..(33): n is a, c, g, or t
cacgcgtccgcgctacattgtcctggccaaggnacttcgagaaagcatacaagaccgtgatcaagaaagatgaacaggaacatgaattttacaagtgacctcctccccacacttccccaggcacctgtcccaaaggctagttttctctttacccaggattggtttagtcaataaatggacgtgattggatct

SEQ ID NO: 699575 - DNA, 280 bp, Homo sapiens
agtttttgccccaggttgtgtgctggaatcggggggtggctttcctgccccccatggggagcgccaggaaaggagggtcatggaggatgttggggctttgaccccaggagtggggtggagggcggagccttttgggggccctgccttcccaaaaattccgcgtgctgggaaggcttttggggtcccctgagggttttccagggtggctggagagcccaaacgcgccagggagccccctttgtgctcctcagagttcaataaatgttgtggcccctcctca

SEQ ID NO: 699576 - DNA, 271 bp, Homo sapiens
tgaggtgaggatacaggagagagaggtccaggtcggcgatggtgcgagtggaaggagatcgaagagcggagagaatctacgtctgctatttatactaagggacctcagagtatttttcctccttcacctccctttcctttcgttttatttaatgaactcctttttcttttttttttggacagagttttggctctggtggctaagggcgggagtgcaatgggtggcaatctcgggctcattggcaacctcggggtaccggagctcggaatcc

SEQ ID NO: 699577 - DNA, 371 bp, Homo sapiens
  misc_feature (71)..(71): n is a, c, g, or t
  misc_feature (126)..(126): n is a, c, g, or t
  misc_feature (135)..(135): n is a, c, g, or t
  misc_feature (182)..(182): n is a, c, g, or t
  misc_feature (191)..(191): n is a, c, g, or t
  misc_feature (216)..(216): n is a, c, g, or t
  misc_feature (324)..(324): n is a, c, g, or t
  misc_feature (332)..(332): n is a, c, g, or t
  misc_feature (368)..(368): n is a, c, g, or t
cccccaatgaccaaattccactgatgcccccaattaaatgattgcctgtttattagaaccatgagaatccnttattagtattccaccatgtttccacttgcctctgtacctaatatagtctctccnaatggaggnagttagatagatggaataagttctagtagttgatagtacaatggggnaattatacntaacaataattcactgtatattccnaaatagctagaagagaattgtaatgattccaacacaaaaaagatgaatgttagtttggatgcatatcccaattaccccgatttgatcattacacattatatacacgtntcaaaatntcacatgtactacaaaaatgtgtataactgtaatanatg

SEQ ID NO: 699578 - DNA, 393 bp, Homo sapiens
agaaacaagggcttaatggtaaagatgacatatgactatattaagaaactgaatggccctttgctcacaaacagtaacccacacagcattgctactgtggcatgcccactgctctgcactgacctcatggagcagagaacctccttcagacacctcacgcaccccctgaggagctaatgtttcttcccaacatggaaaaattctggaaagacggcctaattctttcacaggttgtcactttctcaattttggaaaggaatatgcgcccaaccctttaatctcccgaggcaaagtgtggcgaaggagggtctttggggttccagctggttcccagcagaggtggtgaaagtcaacaacagggcactggacacacatagaaatgtgacccacagc

SEQ ID NO: 699579 - DNA, 149 bp, Homo sapiens
cctggccgagttttctccgattcggagtggactgcccctccttactcatgttctgaccctctgtgcactggatcctcggcgtagcggacggacacacctcatggactgagtgccagagccccctgtggcccattccccattcatttttc

SEQ ID NO: 699580 - DNA, 191 bp, Homo sapiens
gtatttagaggatccccgtgggacacgggggcggtagtcgccataacgtggtgtagccagctccctcgtcgcacgggcagagcccaagatgacgcgactgcagcgatgcctgcgactgggtcagctccgagcacgggccagattgccagcgtgaccctccccagacgccgggccctcttccccagcccagt

SEQ ID NO: 699581 - DNA, 174 bp, Homo sapiens
  misc_feature (10)..(10): n is a, c, g, or t
ttcacatgtnggccaggccggctcaaactcctgacctcaggtgatccgcctgcctcagcctccaatagtgctgggattacagccgtgagtcaccgcgcccggctgccttgaccatttttttttttcttttttttttttttggaaaaagattctcattttggtggcccgggtaaa

SEQ ID NO: 699582 - DNA, 278 bp, Homo sapiens
  misc_feature (22)..(22): n is a, c, g, or t
tatctgtcagataacacacaantatagttatttaaagaaacatgggaatagtagaaatgactgcagtgcagcagaaaataatggtgccactgttcgctatttgagattggagtatttctctacaattcctgatgacaatgttttaggttgtttttgtagtagaagaatgcaggcgagcgttgttcacaaaagtaaatgtacagtgatgtagaagtacaataaaatgatggccagagcagtggtcgtcccaactaataaatattagaaggacgtgcatg

SEQ ID NO: 699583 - DNA, 897 bp, Homo sapiens
acgtctatggtgggtgcccctactagtagtatatcacgctctacctaggtgaaaatcgggatcttagctgccccggtgatctgactttgcgtctcatttttataccccccttgtaactgctgggtttccgcgggacgccatcttgtatgcccgaaattatattctgcggtgtatataccgctaactaatatgtggggaaaaccaggtcaacaatctctgggacacgcgtgtccgtggcccccagggacgttttttcaaggcgccaaagcctggcgacattgctcccgcggggcacaccgggtattcccggtttcggggaaccccgattcttttcgcatggtacgaggaaacaatcacatgtctcccttatgcgggcactttcacaatgccgctctccctgcgcccaagggtatcaaaatggcatcagcggctctgccctaataccctgggtatactcctcacatcaggcgtaaattactctcccaatggcgtgtgtaaccccgcgcatgctagtcgcggcagcacacaggtgttcttaaacccgccccaccaaggatgagcgccccgctgttcaaatggaacaggaagggcagaaccacgcgctgtcctctaaaagggggcaacatgaatgaaatcactcttgcttgcatagcgggcaccgcccgtggaagtcacttccttcatcaagcctggcccccacacgtgctgtcgcaaccccgagagttccgaatcccggcgctttggagaatcctgattctttcagcacaagcgactcccccaggttgggctggagatcaagaaatcatagcgccacgccctctttcagtgccagccgttgtctcaacctttcccggccacaccattaagagcggaacaaaactctttctctacaaaaca

SEQ ID NO: 699584 - DNA, 839 bp, Homo sapiens
ctccttgatcaactcaaatgtgggtttgtgaccatgatctgtgcagtgctcaattgaagatgccaaatattagttatgctgtggaaagaacttaaagagcagctgggcgaggatattgattccatgagtgaagggaatggtttgttctcaagaggaaagctgggtgttgcttgatgtacctaccgcatcagtaacagaagatacaggagaaatggcatgattcacgacgctggcagctctctgtgggcacagatgcaagcagagactggaaggaccacgggaaggatatggacggcttcaggggacagcgggaaggcagtcgaggcttcaggggacgaagcgggacggaaacagttaagattctagaaggacaaggggtaaggcagtatgaggcccgagagggacagggatcaggaggtgggaataaaagtaacagatcccaaaaaaaggcagaagcggagtttcagtaaagcatttggtcaataattagaaatagaagatttatatagcaaaaagagaatgatgtcggaatatagaactgagcattattttctccaatgcaaagttgaaaagcacattgtgcctccttttgaccactggggccaagtccctgtctctttcagacacagacagcttcatttacattaatttcatctgctcattatcatttgatgactttaatgggtacctgcatcagttttcctttggaaggggtgtgatccctgaccttccatctaagtctatccggggattgaagataaaccggagttttgcgcaacaggggggccggggataccaagggcgaaaaggggtccgaaaaaacggggggcacccgcggc

SEQ ID NO: 699585 - DNA, 601 bp, Homo sapiens
ggtagatgattcgtggccgcgagggagctagtcgggaagggaagatgggattcccgtgttgcactagtgatcatcgatgtgtcactcggattatgtgcttgttctctcatctagcaatctaagaatgagggcccctgcgagaggtttatccgatgaagtatcttgcatgcagaattgtcacgcatcgcgcagtctcagaagggctcgtcccacaggtgtctcatgcaacaaggacggtaccaaagcaagtctcgaactatcacacattatgacgcggatgttgtggtggtggatggtgttcgactcctcattttgctgtctggcacttcatataaagacctgatgccacatgattgtggctagagcagcgcttcacgggtctgtgcatcggaccagtgtcccctaaggaagtacgttgatcatatcatctttggtacagttattcaggaaggtgaaaacaagcaatgtggctacgagaggctgacctttggagcttgcttctctgacaagactcctgctcacactgtcaccatggccttgtatctctgccaaccaagccatgaccacaggttgttggctcgctttgcttctggccagtgtg

SEQ ID NO: 699586 - DNA, 716 bp, Homo sapiens
  misc_feature (133)..(133): n is a, c, g, or t
  misc_feature (142)..(142): n is a, c, g, or t
  misc_feature (144)..(144): n is a, c, g, or t
  misc_feature (161)..(161): n is a, c, g, or t
  misc_feature (163)..(164): n is a, c, g, or t
  misc_feature (166)..(166): n is a, c, g, or t
  misc_feature (168)..(168): n is a, c, g, or t
  misc_feature (171)..(171): n is a, c, g, or t
  misc_feature (179)..(179): n is a, c, g, or t
  misc_feature (184)..(184): n is a, c, g, or t
  misc_feature (188)..(188): n is a, c, g, or t
  misc_feature (193)..(193): n is a, c, g, or t
  misc_feature (201)..(201): n is a, c, g, or t
  misc_feature (207)..(207): n is a, c, g, or t
  misc_feature (229)..(229): n is a, c, g, or t
  misc_feature (231)..(233): n is a, c, g, or t
  misc_feature (239)..(239): n is a, c, g, or t
  misc_feature (244)..(244): n is a, c, g, or t
  misc_feature (251)..(252): n is a, c, g, or t
  misc_feature (267)..(268): n is a, c, g, or t
  misc_feature (280)..(280): n is a, c, g, or t
  misc_feature (300)..(300): n is a, c, g, or t
  misc_feature (305)..(305): n is a, c, g, or t
  misc_feature (310)..(310): n is a, c, g, or t
  misc_feature (312)..(313): n is a, c, g, or t
  misc_feature (325)..(325): n is a, c, g, or t
  misc_feature (329)..(329): n is a, c, g, or t
  misc_feature (350)..(350): n is a, c, g, or t
  misc_feature (391)..(391): n is a, c, g, or t
  misc_feature (396)..(396): n is a, c, g, or t
  misc_feature (408)..(409): n is a, c, g, or t
  misc_feature (430)..(430): n is a, c, g, or t
  misc_feature (441)..(441): n is a, c, g, or t
  misc_feature (445)..(445): n is a, c, g, or t
  misc_feature (452)..(452): n is a, c, g, or t
  misc_feature (456)..(457): n is a, c, g, or t
  misc_feature (461)..(462): n is a, c, g, or t
  misc_feature (476)..(476): n is a, c, g, or t
  misc_feature (479)..(479): n is a, c, g, or t
  misc_feature (481)..(481): n is a, c, g, or t
  misc_feature (484)..(485): n is a, c, g, or t
  misc_feature (501)..(501): n is a, c, g, or t
  misc_feature (506)..(506): n is a, c, g, or t
  misc_feature (508)..(508): n is a, c, g, or t
  misc_feature (510)..(510): n is a, c, g, or t
  misc_feature (520)..(520): n is a, c, g, or t
  misc_feature (546)..(546): n is a, c, g, or t
  misc_feature (549)..(549): n is a, c, g, or t
  misc_feature (566)..(566): n is a, c, g, or t
  misc_feature (701)..(701): n is a, c, g, or t
ctggatttggactaaagaaaaaaggaaaggctagcagtcatccaaaagaatcatgagacagactttgccttgtatctacttttgggggggccttttgccctttgggatgctgtgtgcatcctccaccaccaantgcactgtnanccatgaagttgctaaantnnancnacntaaaaatnaactnaagnacccnataaatcnacccanaaacaaaaaaatataaaacctnannnaaaaanaacanaaaaaannacaagccgcaaactnnaaaaggaaaaanaaacaaaaaaacttggatgnaagantaaanannatctaaaaactngaanaaaaattgtacaaaaaaaatnaaaaataaaaaattataaaactccaacacaataaacaaacnaaacnttctaaaaaaannttaaccttaatgaacgaaatnaactaaactcnaacnaataaanaaannaaannaaaaaaaaaaaaanaancnctnnatcaaaaaaaaaaatnaaaanananaaaaactaanaaaaaatgaaataacataaacaaaantangaaaacaggaaacaacnaggaaaatctccaagagcttctattatcaaacaataaaattcaagcgctaaaaagtgaagaactggatatctttgccaattcatctttaaaaaaattagagttgtcatcgaatcaaattaaagagttttctccanggtgttttcacgcaa

SEQ ID NO: 699587 - DNA, 228 bp, Homo sapiens
  misc_feature (191)..(191): n is a, c, g, or t
tgtatttttacttttcaccatgtcggtcaggctggtctcaaactcctgacctcaggtgatctgcccacctcagcctcccaaagtgccgggattacaggcatgagccaccgtgcccagcccttaattgctgtctgaacctttttttttttttcaacctgacctgaggcatcaattcaggcacagtataactntgaccagtaagcggaagctaacccaaatgctttccag

SEQ ID NO: 699588 - DNA, 383 bp, Homo sapiens
agaagcttcatgatgaaactgacagggtgaccgggccaagccgaatccctgacatcaaggataggcaagagatgccctacatggatgctgtggagcatgagattcagcggatcatcacactcgcgccctacaacctgtcccatgaagcaacccgagacaccatcctcagaggaaaccttaaccctaagggcacagtaggcgtgccaactgtggactctgtactgtatgacagaccaagaatttcctgatccaggtttaagccagaacacttcctgaatgacaatggaaagttcaagtacagtgactatttcaagccatttgccacagggtgcgccattttgcagcaattgtcggcctctcgatgactcacaggatagcgcctt

SEQ ID NO: 699589 - DNA, 341 bp, Homo sapiens
aaaaaaagggtttttttaaaaagttttatagggtaaacaaacaaattggccccctttgattttctgggaatacaaaactcgtgatgcaaagctgaatttgggtgtccaaaacttttgacagtggggcttttttaggggggggggtttttttaaaaaaagaattttttgtgaaccatccgggattaataaagatttcctttaaggcaaaggctggccaaaatgctgctgttattttctgcctaaaacaaacagtataagggggtttgtttctaaaattcctacccccagtttctttgggccaagtttccacatccccttgcgtatgggaggggggtgaaaag

SEQ ID NO: 699590 - DNA, 427 bp, Homo sapiens
gaatgaggaggaatgaaaagaaaggaaacgtaagtaagagaaagagagaaaaggaggaacagaaaagacagggagataagaaaaagacagaatatggagaaacaaagacatgaaagataagaatatcaaggatggaaagagaggatatagagaaactgacagagacaaacagttaagaagagaggagacaggctaaggcaaataaagagaaaactaaagaaaaagagaatggaaacgagtaaaaaactcaagagagaagaggagaagggtgaaagaaggaggaagaagaaagagcgatcagaggatcaatgtctcggaatcacacacactatctctctctctatatctctctctctctctctctctctctctctctctatctctctctctctcaatctctctctcctagtgccgaattcctgcagcc

SEQ ID NO: 699591 - DNA, 588 bp, Homo sapiens
  misc_feature (40)..(40): n is a, c, g, or t
  misc_feature (131)..(131): n is a, c, g, or t
atgtatattcatctcatcatttcatctcaccatttcattncatcatctcatctcatttcatttcatcattcatctcatcatctcatcattcatctcatcatttcatatcattttatctcatctatcatttnatctcatttcatctcatctcattccatcattacatctcatttcatctcattttatgtcatcatttcatgtcataccatcacatctcatctcatcatttcatctcatcatttcatcatttcatctcatttcaactcattgcatctcagctcatttccatttcattattccatttcaccatttcattcattatgtcatttcatctcatcatatttcatctcatctcatcatttcatctcattttatctcatctcatcatttcatcatttcatctcatttcttctcatctcatcatttccatttcattttcatttcattatttcatcatttcattattttatttcatctcatttcactatttcatttcattatgtcatttcatttcatctcattacatttcatctaatttcatttcacctcatttcatctcatcatttcctttctctcatcatttcatct

SEQ ID NO: 699592 - DNA, 260 bp, Homo sapiens
  misc_feature (40)..(40): n is a, c, g, or t
  misc_feature (131)..(131): n is a, c, g, or t
atgtatattcatctcatcatttcatctcaccatttcattncatcatctcatctcatttcatttcatcattcatctcatcatctcatcattcatctcatcatttcatatcattttatctcatctatcatttnatctcatttcatctcatctcattccatcattacatctcatttcatctcattttatgtcatcatttcatgtcattttatttttacgttgttagatatggggagtagtgtgattgaggtatccgtgacggg

SEQ ID NO: 699593 - DNA, 100 bp, Homo sapiens
acagcgacgactctgtcttaaaaataataaattgtccatctgtctcctgttatacatgttgtatatatgctgctttgcagttgcattgtccacatccatt

SEQ ID NO: 699594 - DNA, 2010 bp, Homo sapiens
caagaagtggcgaagttacctttgagggtatttgagtagcggcggtgtgtcaggggctaaagaggaggacgaagaaaagcagagcaagggaacccagggcaacaggagtagttcactccgcgagaggccgtccacgagacccccgcgcgcaggcatgagccccgccccccacgcatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggcgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagcgtaccttgaacagagggaggggaggacccatggctctccccccctagcccgggagaccaggggccttcctcttcctctgcttttatttaataaaaataaaaacagaaa

SEQ ID NO: 699595 - DNA, 524 bp, Homo sapiens
cgggtgaggtacagctgagtggcaagagcctgggcagcgccccgaagccagtggaaggtaggagcgccctgttcgcgggcaatgagtggctggtgacccatacatccagtattgtctgagtcctgggagacgacacagaactccacactgcttacagcatgtgactcctatggcaaggcacagaggtctgccgtactgcatggtgctccatgctagggtggcttgccaatgaatgccaccctgttaaccttatgcctgaaaatgggctgagcttgcgccaatgtccatttatctctggatgtccctggacagcccactggttgtccatacataggatgccctggggatgaccctggcggaacatgctaccccctgggcctgacactgggccttttattcactggtcacaagtcccggctccgaggaaggttgctgtgcgactcactgcatctggcaacaagccagaaggcggtcaagtcctgcctggtgtgccaggcctccttctgcgagctgtacctcacccg

SEQ ID NO: 699596 - DNA, 231 bp, Homo sapiens
cctgtattttggtttaggagtcacgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctaact

SEQ ID NO: 699597 - DNA, 2085 bp, Homo sapiens
caagaagtggcgaagttacctttgagggtatttgagtagcggcggtgtgtcaggggctaaagaggaggacgaagaaaagcagagcaagggaacccagggcaacaggagtagttcactccgcgagaggccgtccacgagacccccgcgcgcaggcatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagagtgagtgcagcagggagggggcaggtgccaggccatggccacaccgacatagcacctggggttcatgctgaggcctgaatcccccatacaggcatgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggcgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagcgtaccttgaacagagggaggggaggacccatggctctccccccctagcccgggagaccaggggccttcctcttcctctgcttttatttaataaaaataaaaacagaaa

SEQ ID NO: 699598 - DNA, 184 bp, Homo sapiens
  misc_feature (1)..(1): n is a, c, g, or t
ntgcatggtagtcttactgttaaaaagaaactaacagcacatattgagtaattgagtgcaggtactcagtgtgtcagctgctggggcaccagcttgtaatagggctccacagcgggggcatcgctgggcctcgcctaagtgcagtcaaaatcagacgacgctggtatagtcctcttcacagatg

SEQ ID NO: 699599 - DNA, 368 bp, Homo sapiens
  misc_feature (290)..(290): n is a, c, g, or t
ctggaaaactgtctgcaaaataggctactttctgtagtcatttttcatttccaaagcactcagcaaaagctggctgttttattgtaagtactctggcaattcacctttcaattcaaatatcctgtagagaacgcttcctctgagaagccactggatgtctgtatggtgcaggaggttcatgtgctgtctgtccaggtttttgttttgggtgtttttttttttttaacatttttggcataaagtgggtctttggatacaggtaaccagttttggtaacatttattcagaancttcacgtgttttttcaagtttttggaatatcagcattctctgtggagaaaagcagtggtgctactagtgtcaacact

SEQ ID NO: 699600 - DNA, 860 bp, Homo sapiens
  misc_feature (860)..(860): n is a, c, g, or t
cagtgcgggactccggtagccgccctccggtagccgcccctcctgcccccggccgccgccctatatgttgcccgcggggctcttggggcatggagcacgctgcccagccctggccgatggcaacgggcgacgggggtggcggaggagcgcctgtggccggctcgcctacctgcagtgcgccgtggctgcgcggcttcgcgcggaatcgtcagacgaacctcagttgtacggccgccaacgcgcttgcccagcccaaggctcccgagttgcccggcgcgggcccgccttggttggtgcagggagcttgccctccgtggcccttgccggtctaccagttacgccagtgagtccggcccgggttcctccgaggcgcgccaatgtgttcctccgtggcaaggttccttcgtccacttacgggccatcgggtgctaattaacccctttttttgatgcgaggagggacagcccttttggcactgggtggcgggtcaccaggggcgaattatgttctggacctgtagcgggctattgtgcacacgcaggtttctggcgccattgtgccgtgtctgcctggattcgccttggttacaagaccccccgtttcctaaatagggtcggcttgtggtcaacggcctgttgttaaccctccatcaggtcattccgtaggaacctcagacacccggggattgcgggttccacaccgcagaggggcgtatttgacatcctactgcgccccttttgggggcaacctgggggggggctaccccgcccctgtgtcacgggggctcgtcccccctggttccttgtggcccacatgtggctcggcttgagccgccacacactcccgtggggcgcggcaan

SEQ ID NO: 699601 - DNA, 166 bp, Homo sapiens
cgttcaacgcctcctactcattccctccaaaagacctcaaggtaaagagtaaacacatgctctacaaacaacgtgtgttcagcagttaaaacaccattaaattccaacggaaagcacccttaccagctctggctgaaagctggccactgtgggcagcccagtaacc

SEQ ID NO: 699602 - DNA, 1339 bp, Homo sapiens
  misc_feature (33)..(33): n is a, c, g, or t
gccaggactgagtaatgagccacgtgcggggtntgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggcgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagcgtaccttgaacagagggaggggaggacccatggctctccccccctagcccgggagaccaggggccttcctcttcctctgcttttatttaataaaaataaaaacagaaa

SEQ ID NO: 699603 - DNA, 117 bp, Homo sapiens
gaccaagcagaacaattctttagaagtggccatacaaacaacggggctggctggcgggacatcccgattctggtttaattatcgacatggtgcaaataccctttctggttatagaag

SEQ ID NO: 699604 - DNA, 409 bp, Homo sapiens
  misc_feature (211)..(211): n is a, c, g, or t
ttcaccacatataccttctaaggtgtgtcaccagcttaagaagtataaccaaatatcatggatatcaaacttttaacatatatcacagaattcataacctgccattagattttattttgcacttttagagacctatttgtgcactggttttacagcctaagagagtatgtgagatcgcttagaagaagtgagtttccagaactttgtcatngccatactatcccgtccgttctacatttcctctatgtctaacgaataagctagtagaatctttgtcatttaaagaaggcgacgctgtagattgtaagtgtttcctctagttacaggagaagaaaagctaagcacgtttgttgggcaagtggaaaatgcaatagtgggcaaagtgctcagaacctaggcaatcaagctt

SEQ ID NO: 699605 - DNA, 1171 bp, Homo sapiens
taaatctgaaggttctggtaacctgtggtgtattttatattttcctgtgactgttttggtttggttttttctcctttttcctccccttttgaccctattcagtgtctctacccactattgcacagattaaacttcacctacaaactccttaatatgatcgtggtggagaatgtacacagtttaaacacatctaattaaattacctttaagctttcccaaaaagaacaaaaaaaaaaaaaaaaaaaaaaagaaagaaagagaaaagaacaaacaagaagaaaaaagaaagaagaacaacagagaagaagagagagagaagagagaacaggaagagaagaaggagagaaggaggagaaacaataaaaaagaaaaaaaagaagagaaaaataaaaaaaacaaaaaatacaaaaaataaaaatagaaaaaaacagataggagacaacaaaacagagtgaggaggagagggcagaacaacaaaatcacatcacacagatgaggagagaagtagacaaacacgacaaagaagcaaaagaaaaaaacaaataacaaaaataaaaaaaaaaaaaaacaaaaaaaaaaataaaaaagtaagataaaaatatatataaaaaaaaaaatcaaaacataaaaaaaaaacaaaaaaaaaaaaaaaaaaaaaaaaaaaaaaaaaaacaataaacaaccaaacatacaaaatacacataaaaatacagaaatacataaataaacatcaaaacacaaaaataacaatatatatacacacaacataaaatacaaataaaaaataaaatataaaaaaaaaaaaaaaaaaagaaaataataaaataaaaataaaaaaaacaaaaagaagcaaagacatcatagaacgctattagagaagggacagcgacgagcaaagcagaccgcaacctgacaacgcatgatacactgcgccgcagacgtcacgcacgcaccggccgcaacgcgagagccaaaactaaagaagagaaaaagtagaaaacaaagagccgaagcaaggatactcagaggaggcgcccgagacgagggagcgcgagtaagaagcaatgtcgaaaaaggaaaagagaactaggacagcgaggcgaacaatacagaagaaagaaagacgacaacaaaaaagtaaaataagtcgttagtaaaaaaaaaaccaaaa

SEQ ID NO: 699606 - DNA, 103 bp, Homo sapiens
gcgccgcgggctacgacctgtacagtgcctatgattacacaataccacctatgcagaagcatgttgtggaaacggccattcaagataggcgttcaattcatgg

SEQ ID NO: 699607 - DNA, 1324 bp, Homo sapiens
  misc_feature (352)..(352): n is a, c, g, or t
  misc_feature (1324)..(1324): n is a, c, g, or t
ggagtgcagtggaatgacctcggctcactgcaacctctgcctcccagggttcaatcgattctcctgcctcagcctcctgagtggctggtattataggcatgcaccaccacgcctggctaatttttgtatttttagtagagacagggtttcatcgtcttggccaggctggtctccaactcctgactttaagtgatctgcccgcctcagcctcccaaagtgctgggattacaggtgtgagccaccactcctggccccaaaaacccaaaaaaaaaaaaaaaaaaaaaaaaaaatttggggggggcctgggcctgggaaagggttttttaaaccaactccggtgggcgggcgcggngccccaggtggcgtccgggcgacacgtgcgcaaaagcgtgtcccaatgaagaaccgggcgtcatgactaagtgcgcgcgcgtttcctccacccaataaaaaaaacgccggggcggcgcagccggagacgttccggaaccaactccaggaaggggacgaccggagggccaataaggggtatcctaatcaacggggggttccacaaggcgaagctcgaacaatacaaatagccgcgcggccgccgcgagagcgacacaacacacagcagacgaagcgacaacgagacaacgcgagcagacagcagcgaaagcaggacaccgaggagctagcgacagcagagagcagggagcagacacgatcagacgcgacacagcgacgacgaccgacgacgaacaacaagagcaagacagaaagaggcaacaccaggggtagcacccacagagcaagtaagaaaggaacaagcaaacggacaagacgagagcagcgcacgggaccgaacagaggaaggcagacgacgaaggcgagaaagaagagaaacaaggagacgagccacgtcacacgtagctccagcggagtgtggaggcgagagagaaagcaagagcacgaggcgagaacagcacgacgacagggacgaggaacgagaagaagcgaagagagaggaccacgaagaaagacaagacagcaaagaccagaggagagcgaagagtcacagcaggcgcccaaaaacggtaacaagcagcagagaagggaaatagacgacgagcgacaagaaggaagcgagaaacaaagcaaagagcgagaagcagaaggaagaggagggcgaaacgaaaagaggaagcagaagacagacaaacacaggaaaggagaggagggcaagaagacggagaagggaagacacacgagaacagagagagaaggaaacagaaaagaacacgaaacagaagaagagcgaaaaagagaagagagaaaaagn

SEQ ID NO: 699608 - DNA, 468 bp, Homo sapiens
  misc_feature (54)..(54): n is a, c, g, or t
  misc_feature (155)..(155): n is a, c, g, or t
  misc_feature (160)..(160): n is a, c, g, or t
  misc_feature (168)..(168): n is a, c, g, or t
  misc_feature (173)..(173): n is a, c, g, or t
  misc_feature (180)..(182): n is a, c, g, or t
  misc_feature (184)..(184): n is a, c, g, or t
  misc_feature (187)..(187): n is a, c, g, or t
  misc_feature (191)..(191): n is a, c, g, or t
  misc_feature (196)..(197): n is a, c, g, or t
  misc_feature (199)..(199): n is a, c, g, or t
  misc_feature (206)..(206): n is a, c, g, or t
  misc_feature (224)..(224): n is a, c, g, or t
  misc_feature (260)..(260): n is a, c, g, or t
  misc_feature (263)..(264): n is a, c, g, or t
  misc_feature (275)..(275): n is a, c, g, or t
  misc_feature (313)..(314): n is a, c, g, or t
  misc_feature (316)..(316): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (335)..(335): n is a, c, g, or t
  misc_feature (338)..(339): n is a, c, g, or t
  misc_feature (365)..(365): n is a, c, g, or t
  misc_feature (371)..(371): n is a, c, g, or t
  misc_feature (383)..(383): n is a, c, g, or t
  misc_feature (386)..(386): n is a, c, g, or t
  misc_feature (393)..(393): n is a, c, g, or t
  misc_feature (452)..(452): n is a, c, g, or t
cgtacttctgcaggcactgccgctcatcccgggcctcacggtgcaccaccagcncggctgcaagtagaggaggtagaagtaggcgcagcaggtgtgacaccccgcaggccaaggaccaagccagacccactgatgaggtctccaagaaaataggnatggnggaccatnccccnccacccnnncnccncccntttcnncnctgtggntgtagaaatggtctcccncccagccactcaagggtcagaaggattctttcgganagnntttttatgggntttcgccccacggaagatgtagtccccaatagcattgnngnggcagntgncngcccgccntgnncaaccccaggcgctgcgggtggtggngggggnactgggcctggnggntgtaggngaagggcaccaggccatgtccccaaacgccagcatgaagccaaacccgtcatgtgtganatccatggtggtgagg

SEQ ID NO: 699609 - DNA, 1149 bp, Homo sapiens
ggcaggctagggatgggtgcggaagtatcgggctctggctctaggctgtaacctctggcactggaactgcgtcaggagtcagcgtctgagtccgggagcccgaagcctggacacctgtctctgattctcgtaggtcgggggctgcatgcgtccaagcagatggttgcagggttcgaagcgctgggagggagttcccttgcctggggtccagatctgtcaaaagttgtctgccgcgtgttctagggagcccgttgccgaccggctgggactcttccagtgcagttgagactggttgactactcattatgcctgggtttggaacctacaggtggcactggaagacagactggtgacctggacgatgcccgtggtgtgaacgcgcaggggccctaatacggctagcatggtaaggccgggtacagtcttctaccgtatctatgtagcagactttggtcggtggaggctgtggcaaagggaacaggtctgtgaggaagacacgcgagataggtcatgtagctagttgggtcgatccgaggtaccgaccgtatcaatcagacttgaatctggctccgaggtccttgtcctgtcactggcgcccagtttccatggaggttgcccctgtgcgatgtgggtaaggtctaaggtcgtaatggcatatccttgggacgatttattaacctagtgggagatgggctcctgtaccaatttcatcggaccattcaacccatgtgtattacacctccgagatgtgagtgagtgctcctttagcgaatacaagtctcgtgtgtgacatcggtaaccaatgtacctgaaatttacttcatggcattcggttttgcagtatagtacgaatcctcggccagccacttcggtcgatgagtagatggtctgggggatcgatgggcgtgtgatggggggcgtcattcatcctccaggactagaagggaatgccattaggcgtttgaagaaacgtttcgcttaatattttgaggtgacagaggtctcgcctggtacgagtgtattgctggtacactgaaaattgttttgtcagtagagggagtttttgctttcaaggaacaaaagggaacgagcaagatggttgatattatagagtaggtgatagaaatgagttgtgctgggatctgggac

SEQ ID NO: 699610 - DNA, 884 bp, Homo sapiens
ctttctgcccgttgggcttattgaaatcccaactgctgccctttctgcttctttctccgacatcccccttggcgtctccctctatactccttcccatatctgtctccccaggatgacatatgaaacaatgtttgtctgcccgagcagtcaaatggcaatgctcaaacacccaagtggcccccagcctcgggactgtgctggcagtcaggagccccatggcctgtctgtacctagaggttcgtcaaaattgccaataaaggcattgcacctactggacaactcaacatggactcttgcaaaatctccccttcgataaaaagaggaggtcatgccgggggagccaccagcccctcactgggttcggaggagagtcagggaagggccaagcacgacaaagcagaaacatcggatttggggaacgcgtgtcaatcccttgtgcccgcagggctggtgcgggagagactgttctgttccttgtgtaactgtgtagctgaaagactacctcgttcttgtcttgatgtgtcaccggggcaactgcctgggggcggggatgggggcagggtggaagcggctccccattttataccaaaggtgctacatctatgtgatgggtgaagtggggagggaatcactggtgctatagaaaattggagaatgccgccgccccatagcacaagacaaaatgttccctttattgattcaaaggtctaattttaaattcccttgaataattcttttccttaaatgaagaacaccaaatctggtggaattggggaacctgttgacaatttttaccaaacggcgacaattcaacaccatggagaagaaaaacgttatgcaagtcccagcacaaaccccagtacaacaataacaccccacctcca

SEQ ID NO: 699611 - DNA, 194 bp, Homo sapiens
cgagcggccgcccgggcaggtacggggggtcctagccagagcagtcgggcagggaaaaaaggtgcccaaattgagggggaagaagtgaaattgtccacattgtttgcagatgacgtgatcttatatatttgaaaattctaaagactccatttaaaaaaaaactgttagaactaaaaaatgaattcagtaaagtt

SEQ ID NO: 699612 - DNA, 220 bp, Homo sapiens
tacgctagaacacaaaaagtgtaactgaaagctgacctgggccacgtctgcccgattatgtgccattgggcacgcttcatctaaacatggaacaaggtacagtataaacgataagaaattgtacacctgtatagggcacttaccgtgaatggcgcttttaggactggaagttgctctggtaaagtcagcgagtgagtggtgagtgaattgtgaaggccta

SEQ ID NO: 699613 - DNA, 1154 bp, Homo sapiens
tagttgttgttattgctgataatacactcgattattttctgggctcattgtttattgtgcgtctattacggtggtgtgttatctaccatgtggggggttttatccttctctcatgtgtggtggataatctgccccttggtggctctttgtcaacttctgacagtgtgggtatctatgtccacgattttagcggagtatcttacgtggtagactttgggtgtctggtcttacatgcatagaatttgtagtgtgctggcttcctgtcgtagatgtgttccactttctggtttgatactttgttcccatttcagatgcctgtcatgtgaaactgttgaagcatgtcaatatggtgtggaaactcgcatatggtccaggttgggttagtccgctgtcagtgctagtattgccatagtggccagcatgaatggatgcagatgttgctgtctggagttagaagagtgctgctgactcccaggtgcttctcgtgctgcctcactttgctgcagaggcttcttcaaggatcaccggcttgaagactcaatccgagctagaccgcatcgatgccaagtacctggaagtcaagtgcggtgctatgatccttatgttgaggatggtatggagcttcagattttgtccgacttcttacactgttgagaaagctcggaagttcatctgtcctgattacgggaccgtttggagggagccagtcacctacaggagccacggacatggatgaactcatgacaggtcctgaatctcctatgaggtccttggggaggagctcttgacatgactggtgcaacgagtacatccagtactcatagcacggctaacaggagaacaatacggttgggccctccaggtagttcagcaacgcgtctaccgttgagtctctggacagggcacaggagtacatggcttctgcatagctgcgtgcctcctaatcttcgcgtgctagtgggaccaccatgtgcgacctgggactagccttcagtacaagggagtgtggaaatgcttacgcttgccacactgcagtcaatttaggcactctcgcgggtttctctgtatattttatgacctgggcctcttctggataatctagacaggtagatttatataatttctatagcatcgcggtgtgtcagtgtcaggcc

SEQ ID NO: 699614 - DNA, 361 bp, Homo sapiens
attcgcggccgcgtcgaccactattttgttttatttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacattccaacattgtgatttgttcctgccccaccctaactgataaatgtactttgtaatctcccccacccttaagaaggtcctttgtaattctccccacccttgagagtgtactttgtgagatccacacctgcccaccagagaacaaacccccttgactgtaatttcattaccttccttat

SEQ ID NO: 699615 - DNA, 400 bp, Homo sapiens
cttcctcagacacacaccgtgagggagatgggactcccctgagaccatcataccgcggagaggcgggacacccccagccagcctcacccacaccccctgaggcgcagaaggtaagccactgctctacttcatggccacccctcctgttcaccacgatcagcggtcccacggggacatccgctacgtctgcaatatgcctgcggacacgcggaatggacgcctggaccactggctaatgacatgacgaatgtctactggactggctcgtagtgccacagcccccttcgttaccgcatggacacataccccccttacctctcccatgcgaacccacagtccggaacgcccgctaaacgaacatgacttgccgggactacctctgacctgctcagccctcgcc

SEQ ID NO: 699616 - DNA, 1204 bp, Homo sapiens
tagatacactcatcaaagttcgaaatagacaccataatgtagtccctacgaaggcacagaggaatcatagagtataaagatgccatgtacagttgacccagtgcaccaatgaaaatcttcaatatggtcttgtgagtcgattgtacatggaacgcgtatttctacgtcgtgagtgctgatgaaccagcacatacttatattatagtgactcagagacaggaaacccaagcacgataggaagcattgatccgtaactgtgatgtggtagcagtggtccaaggtatgtactgtattggtgcacttccctgatcgacaatgtacaagtatatgattgatatatctatagattgaggtgagtctgtgaatgaatttatattcggcagaggtgttccattgattggataaatgtgtatcttcaaaggtgcttagctttagagagtcaggagtatgagaacattcggctagaatatggattgaaaaatccaaatataggtgactaaagaagccagtatgtgtatatgtcgtatctgagtctctgaaagtgcacatatgggtaagattgggatgcaggcacgtgtctgaatttttctgtcaatgaaatgttgacacatcatattgtcatgtacagtaaactgtgccttgggtggatatttttagattaggggtgaataaacgaaccctggcaaagaattatttggacgaaacctggtggcctggggagtaaacctgcgcatttccaagcgtgttataaaacagcaagttggtattatcacgaagggccttggaggaggtgtgaacagggatgacaccggggaacacggaactaagtatatagatataccacaaaagtaagattacaccaggtgcactggggcagtggtcgtaaagtagagacaaacaagttgacaacccaccgcggaaaaaaacacggcgggtgcggccgcagccacaaacaaacaggagctaggtagggacatcaaacacagaccaccagggacgcgcaagcaccgctcggcacagacagacgcggcgacccacactggcagaaacggcaccgcccagacaatacaacgacacggagggacccactccccccagaccaccgcgaggagcaccacaaacccgcccgccagccacgacgcgcacagcagaccacccagtgcacagcagcgaagccaccacaccaggcgaccagtcacaccgc

SEQ ID NO: 699617 - DNA, 526 bp, Homo sapiens
  misc_feature (196)..(196): n is a, c, g, or t
  misc_feature (339)..(340): n is a, c, g, or t
  misc_feature (345)..(346): n is a, c, g, or t
  misc_feature (366)..(366): n is a, c, g, or t
  misc_feature (368)..(368): n is a, c, g, or t
  misc_feature (393)..(393): n is a, c, g, or t
  misc_feature (440)..(440): n is a, c, g, or t
  misc_feature (462)..(462): n is a, c, g, or t
  misc_feature (464)..(464): n is a, c, g, or t
ttgccgctttgttaacgagtgcgccaatggttttaactgcctgttcacgcacaaccacaacctgattgatcatttgattggagaagtacagatcggagaggcgcttcagaagttgcagcttgattatttccagatcggtttgcgattccaatatcttggattcggcaatttcgcgtgtcgctgtggttctaccgcnggtgtaaagcggccacagaacattgacctgggaacgtatgccgctcctctcgatatcaatttcagttcttctattgataatcggaatcaggaatgaaatttctttttcataggcaattccggcaacggtcaggctgagttgcnncaggnncaggttgctcaaggcctggnantcgaactcccgtgcttgaatgtccnattgttgaatcagggtttggcgcactgtgctaagccgcttctcagcntcaacgaaactaagtgcgggcncnactgcggcaggacccacaggtacaggttcggctgcgtgcacctgcgtgcacagggcggccgc

SEQ ID NO: 699618 - DNA, 868 bp, Homo sapiens
gaagggaacacgttgaatgaatttctggctttgagaaaacattttaaggcaaaattgggagaaacctttttggtcgaacccgggttctgggagacaaactatgattactgagttactggggtggaaccttcttaattaaccataaggatggagatctccatggatcactccatttgggacccaatggcctcatatctcagccaacatgggcagccaatcctttcatgcatggctggtacagggatagggcagaccagggatccaagccattaattggcaaaacctcaccaggtctccagccttaaagcgtacaggggaagaggggaaatccacatccatattaccaggggtatttgggacacaaatataacatattgcgtaatagcacagttaaatagaaagattttgcaagggcctcaattacaattagccacccccttccatattctccatcctggcaattcctgcagcgcaaattggagcaaaccaagcatgcaccatcagatggccatggtgcaagcccccaacaatggtatccccatcatatctcatgcattcaaggcgtcaaaaaggagcaaattcagcttaagggataaccaggccaacctggaaccctggcttaattggccagcaacttagccagtattccggcctgagtctggtcaccgggaacatgctgggcctgggagcagggcttccctggttttacaaacctggcctatcctttgacataagcctcttggagacggttccctcttcctttaaacagactcttcccaaacaatgggaggcactgaccgtgaatgctggtctatccaatttcctcttgaatagatggtccactacccggggggggtaggggaggtgt

SEQ ID NO: 699619 - DNA, 1228 bp, Homo sapiens
  misc_feature (21)..(21): n is a, c, g, or t
  misc_feature (44)..(44): n is a, c, g, or t
  misc_feature (47)..(47): n is a, c, g, or t
  misc_feature (50)..(51): n is a, c, g, or t
  misc_feature (692)..(692): n is a, c, g, or t
cgcgctgccgcgccgccgcgncgccgctactgctgcgggggccncgnggnngcgcactggggcgcggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagnccctggtgattggaagtggaccatgaccggcaggttggttgcatgttggagacactgggggctcactctgcaaggagcccgaaacactgctggccgccatgcgggccagcgaggagcatgtggcagtcgctcactctcctatcgtctccaccacctggaaactcgtaatgtggcctttgagaggaacaaatgtgggatctggagctggaggtctgagagaatggcaacggttaacccgctaacaggccaagtggaccatggccccacgtggacccggttcacgccccacccgcgcaccctcggaataagaaacagcgcgagacaagagaagaccacagcggaaaaacatccacccgtaccagcgaggcagaccgactcccaacacgggaccgagagtagagcacaacaaaccaaaactccccaacactcaagacaacagagaaaagaagtgccatacacgcaacaacacgaggcagcgaaacccacccacgcaccacaaccggaagaccgccaccacgaacaccacggcgcccgta

SEQ ID NO: 699620 - DNA, 458 bp, Homo sapiens
aattaggtttgaccgtacaagtgttgatgaggatttggagcaaaggaaatgctatacactggtggtaaggggtgtagttttgttcaacaactttaaaatacaagttgacgttatattgtaaagctaaacagcacacactctataaaccaggagttctacccctactgtataccctagagaaatcctcatagagaggctgcagaaggcatatacaagagtgttcagagaggcaatgttcaaacagaaaaaaatctggaaacaacctagatatccaccagtaggaaaagacatctactacataaattgtatattcacaaaataaaaacagcattgaatatgaacgaacttctctatacgcagaatgtggatttgttctggaaacactgttgagtgaaaaaagcaatttacagaaaaattatatatggtatgacatcatttttaaacaactcaagagcaaa

SEQ ID NO: 699621 - DNA, 188 bp, Homo sapiens
tcgataaggggccaatgcaggcagatggttgagctcaggagtcaggaccagcttgggcaacctagtgagaccctggtctctacaaaaaatacgatgtcaaaaaatcaaaaaattagccatgtggaggggcaggcgcctgcggccctagctactcgggaggctgaggcaagagattggcccttatcgag

SEQ ID NO: 699622 - DNA, 316 bp, Homo sapiens
gttacaacgatgaccagcaccagtctccgtcctctccttctcctgtcagtggtaacaaacttaatgggcattgacaaagaattcacacagttaggatctgcatgatggggttgtggagggtcgcccttggaccacagctcctatagaaagcactccatgctgaagatgtgtgggtgtctttggagctcacagctgcttagggaaaagttccaaatggctatgaatccttggtggtagcctacatacagttggtgggaagtgggtgggcctggaaggggacttcagtgatgaggatcagcagagatacgacattgtg

SEQ ID NO: 699623 - DNA, 562 bp, Homo sapiens
  misc_feature (20)..(20): n is a, c, g, or t
  misc_feature (39)..(39): n is a, c, g, or t
  misc_feature (242)..(242): n is a, c, g, or t
tggccccagtcagacagagncaaagcaagagagaagcanagctgtggggcccgggcgagaaaaaggctgctgcaaaggggacgtccaacgaaagagaccacctgtccttcgagcaggagttaacacgtccccaccttggtggagaacaagaaagctcagctggtggtgattgcacaccacgtggatcccatcgagctggttgtcttcttgcctgccctgtgtcgtaaaatgggggtcccttnctgcattatcaagggaaaggcaagactgggacgtttagtccacaggaagacctgcaccactgtcgccttcacacaggtgaactcggaagaaaaaggcgctttggttaagctggtggaagctatcaggaccaattacaatgacagatacgatgagatcccccgtccctggggtggcaatgtcctgggtcctaagtttgtggctcgtatcgccaagctcgaaaaggcaaagggtaaagaacttgcccctaaactgggttaaatggaccctgttgagttttctggacataaaaaaaattgaaataaaacaaattttccttcca

SEQ ID NO: 699624 - DNA, 516 bp, Homo sapiens
gctcgccccaagtcttttgttttctggtttttttcatttgtttggtttttggtgaggtttttttttgtttgtttgtttttgagacagagtctcgctgttgttgcttgggctggagtagaatggcacaatcttggctcactgcaacctccacctccggggttacagcaattctcctgcttcagcctcccgagtagctgggattacaggcacccgccaccatgcctagctaatttttgtattttttagtagagacggggtttcaccatgttggccaggctggtctggaactcctgacctcaggtgatccacccaccttggcctcccaaagtgctgggattagagacgtgagccaccgctcctagccacaccttctttttctaaaaagaagcaaaccagatcacggagggccacgtgatgggggctttcatcccccttctgagtggcagtcggaagtgggactcgcctcttcctgtgcttggcccgtggggccgctgtgaagttcacatgcagtcccag

SEQ ID NO: 699625 - DNA, 251 bp, Homo sapiens
tagtcttacatgttatctacctaggccagtctagcatcaggctgaagggtgcaggtcagaacgtcaggcggattcttttgcttataagctagcacgtctacttacgcgtgatcttttacactagtgtgtcagaaggcatcctctgaaaccctctctgtgcccaagtacagtcccattacttctgtttcgtatctctaggaaaagtggagggtgcttatgggcctctcaaggtgattgaaagaaccaaccaa

SEQ ID NO: 699626 - DNA, 1015 bp, Homo sapiens
  misc_feature (337)..(337): n is a, c, g, or t
  misc_feature (388)..(388): n is a, c, g, or t
  misc_feature (803)..(803): n is a, c, g, or t
agcgggttctctcgcgccgccgccgccaccatgttgggtttggagctgcagcggagccgccgccgccgccgcgggtgagggaggccagagagcgggagctccgcgcccagccgccggggtccctatgggatgcggggccgtgctcgagtagcctcgtgccctctccccgcgcagccgccggcccggtcccggcgttggtcgagggccatgcggaggcgcagacgagacagagtcgaaaggcaatgccaagacatccgggaacccgcggaccgacgcgcttctaggctagcgtggcccggacgtcgacgctcgcggccgacgcgctcgggaccacggnacatgcagtcctagcaggacgcaggcccatgggagaggctaggcgccgccntggcgggcaggcatgagccctatctcggtgaggcgcgtagttcaccattggttgggatttcgcgaggtcgagagtgtctaacagttatcctgaagttctccagtgtacttctattagtacgttctaatgcgtgagcttatgcaagggtccactttatagtgattggtaccttatgatagagaatgcacatggagtaaagggcaggaaaagaaccaggtcacaataggttgctatgcgttgggagttcttttctacattgggctaatcgatgcaagcgcaaagtaagttaggccagttcgctagataggctaaagtatcgaagcggtgcttagctcgcaaggggtctgctttggtgtcccctgggttcccaacattatgggcaggccgaattcgtggatacctgtccttcattttntttaaggctcacacctccgcttttccgtcctacgtggacaccttttctaggaacggcttcccatgtttttcgacaccgctgaacggtttgttcttgacacccaagactggacgcttgggtacacccaacggatcagacggttttctcctgcgtcggacaaccgacgcggcgaactttcagcgcctgtcctctctggccccttctccaccccg

SEQ ID NO: 699627 - DNA, 113 bp, Homo sapiens
gatcgagtgcgcgccaggatctgagcccacatctggcaccaactctaccaagggcctgttgggcccacacaagcttgcctgtgcctagtcaggctggtaccgtcgacctctga

SEQ ID NO: 699628 - DNA, 181 bp, Homo sapiens
gtcgctctagcaggatccccatcaggcgaagacgtgtggctagtaagcagctctaagggcttccatttgacctttcccaccatagtagctctcactctaccagtcagggagccgaggtgggggttctgccagctgctaagtatgtctatgctaattatgcattctggcactggggaaatga

SEQ ID NO: 699629 - DNA, 199 bp, Homo sapiens
tgcctctttcaactttacacggcctcgcctgacatgatgcccatgctggaatggcccgggcgtgtggtacacctgctcaatgaccagcacatgggtgtagtcacggccgccgtcagcctcatcacctgtctctgcactaagaacccagatgacttcgagacgtgcgtctctctggctgtgtcgcgccgtcgcctactca

SEQ ID NO: 699630 - DNA, 113 bp, Homo sapiens
ctgtgtctcagtgctgtggacagctcacctagtggctgtggctccaggctcgtggatgtcctgatcctggcttttggcctgctctgtcgtgccctggctgtcgtatggctggt

SEQ ID NO: 699631 - DNA, 667 bp, Homo sapiens
  misc_feature (174)..(174): n is a, c, g, or t
ggctgataggagcgctgctgtctcgtctctccgacatggtgtgtgctcgcccactgatatcggtgtactccgcaaataagggggattcatctgggcaaaaatgtgattttgcctggctgtattcatggctcctattcgagcagatattgtgacctgtgtgtgtgcactcgcagngttgcagcaaaaaccaacaggacaaggcgctgattgctggtgcagtgtgcaatatagtgagcgtcatgcaggactgagtggcgtgagtcttggtggtactgggcagacgctgtaggctcgaattcccaagatgtgtcgaggtcggtggagactcagcgctctggcacagaggtgcttttggcaacgatggtcgtctgtggatggccgacatgtatgtcacgcaagccaggaactctggacgaccgattaggtcgatcgatagatgtgaatcacaagactcataaacggatacgcctagtctgttctgccctggttgactcagtcctagcaggactggtcatgtctaacaggtcatcgtatcgaggaagtccctgaacttcctttggtagttgaatgataaagttgaaggctacatagaagaccgaggaagctgttatagctccttaatgaaacttaacgcctggaatgatagtcaagaaggtctatgcctcta

SEQ ID NO: 699632 - DNA, 191 bp, Homo sapiens
gatgaaagatcttggtgggcacaaaaggaatccctcatctggtgactcatgatgcccgcaccatccggtaccccggatcgcctcatcaagggtgaatgataccattcagattgactttggagacctgggcaagaccacctgactttcgatcaacgttcgaccactgggtaaccctggggtactgggggtac

SEQ ID NO: 699633 - DNA, 198 bp, Homo sapiens
cgtaggcgaaatttgaagcgacatgtgaatggtagacatggtcacagtcatggacatggccacgctcacagtcatccccgtgttcattcatgtacatggacgacaagcgcgttctaccaagtagaagcagagctcagaggaagaagcacaggaaccaagaggggttcagaagaggcgaggagggagcacagtacccaa

SEQ ID NO: 699634 - DNA, 438 bp, Homo sapiens
  misc_feature (13)..(13): n is a, c, g, or t
  misc_feature (36)..(36): n is a, c, g, or t
  misc_feature (59)..(59): n is a, c, g, or t
  misc_feature (82)..(82): n is a, c, g, or t
ggtcccaggcccngggtgtttgggggggggccaaanaaggggcgcccccccctatattnttttttgcagccccccctccccngggagggggccaaagccattctcccccccgtgcctcttcccaccagggttaaaaggatttagggtgggtgggagggtttcccggccccccgccccttcccccccaaatgggggatagggggggttttattgggccaaccctgcctcccccaaccaacccagcccttgggctgtttggggcagggggttccgggctttttttttttttttttttttcgggctaaaatagtttcccaagggcccgggtattggggaggggaaaaaggtgggggccagggggaaatgcccccccctccccttgggggccgggggggggatttttttccccccccattaaaaaggaaggggttttgtcca

SEQ ID NO: 699635 - DNA, 125 bp, Homo sapiens
atgattgtggtggcttgacatggatcgaacctgcgaccatgtttcggaaaccattactctatccaactgagctacaagcgcaagttatatggaagcgggggctggattcgaaccagcgacctctg

SEQ ID NO: 699636 - DNA, 944 bp, Homo sapiens
  misc_feature (1)..(1): n is a, c, g, or t
  misc_feature (306)..(306): n is a, c, g, or t
  misc_feature (320)..(320): n is a, c, g, or t
  misc_feature (324)..(325): n is a, c, g, or t
  misc_feature (348)..(348): n is a, c, g, or t
  misc_feature (402)..(404): n is a, c, g, or t
  misc_feature (453)..(455): n is a, c, g, or t
  misc_feature (463)..(463): n is a, c, g, or t
  misc_feature (475)..(475): n is a, c, g, or t
  misc_feature (502)..(503): n is a, c, g, or t
  misc_feature (506)..(507): n is a, c, g, or t
  misc_feature (531)..(531): n is a, c, g, or t
  misc_feature (534)..(534): n is a, c, g, or t
  misc_feature (566)..(566): n is a, c, g, or t
  misc_feature (653)..(653): n is a, c, g, or t
  misc_feature (670)..(670): n is a, c, g, or t
  misc_feature (684)..(684): n is a, c, g, or t
  misc_feature (752)..(752): n is a, c, g, or t
  misc_feature (764)..(764): n is a, c, g, or t
  misc_feature (828)..(828): n is a, c, g, or t
  misc_feature (881)..(881): n is a, c, g, or t
  misc_feature (890)..(890): n is a, c, g, or t
  misc_feature (909)..(909): n is a, c, g, or t
nccgtacggtttggggcctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatggggactcagcaagcaagcgtggcaccatcttggatctgagccggtcgagcccctgtccccaccctccatgacctgtccttttcccacaggcctctgggggcaggtggcaagncctggccgggcctncctnnctggccttagccacctggctctntctgcagcaggggcaggctgctttcttatccatttccctggaggcgggcccccnnncagcagtattggaggggctacaggcagctggagaaaggggaccagccgnnnacccaatnactcaggacctnactcactagccccgctttgggcccccnnctnngacctcagggtttgcccatggggnccncccaggcccctgccccaactgattctgcccanataatcgtgtctcctgcctccactcagctgcttctcagtcatgaatgtggccatggccccggggtccccttgctgctgtgggctccntgtccctgggcaggagngctggtgaggaggnggagccttttgaggggggccttccctcagctgtttccccacactggggggctgggccctgcctccacnttaccctccttncctgcaggcctggagcctgtagggctggactgaggttcaggtctccccccagctgtctcacccncactttgtccccactctagagcagggaggcagtgggggaggagttgtgtctcntcttctgtntccatgtggtttttgggtntttttctttttgtgtctctggattccgataaaatt

SEQ ID NO: 699637 - DNA, 448 bp, Homo sapiens
  misc_feature (61)..(61): n is a, c, g, or t
  misc_feature (154)..(154): n is a, c, g, or t
catgggagtgcagtgcatatcgatcgtaatgcgcagcaaaccgccggcagaacgttcaatntccaccaaatcaagcccaaaggcttgtaccgttgttgcaccagtgtttgtaaggtcacaaatatttgccgttttaaatttcaaaaagctcaancaaacaaaaaaaatggccggttatagccggcccatcgtgcttcttgtttggtcgagataggcgaattataagctattattgcgagcttatttacttaaaaggggcctcgtgcgcaaccgcaaagcggcactatttacaccatgcgcccctcaccacaaccagacaatcagccggccatcaggtcagattgacaaggagcaaacattcatgggttttctaaaaggcaaaaaactgttgattaccggcgtgttaatccaaccgctctatcgcttacggcattgccaaagcctgcca

SEQ ID NO: 699638 - DNA, 177 bp, Homo sapiens
catctcactagtccagggcagtggccataaaagtccaggaaaggcattaccactagtaatgccatcgtttagaacagattcggatttaacaggcgtagttataggtaagtatctcctgagaaaaatctctattgactcatgtgtctgagaggaacgttaaatcttatcatcacagtg

SEQ ID NO: 699639 - DNA, 400 bp, Homo sapiens
  misc_feature (277)..(277): n is a, c, g, or t
  misc_feature (287)..(287): n is a, c, g, or t
  misc_feature (358)..(358): n is a, c, g, or t
  misc_feature (387)..(387): n is a, c, g, or t
gggagttctctggggtgcttcaccagtgccacatcctggcctcagagatggtgcacttcatccaccagatgcagtactacatcacctttgaggttctcgagtgctcctgggatgagctgtggaacagagtgcagcaggcccaggacctggaccacattattgcagcacacgaggcgttcctgaacaccatcacctcccgctgtctcctggatagcaactccaagggtgcttttaaaccaactgaagagccgtgtttgaccaaatcattgaacttcangaatgcccanggacgttgattgtacaagagcagctctggaggagctgcaagaaggcgtctgcagttttgaaagagaaaaangaaacaggcgtgaaattgaagggccagtnggggaagtgactt

SEQ ID NO: 699640 - DNA, 198 bp, Homo sapiens
ggtctgagcttaaaatgaacatcatcaatcatggcatccacaaactaagccaccaggtctgagcttgatgcaaactattatcttggaatggataagcgatgagatcctgctgtatagcactgggaactgtatctagtcacttatgatggagcatgataatatgagaaaaaacaatgtatacataaacatcaaaactgg

SEQ ID NO: 699641 - DNA, 475 bp, Homo sapiens
  misc_feature (352)..(352): n is a, c, g, or t
aaaatacaaaaactagccaggcgtggtggcaggtgcctatagtcccagctactcaggaggctgaggtaggagaatcatttgaagctttggtgcactatgactcaacttgtgaatggccactgtgctccagcctgggcatcatagcgagactatctgttgagaaacaaatgtcttgtgaatgaatatattattgttttgttatgtttagttgtacaagaatttgcttttcttgccttttcgaacttctcatggttgtacgtagatctagttctttgcttctattgttgtgtgctgttttcaaatatacacacacacgtgtacacagcaaattgtatttgtccttttccttaantcatctgcatttggttgccattattttgctactaaaatagtaccttgctggactttagaacatatattccccacgcacatgtgccagaatttttctgggatgtcttggccttgccatatgcaa

SEQ ID NO: 699642 - DNA, 938 bp, Homo sapiens
gcggctggcggcggcggcggcgtgctcggtgtggctgcgctggtgatgtgctgtgcggtgagatgtgctcgcactgcctccatgccctggtcccctgtgccccccgtggaggtagagccgatgcagccccgtgctctgtgtgctacctgcggaaataacatgcctcatgtcctggtgtgccaccatgcactgctgccacttcttccatgccccatgccaaatggctgtggcttgtcagtggcttgggcccttgtatgttgcttggactctccctgtggccacgaatacgtggacatgggcatgggacagtggacaggcccatggtcacgacgtggtggtcatgcacgagtgtaccactgaagcctaccctttttggcgcacattggatttgcgtccggaatttggttttggcgttatttaacaattctgtgacaagcgccatacgactacgctaaatcgtgcttttaactcagcagagtgttttaactctaccctctgtcgtctttaaccagtgctgtctctggactgagcaagagggaggagggagcctgctcaccccactccatgggccttccccagcggtcaccaactgacctggggcgctgctccccacatgtccaaataagctgagaagtgcagctcgctgcaggcccagagcgagcttcccctcctccctgctctcccaggcccctgccacagcctctttccgttcctctcttctgatccaggcccctcagtccaagcttggaacaccttcacctcatcttaaaccgactcaaatatatcattttttaccagtaccagcttctctccattctctaggtggctcaatcattggcatcctgccccagcttggtggactgaggaatcaaagccacacttaggcccttctaacccaggagggagcccctctgcagtcctgtccctttacccacagc

SEQ ID NO: 699643 - DNA, 371 bp, Homo sapiens
  misc_feature (248)..(248): n is a, c, g, or t
gccagatactcgaagcgttttattttaaaatttttatgtctgggtgatgtgttgttgttgtttctatttgtggttttttacttgtttttgtttgttatgtttagttgtacaagaatttgcttttcttgccttttcgaacttctcatggttgtacgtagatctagttctttgcttctattgttgtgtgctgttttcaaatatacacacacacgtgtacacagcaaattgtatttgtccttttccttaantcatctgcatttggttgccattattttgctactaaaatagtaccttgctggactttagaacatatattccccacgcacatgtgccagaatttttctgggatgtcttggccttgccatatgcaa

SEQ ID NO: 699644 - DNA, 465 bp, Homo sapiens
tcccccgggctgcaggtattggcacttagatatatatatagtatatatatagagatatatcgagatatatatattttatatatagttattattttttatatgtgtttttactttttttatatttatttatatttttttatcattttttattttattttatttttttttttatttatatgttttaagttctcaattcttctctctttatcaccctctctctttttccccttcttttcattccccctcatccttcttatcatttcctcccttctctcctctatctctcccctcttctcctccccttcccatatctctcctttccttcctctcttctctattctcccctttcttccatttcactccattccattctcttttcctcttcctctttccctccatccttgccttacctctccctcttctttctcatctctctctctttcttcctcttcctctcttctttct

SEQ ID NO: 699645 - DNA, 238 bp, Homo sapiens
  misc_feature (28)..(28): n is a, c, g, or t
  misc_feature (31)..(31): n is a, c, g, or t
tgcccccctcctggtgcctgccttcttnttnggcttaccatgatgcttttgaaccccatccatgttgagatccacccatgttaacatgtgtatcaataataagtccctttttattgctgaatagtatcctagtatatagatataccacaatttgtttagctgttcacctattgatggacatttaggttgtttcaagttttgatctattatgaataaagctgctatatatataaatcac

SEQ ID NO: 699646 - DNA, 354 bp, Homo sapiens
ctccctccccagggccggtgggtggactttgaacaactcccttcagtaaaggggccagttttccctggcagtggctggtacttggctttcagcctggagtggcagctttgctaacagctgggttcactcccccttcatcctgggtgaaaacagtgctgtgctttgaaatgcagccaatgaatacccagtttgattacccagatttgggcagaccaacagtgctcgccaaagtggtttggcctgctatgggggatccagggggtgttacatgtccctttcatgttttgggggcttttagccccccaaaaccccttcagtagagccttgattaaaaggaaacctgcaggctttcca

SEQ ID NO: 699647 - DNA, 993 bp, Homo sapiens
ggtagtataaaaagaagcagtgggactgctcggaatgcctgtttgacacttcggacgaaattgaaggatcggtccttgtcctccacgcgagaggagccccctcacggcggtacccgagttcaatcaagaaactcgcaagctcaggcagttccagacgtgggatgcgtatacaaggggagcctgcctcgtgctctccgtagccttggacccacggacgtctggttggaaggctgaagaagtaaaagaaacattgcacgggtgctgtcagatgcctgcaaagacgaggctgcttatgttctccgaaggagtagacggcttccgctgaagagttacccggcagtctcccgggtgctccgaatcgactccttcaccaaagaatgcgacgagaagacggacatagtgctacgttgaaggcaccccgagatgaagacatgccgtgatccagaccaacccacgcaaagacgcagtgctgaggtatagcgaccatggctcagtcagggcaacactttccacgcagtcgggtagggtgaccgtataggaatgaaatgacccaattcaccaaagtaagagagcaaaacgggatgggcagtaactgcgttaagcaactactcgagatcgagagacgtcccacgcctggaccagtggcaacgaattgactcacagatttggccgttgtcctgtgttactggtttagggcctcttaaagaagaccaaggtacttggaaacgagaccttgtgccagggaagttcatacatgcaaagcttgaggatacctgggatattcctggcacgtacgacaaccgagccgacgtcctctcgagatttcagagaatctggtacggtacgatggtggaaccgagggtgtacacgcgtgcagaggtactacataatagtatgggagaccagaaatattcatacccacatgggggaaaaccccatcttggacttttgcagtcttagaaatgcttataaccggtgggcattcgcaggcgg

SEQ ID NO: 699648 - DNA, 338 bp, Homo sapiens
atcaaaccactgcactccagcctgggcaacagagcgaaactccatctccaaaaaaaaaaaaaaaggagggcctggtttgttgattggacgtccctctacaacctagaaagctgccctggttctggataaagaacatttatgggccggagttttggcggccctcttctttggagggtaaaatcttcaaaggccaacataaaaacaactggaagagcataaaacgggttttacacaccgtgggaaataagggcacaaggacgggtgtaaactatcccccattatgaaaagttggaatgtccaaaaggggaatttcttaaatggcaggctggcaatttttt

SEQ ID NO: 699649 - DNA, 568 bp, Homo sapiens
aggagatcatctgggaggaggcgaagcgaggtggatcatctgagcccaggagtttgagaccagcctaggcaacgtggcaagagctgtctctccaaaacctacaaaatttagccaagcttggtggtgtgagcctgtagtcccagctacttgggagactcacgcctggaagggatctctcgagcccaggaggcagaagatgaataaataaatggaagcaactgaatgggatgaggtctctcttgaaggagagagcaaaagagatttaaatagtaacaattataataaggctgggcgctgtggctcacgcctgtaatcccagaactttgggaggccaaggcaggcggatcggttgaggtcaggagttcaagaccagcatggccaacacggtgaaaccccgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttcacgatgatct

SEQ ID NO: 699650 - DNA, 447 bp, Homo sapiens
  misc_feature (18)..(18): n is a, c, g, or t
  misc_feature (59)..(59): n is a, c, g, or t
  misc_feature (125)..(125): n is a, c, g, or t
  misc_feature (210)..(210): n is a, c, g, or t
  misc_feature (432)..(432): n is a, c, g, or t
  misc_feature (436)..(436): n is a, c, g, or t
  misc_feature (439)..(439): n is a, c, g, or t
aaaactggaaaatcagtnaatagaaaatacatacccacccacccccggcctaattttanttttgtaagaagatggggtcctcgcctgcctcaggcccagtctggagctcccgggccttatgtgancctcttgccttggcatccccaaagtggtgggattataggcatgaaccactgcacccggcttaatttacgttttatagtgtgcaantcaatgttttgggtttttttttctttttaaagcatatttacagagttgtgcaaccgtcaccactatctaacttaagaatattttggccaggcatggtaggtggcacgtgcctgtggtccatgctgcttgggaggctgaggcagggggattgctcgagcccgggaggttggggctgcggtgagctatgatcacacccactgtacgtcagtctgcttgacaganaaangtncttgtttc

SEQ ID NO: 699651 - DNA, 341 bp, Homo sapiens
tccaagcacatctgtgacctacaccacaggtcacggcaatcgcagatccttaacccactgagcaaggccagggatcgaacccgcaagctcatggttcctaatcggatgtgttaaccactgtgccacaatgggaactcctacagaccttatcttaatgaatgaacaaaaaacagatggagtgagagcgtaatagtgggaaatagattaggatagtttgatgatgatgatgactgtggttataaagaggtcgagaaggagtatgccaaagaggaatcctagtggggtaagccaaggacgaggttgcaattagactaatatggggattgaacagcggaccctaa

SEQ ID NO: 699652 - DNA, 171 bp, Homo sapiens
cagtgagcaagggttcacatgcattcttttaactggtgcgcccctgttgtgcatcatttaaaacatgtggtatgtttcttattatctgtgaacacagtatgttcttgaatgatgttcatttgtcaggagaactgtgagcactgtactatgtggatacggtctgtttacatt

SEQ ID NO: 699653 - DNA, 216 bp, Homo sapiens
ggctcacaacttgcacagtgtcacattggactgaagatgtacaggaggctctgctccagatcatacaaaggcggcaggggctggtgtgctagccgttagcacggccggccagtatctgttttatctggcgggtgctgaccattcttggtgcaactccagggtctttctgggccttcagggggcggggtcataattacacacatacacatcatcatt

SEQ ID NO: 699654 - DNA, 348 bp, Homo sapiens
tacagccggtgggagaccctgggctctgcctctactccaccccaggcggcggtcctgcttgtggcttcgaggggctgctggggggcagaagacttgtccggagtctcgccagtggttgtgctccaaaactcaacgagggtccccagggtttgtggcaaaagccctgggccccagacattgactctccctgggaatttccccacaccggagaaaacagcaaaggttacgaagaagaaaatgccagagatcttggaacacgggaactggattgaagtgggctggggccatgaaatggcgagtttgaaacttgctgacgaggttgaccccctgggttgactgaaatgccgg

SEQ ID NO: 699655 - DNA, 325 bp, Homo sapiens
gctctcctagcacggtagtatgattaacagattcttgctgtatcacagtttgaattgctttatgttttgtctttattttgatagttgaaaacccgtgtttttgtttattttgtttggtttttgtttttggctatcttatgtacaaaggcatgttaggtatggcttttattattcttaattatttttactgggaaagtcttttccaagattttgaatagctaaatgtctacttttttcttaatattattttcatctcagcctagtgacgataattcaagttgtgatgaaaccagtaatcagcccagtcctgcctttatacgacgcc

SEQ ID NO: 699656 - DNA, 936 bp, Homo sapiens
ggccatttgcaagtctgagcaagctgaagtaagctgtagcctgtaatttccacacaagactggagctttgacggtgctgccctcatgctattggcaagctcacctaaccgtggaagagttgcatggctgcacaacaatcgaatcctgtgaggctggcttccctgcaatagtctctggcaggtgtcccgaaagtctgaggagaacttgatcctggaacgaagaaaccacactggatgaccctcccagtaagccatccatttacctgacggagatcgaggtcctggtatgtgcgggagaacccctatatcctggtcatgtccgaccatagcccgcagacctgtgctcgtctgtagtggttacaagcactcgacgttcttcgcttgctaggaacacagacttgctggcgtagcgggtgcctcgtcctgtctaccagtgggctgtcatgctgtcagcgtggggagtgtggcccgagaggaacccattagtggctccgcataggatgccgcactgcggcaggcgccaaggcattcagatccagagatgaccaggccaagcaggtgctgaagggcatgtcagatgttgcccaggagaacgaacaaaaagcaggaggagagcgcagatgcccgggcccccagcgggaaggtgcggcgttgggaccagggcctggagaagccccgccttgactactccgagttcttcacggaggactgtggcgccagctgcccggactgaccatctggcagatagagaacttcgtgcctgtgctggtggaggaagccttccacaggcaagttctacgaggctgactgtacattgtgctcaagaccttttctggatgacagcggtcccttcaatgggagatctactactggattggcgggaggccacatcgacaaagaaagctgtctgcaatcacgctgtcaatgcgcaatactg

SEQ ID NO: 699657 - DNA, 100 bp, Homo sapiens
taccctgagatccgagcgcacgagccgtcaatcattctcctaatgacgtctgtacgcgcgaccgcgtattactgtcaaagacgtgaaacagcatcctgtt

SEQ ID NO: 699658 - DNA, 388 bp, Homo sapiens
  misc_feature (45)..(45): n is a, c, g, or t
ggagctcagaaagtatctgagcatttcacccttctgtgccctttngccaagactatccttgagggaattttattcagtattcagggacccgctacaggatttcacactaatgagattcttggatcgatttgtataccgaaatccaaagctacacaaaggcaaagaaaatacggacagcgttgtgatgcagccaaaaaggaaacattttatagaggatgtccgtagccttgctgtgaatagtaaagagttccttgcaaaagaagaaagccagatcccagtggatgaagtgtttttctacaggtattataagaaagttgctgttgttaaagagaaacagaaacgcaacgaagatgaagatagcatagaagatgttgatgataaagaattt

SEQ ID NO: 699659 - DNA, 110 bp, Homo sapiens
aggtcccacaaaggagtgtgacacggggtccgagacactgagagtgtggaattgggacccacacacaaacagccacacgccgcgcaccgggccctcagaaacccacatac

SEQ ID NO: 699660 - DNA, 219 bp, Homo sapiens
cagtgtgtctggttcatttcagttccttagctgccaaatcggtgggcaggcactgcttcagtcactctgagttctttttgtcagtgatgatcagggtgtaaaggtatcttctgcatcgaactttaaacttcatgttgtccttattttttctgatcttgtcagattcggcatcccttttgttgtttttttgcaacccgtatagtagtagtaggcggccgc

SEQ ID NO: 699661 - DNA, 964 bp, Homo sapiens
gcattccaggtcagctggctgtggtcttagaggcaggagtgcctacccagtcctgcctcaggagcaggtgagtagctaaatacagacttaggctttttttttccccccttttaagatgctgggctcctctcccttttctttttaccaccctacctttatggttagtggttacaaagtgaccacatattatgtacttcgctgtaaataaagacagacaaaaagccaaaaaaaaaaaaaaaaaaagaaaaaaaaaaaatgtggggggggggtgggggcgagaaagaaagttttttaaaaacaatggggggggggggggggggcccagaggggataagggaaaaacggcgcaacagacagtgtccacaaaggaagaacctgatgggagagaacaatcgtcgtggggattctcccacccaaagaaaaaaaacggcgggggggagaccccaggaacgtctcttctagacacaccaccaaagtggagagctcgagggagcaacacggggaacatcacacaccggagagctaaggacggcggaagattcaaattaggcccgacgtgggaggacagagtagatataaagacaagaaaacaagagcaaaagcaagtatgtgtaacagaaacaacagaacaaggaaggagcgagagaggcagccgagagaggagcgaggcagagcgggcgagagcagagagagggaggggcagggggagagagcaacgaggcggcgaggggagcagggcgcagccagagcgcacaggagataggaggagggagagaagaagggaggaggagaggagcgagaagacgggagagaggtgagccaggtaggcgacgagacaaagagccagaagggggagcgacaagaggtcgaaagacgacacagaagagcaggcgaggcaggagcacgcgaacagggcagcagaagcgacgagagaggagcaagctaaggctggtagcacgaggag

SEQ ID NO: 699662 - DNA, 363 bp, Homo sapiens
gtgttgaagccctaacccccagtaactcagatagggccatttaaagaagcaattaagttaaaataagaccattagagttggccataattcaatctggtgtccttttaagaagaggaaatttggacataggaagggccatgtgaggacacagcaagaaggcagccatttgcaagccaaggaaaagggtgtcagaggaaaccaaacctgctgaccccttgatcctgcacttttagcctccaaaactatgaagaataaatttttgttgtttgagcccccctatttttggcattttatatggcagccctagcagactaacataccaaccagctggacatttggaaaaataaaactttttttaatcca

SEQ ID NO: 699663 - DNA, 321 bp, Homo sapiens
ctcacggatcaccgtataccagtcgtacctttaccatgccaggaaaatatattgacagagtagaaaaggcagagcgcggcatacgttgatcagtagttctttgatgtgaaaggggcagcacagtcctttaaacttgatccaatcctcttggcatcttacaaagttaaacagctaaaagaagtaaaataagaaggcaatgcttgtgagacatgtacagtgcatattaggaggaacacgcctcattacgattcgcctgcttgcttctcctgttcaatcgtttctttggaaggcagtggatttttctcttgcgtctctgtcttc

SEQ ID NO: 699664 - DNA, 681 bp, Homo sapiens
gacgggtccccgaaaaggcggcggcgatttctgtaccacaatggaggtgcatccactccaaatcgtagagggggtctcctccctcccctggggtccgcggactccaacccccgtgctctgtgccccaaatatgggctctcgacgtcaggagggggtcagttgcccacctgtcacctcgcgaggagacaggtgtgcgacaacctctaggttttggccgattgagactgagcagcccgatcgctggtccccccaaagtttctgggcccgtccacacgccccgggcgggaaggcagccccctcgggctgcgaagcacatcgcgaccaccagcacggggctcactcttgagcgacggtcccccggcgctcgactgaccgcatggtgtaaaaccgcagggacgacaccgacttggtgggggcctcagcggttgacctttgtcacatgttgtttcatgtcgccttgttgcatcacatggtgtattccctgcgttatcccctttatccgtgtataaccggtagtcgcccgcgattactgcgctgtcaatctcgacggactcagtagatctgtaatacagactcagctatagggcagctagcgtcgacctccagtgcgcagcgaccgagcccaagcgagtcaggagcgaggaccggccgcacaactcgatagcaacacgaacagaagtc

SEQ ID NO: 699665 - DNA, 157 bp, Homo sapiens
atcaacctaagataccacctgcctctcacactaagtagtactctctacttcttatgcctccatttactttcttagtttctctactccctataccgtattctctatgtttcctatccgcaacttcttttttttttttttagaaaaggtttctccttct

SEQ ID NO: 699666 - DNA, 410 bp, Homo sapiens
attggtggtatcggttcatgagtagtctttgtggggatttgtgagattttggtgcacccatcacccaagcagtgtacgctgaacccgatttgtagctttttatccctcacccctttcccaccctttccccctgagctccccaaagtccattgtatcattcttatgcctttacatcctcacagcttagctccacttatgagtgagaacatatgatgtttgcttttccattcctgagttacttcacttagaataatagtctccaatcttaaatcacttgaacctgggagacggaggttggagtgagccaagatcgtgccactgcactccagcctgggtgacagaggaagactccatctcaaaaacaaagcaaaaaaagagaatagtagtcttcaatctcatcgtggttgctg

SEQ ID NO: 699667 - DNA, 418 bp, Homo sapiens
ttataagatccccgagattggagaagtcctgggcaccaggctggcggaacgtggtttcgacaaggcctatgaagtccctggccaggttctggtgctaaagaaagacgaagacctcttccgggaatggctgaaggacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaggattgctattgtcgaactcacctccgacgtactccgggatcttttggcagttttctcccctaaccatttcaattttttttttggattctagctgttgcatgcctcccccgacctttttcc

SEQ ID NO: 699668 - DNA, 209 bp, Homo sapiens
ctaagatatgaaaggcttcttagagacaaagtcggtttctgagtaggctagtggtctatactctgtatgacatttatttgtggtgtctatctgcctctacgaataataatatcacactacatattagtagtattataccaattcatgcaagcattccctacttacttttatagcataacattgctctagaaacctcagcattaaatgat

SEQ ID NO: 699669 - DNA, 425 bp, Homo sapiens
  misc_feature (340)..(340): n is a, c, g, or t
  misc_feature (367)..(369): n is a, c, g, or t
  misc_feature (406)..(410): n is a, c, g, or t
tggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatataaagtgtttccgggagatggggttccaggngttactgtgggaaaagaagggtttggnnnagaggttattttatgacaggaaagtgaagtggtgagnnnnncaaaaaaacaaaaac

SEQ ID NO: 699670 - DNA, 148 bp, Homo sapiens
gatgaggtactggaggtaggggctttccaaaactggatactgggttgaggtggtatttagggttagggcaaagcccacttctgatggacactctaggatgacctattggtttctcagatggctggggacaagacagggactccatcac

SEQ ID NO: 699671 - DNA, 119 bp, Homo sapiens
gtgctggtaccacgtgctgggacacctctggtgctcgacacttcagtgtacatgcgtgcagcttggggttgccctggctggatcctgcagctccgccaggcacccatgatgcctgttgg

SEQ ID NO: 699672 - DNA, 1004 bp, Homo sapiens
  misc_feature (894)..(894): n is a, c, g, or t
  misc_feature (1004)..(1004): n is a, c, g, or t
taaaacccccagggggtggcgtttttggggggattggactttaaaaaaccccagaggaacccctcggtgttaaaagacacccccagtaaaaaaaaagtggtcttaagaagtctttcttcaaacaagccttggaggtctagaggctctccgtgggacagaacgagtccctttggatgctaccgagggaggaacaaatgtgttaacaagcggataacagcatataaagaggcccacttctctctctcagaggcggtgtgagtgtgggatcttgtccggctctctctttatttctcccccaaacatgtgcgggtggggcgtttttatagattgtgtgtgtggctttgtcctcttgtagtgtggagagagagttggccctttccacagtgggggaatttcccacaggtgtgtgtgagcctgtggggagacccgtttgtggagagaacaccgggtgtgttgtgtggtgggggcaaatcaccctctccgcaagaagagagaaacaacgaggggggtctctcctcaatagagaaggagaggacaaggttgttgtgtgtattgttgtgggtacttttgtgacaaaaagagcagttgttgtctccccgctgtgggcgtcacctggtgagaaaacaggagagaccccctccccgtagtgttgtgttgtattctcttgtagaaagggccgcccttcttagaacacagacaactgtggtgggtgtagtagacgtagtggagggcgccgctaatatccatctgctcatcagcggtgagtcgtcatcctgagtactatagtcaccccacctacaatgtgtcggcactgttgggagaacaacagctcctatttcttatgtagaggagtgttcgcccctccttatccgaagagggcggtggtagcggcancgacaaaaagatcctctgctgtgggaacaccacgatttgtttgtgagaagaaaaacctccctctcgcgaggggggaggcaaagccaacaagcgcatgtgaaaaagaagcn

SEQ ID NO: 699673 - DNA, 135 bp, Homo sapiens
cacgaggcccatcccaatcatataccatctctctccctcaataaacgttatccttctcctcactctctcaatcttatctatcatatcaagcagttgcggtgggttaaactactcacagttctgcacaatcttagt

SEQ ID NO: 699674 - DNA, 1012 bp, Homo sapiens
tgggtatccagtttcttagaagaaaatgtgtcacggacttggcgatctacagtcatgcaaaaccatgattattgagctacattctatcgaagctataaaaggagtaactatctgggtagtgagctcctcccattcgatctcctaagtctcccttgatattagctgaatccgagtgcatctaagggcaaggtaatggatagtaatgacaacgagttatacgctacagaaaactgtaagcctagtcaataagctagataggatacacagggggaaattctgtctgattcgcgtgttgctattgacgtcgatgggtgcttggatgacagctacttacatggatggtaagggaactgcatgtccaaaggatcatctcgagcaaaaggactaccggcagccccgtgtgtccgttcctagtcagagagggcacgtgacttttcagatttaccaatcgactgtgtgacttgacatccggtgggcccgtgtagttgcaaacccctggttccgccagggtagagttagcaggtgaactcacgagggggcgcatcattctcccgatcagaggattggttggcggatggctggctaaaggaaatctctggaagaaacctttgaaagtccgcggggaaattgcggcccatttaaatgccttaaataaattaacttttttcttaaacgggggctgaccccttggaatgcctcaattggcaagtgggcaagaattcgatacagtgcgactgcattatccatgcttgttgtgggcctgtcgcaaactgaagtgcgactatgggtttgcccaaatagacaacgcttgggccatagcacgctgaaacttttagtgcggacaacccccttggaaatgtgtcattttgcccgtgtgccacattttttacccgtgttgtgacccgcacagttgtggggcttgtaaaggtttatacccgtgaagtgtttttatccgaccttcccgggtgtggatcccatacccattttggcgcaagtatctataccggcaaat

SEQ ID NO: 699675 - DNA, 437 bp, Homo sapiens
taaaaacccctgctcctacgttgttttcccatttaaagcaaactcttcatccagggggcagtgggacctggccttcaaacaaaactccctgagtctaatgcgtgtctaggactagggcacaaaaatagagcttaaaatttggggaggataaggaggggatctactgcttcttttttccctttccccaatcctaccataccctgttgatatttttacactgcaggaaccacttctccacagggcaaaaatggaggagggggacctgtccatcatagcaacatgcgaacacaagcaaaacactgaataaagaattgtttggagattatgtgcagccctactgagcctcatttatatgggctcctagttgatccatggctcgggcttaaaatgagtaagatgatgagggtggcgtgccaagcacaaatcacttcatagaa

SEQ ID NO: 699676 - DNA, 149 bp, Homo sapiens
ttctagaggatcccggagaataaatgaaaactcagaggaaataggacaatctgctcgggagaaagaagctaaatctgcatagatttagtttggtagaatttaatttaaaatttaaattttaacaaagtgatgacactttgcatccagag

SEQ ID NO: 699677 - DNA, 855 bp, Homo sapiens
ctgggtgtgaaacaagtaatgtcggtgttaacaaaatggattccactgagaccaccctacagtcagaggagatatgaggaaattgttaacggaagtcagacacttcacattaagaaaattggctactaccccgagcacagtagcattctgtgccaaatttactggttggaatggtgacaacatgactggagccaagtgctaagcctatgccttggttcaaggggatggaacagtcacccgtaaggatggcaatgccatgtggaaccaacgctgcattgagagctctggtactgcatcctaccaccaactcgtgccaactgacaaggacccttgcgcctgcctctccaggatgtctacaaaattggtggtattggtactgttcctgttggccagattggagactggtgttctcaaaggccgcgtatggtggatcacctttgctccagatcacatcgttgacaatcgagaaatgttatagatctgtcgtagaattgtcaccatgaatgctttgagtgaagctcttcctggggaccaagtgtggtgcttcaatgtcaagaatgtgtctgtcaaggatgtccgtcgtggcaacgttgctgagtgactagcgaaaatgacccacacgaatggaacgcacgctggcttcactcgctcaggtgattatccgtgagaccatccaggccagagataaggcgccgggcttatgcccctgtattggattgccaatagcgggatcaccatttgcctgcaatttttgctcgatgttgcacggaacacgacttgatcggccggctctgggtagaacagcttggaagattgcccctaaactcctttgaacacctggtggactgctgccat

SEQ ID NO: 699678 - DNA, 401 bp, Homo sapiens
agccgcttaggataatcgcggcgaatgttgttgccatctgttgcctgacttcccgtccctcgcctccatccgggaacctccgggaccacgcccgtggccgtgaacctcagtcgcaggaccgtcggctcctaggaggctgctgtccgcgggtccccagaatgcaacctcagcatccagcgccttctgtgcagagcccccctgctgtcctcaaaactgtagtgtggcgtccaacctgggaagcccctccaggtgacctggccccccaggtgacacccctgggattgacctgctcccttgcactgtccaattgctgtgtgtggacgtctcccgagagctctgcaccccgtgttcttctgcagaacacggcctcctttggtgtcccagcatggcagtgagcaaga

SEQ ID NO: 699679 - DNA, 133 bp, Homo sapiens
cgtttccaaccgaaggaaaaagggaatcgtatcggtatgtccgcgtatccagaaaactccaactccttttcgaacccgtttgctgatgcaagttaggggtgattggacctggcttacctgtctggcactgagg

SEQ ID NO: 699680 - DNA, 217 bp, Homo sapiens
  misc_feature (61)..(61): n is a, c, g, or t
  misc_feature (63)..(63): n is a, c, g, or t
  misc_feature (144)..(144): n is a, c, g, or t
  misc_feature (195)..(196): n is a, c, g, or t
gacgagtcttctcaatgggggggcgggtgagctccaggcaccccgaaggcactttctttgnancaagtgcgattggtgccatcgagatctgtcacagagtggatgacgtgtacatacattaacttattacctcattttgttatntttcgaaacaaagccctgtggaagaaaatggaaaacttgaagaagcattanngtcattctgttaagctgcgta

SEQ ID NO: 699681 - DNA, 963 bp, Homo sapiens
tggtaaagcgctgatcctgttaaattgggaaggaaaacaaaacaatccagaagcccaggagggacaggtggatcttaatcctcctcctcgtggtttccagccccagccccacactgtggccctttcgtgggaatttcattcctcattcacgcggcccgggagacggaacacccccgatagggagaagcgcaaaagaagaagtcagatgtgctctctggaaactccaggcggacaattgaagagacgggatgtttcaccaccgtgcttgcggaccctagatataggcgctagggagagatacagacaggacaagcagtgagtgagaatggatcttgggaccaatgcaccaagtctatgaaagacctggggtcatgaaaggcgtcatactcctaaagaaaatcctactaatcatatccaaggccccagagatgtaatccaagactacactatcgtttgcccctacaattccaagggacacccacacaaagtgccagagaacaccagacacgccgccgcaaacaaaggggcgatattgaccctactgcgaaaacaaggaacgaccagagtgagggatccactttactacaataacaagaggcagtcgaacacaagcttccccagagggcaggacccttatgcggagaaattcatatgggcacagggggtataacattcattgggagccccctattaccagagaaacacgatcaacggagatttgtggttacaccaggagaagccaaccaaattacctcgagcacggtaatcagagagctttacacagctcatccttagggggagtaccgaacgacacgaagaatttttcctcacgagaaaaggggaggtccttcaccgagaggagaggatacaacaaataaaagagtttgtcggagagaacgacacgcctcaggatttccaggggagggaccacgatgaggacagatatagtacagggagcatcac

SEQ ID NO: 699682 - DNA, 385 bp, Homo sapiens
  misc_feature (67)..(67): n is a, c, g, or t
gattcccgaccgggaggacagggccggtcgtgccaagacgatgggcatgaccggccaaaggatgacnccgcagggctcagtgcaccacgcgacagaagctgaactcgccgccctcgacgttgaccgggatcacatcattcgggccgaagcgcccctgcaggatgagcttggacagcgggttctcgacgcgctgctggatggcgcgcttcagcgggcgagcgccgaagacggggtcgaagccgaccttggccagttcgtccagggccgcctcgctgacgtccagcttcatctccatcttgtccaggcgcgcctcgagctggcgcagctggatgcgggcgatggacttgatggggtcggcgcccagggcatggaagatgacggtctc

SEQ ID NO: 699683 - DNA, 772 bp, Homo sapiens
gtgtgtcactgcacatgtaagtagaaatattattttacttagttttaatatgtggacattggttaagggtcccaatccttctcatttcttctcttttattcttttgcatacttttagtgcaggttttaactcagttttcttattgttttactttcaaaatttgaacaagtatttaagttttttaaagcaactttattgttaactcatttaaaaaaatatattgctccttaaatcttcttaacatatttgttcctgccttctcctgtcttttaactcatctttgggaagacatttagaattttctgattgtttcagtttcgtgagcatttatactatcatttcttgtaccaaaatagatattttcaggtcttatttcaagttggctggtaagaaaaatagaaatttccattctatggaaaaatacagtgataaagagtaataattctggcatcggttacatttttttaaaaaagataaaattgaatagtcatctgtgaaaggaaagttcacctgactaagagtccataaaattattcaacaatataagccactgacatattcattgttcactaatggggatcaaattcagaagatcatcgtaaatgataaacccattgtatcattttcctacagtggaagtcatctctttgaattattcttatctttagtgagaaaatactgaaagaacatgcttatctatttgactaattatctgaacttcaagaggttctgataagaagtaggcctggcagcagataatttcatcttagaa

SEQ ID NO: 699684 - DNA, 443 bp, Homo sapiens
  misc_feature (17)..(17): n is a, c, g, or t
tatcagagcataccccntaggcatatttagtcatgtggtaggtgttatgaaagcaggtttgctttattttcttgaaatgattgtcaccttggcttgaattgtctgctggtgcgtcacaattagaattttaattaattggtggagaaacacaaaagccagcgagatagtctggaattcatttggagtaaaacgggacacaaaagaagctagcttcaagagcaggaaaatgcctgtgatgacaaagaagcctaaaagaatgatttgcataaaactgaaacacttgaaaagcttcaagataataaggttaaatacaaaaggagactcaacctcagagtggctgcttttgaaataagttttctagagggttttcaagaacaaatattttctacttaagttttgagggcccttcaagtttaggtcagtgatatctgggattctgggtt

SEQ ID NO: 699685 - DNA, 140 bp, Homo sapiens
attgacctaaccaggatgcactatggatgctatcaaagtatactgtgatttctctactggcgaaactgtatcgggccaacctgaaacatccagccaagacttggatagggctcaaggcaagaaacacggttgctaggaga

SEQ ID NO: 699686 - DNA, 377 bp, Homo sapiens
taggtgtctgaatgagtgaaggtatcagtgagtgagtgactccaggatcgatctggcaacacaccagggctcagacctcttgggctaagtgccagtctcagtcctcttggtctgtgtaacccaatagagatcaccccaggctgtggcttacgccaagggcacacccatgctcacaatcaaacacacacgcacgctctcgcactcgtgcacacgcgcatttgaggcaagcttgtggtccgcagacagagacaggactcagactcagactccactctgggtcagctctgcagcctccagagcacaggagtagcagggcactctgagtccgtggcctggtgacaggcctcgctctagatatctgacagccagctggtgcc

SEQ ID NO: 699687 - DNA, 267 bp, Homo sapiens
  misc_feature (14)..(14): n is a, c, g, or t
aaatttactcccgntcgaccctgccttagccccacaagtagtggtactataggcacacaccaccatgcccatctaagtttttgtattttatgtagagacaaggtttcaccatgttgcccaggctgatcttgacctcctgagctcaagtgatctgcccacctcggactcccaaaatgctgggattataggcgtaaaccaccatgcctggccttaaatcaaatttagagtcaacatctcttatcactggagcttctggagaagtcgacg

SEQ ID NO: 699688 - DNA, 338 bp, Homo sapiens
tatgttttactcgttccaccttccatacctcctactatgtcctcttaccctgtgttctcaaaaacttcaaacctcttcaactcacacctgacctaaaacctaaatgctttattttcttctacaatgcctgcttgcaccccaatacaaactcgacagtagttccaaatcaccagcaaacatggcactttcaatttttccatcctacaagatctaaataattcttgtcgtaaaatgggcaaatggtctgaggtgcctgacgtccaggcattcttttacacatcagtcccttcctactctctgtgcccagtgcaactcgtcccaaatcttccttctttccc

SEQ ID NO: 699689 - DNA, 919 bp, Homo sapiens
  misc_feature (806)..(806): n is a, c, g, or t
  misc_feature (821)..(821): n is a, c, g, or t
cttgtcgtggctggttttattcgttccgaggctcgctggcgcgtcctgttgcctgagcgtttagccaggtggctatgagcgtccggtcccacgccgccgggtccggcccgtcgcgtggtacggttgcgggggcttccaggtcagggtaggagagaccggtcctggtcactggccggtcgcttcttacaagcgtgactgtggaaactgcacaggatgctggagcggagggaaacgcatggtctcaggagcgagaccctgaccaaagtctgcgacctcatgtgtgcaggaggggtccgcgctgtcccccttcggccgtggcttgcgaggactgcagctgcagggacgagaaggtggcgccgctggctccttgacgcgctccctgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccataaccctnacccactctggtggncacttcattccagcagctgcaccccagcgtgggggctactcaggttcttggccagtttgcagttagaagtccggaatgttttggccttatccggtcta

SEQ ID NO: 699690 - DNA, 967 bp, Homo sapiens
  misc_feature (581)..(581): n is a, c, g, or t
  misc_feature (596)..(596): n is a, c, g, or t
  misc_feature (749)..(749): n is a, c, g, or t
  misc_feature (812)..(812): n is a, c, g, or t
  misc_feature (815)..(815): n is a, c, g, or t
  misc_feature (832)..(832): n is a, c, g, or t
  misc_feature (854)..(854): n is a, c, g, or t
  misc_feature (886)..(886): n is a, c, g, or t
  misc_feature (921)..(921): n is a, c, g, or t
  misc_feature (930)..(930): n is a, c, g, or t
  misc_feature (945)..(945): n is a, c, g, or t
tgcctggcgggcttcctggcagagcgagcggggcttccgtgagaagaccggggcgctgaggaatggcgctgcggggtcgcgccgagctcgtgtgcctcagcggcccgcacccggtccccgacccccctggtgcccctgatgggctgccagatcatgacttctgtgtgtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccataaccctnacccactctggtggncacttcattccagcagctgcaccccagcgttggaccagtttgcagagtgaaagatcaagaaatgtctctgctcctacatccagctcctctaggggcagcctccgtcatccatgccctcccaggaccctccactcactgctgtgagtgcgcctnaccagaaccagttaagagacaactatcaattcttgagacccaaattataagggccctgccctntantgaaaaaaaggggagcncaaggccttaatggacattganttgtgaaaacgcaaacatgaatatggttgganagccctggattaggagggtgacatggggaaggcanaggctggcnccatggtgactgccncataataaagtggtgatttgga

SEQ ID NO: 699691 - DNA, 104 bp, Homo sapiens
ttcaaacatacaagtttctcttttttcccccccaatgacagttcaacaatagccataagcttggggcaatgacagtttcaacaatatccataagttgggggggt

SEQ ID NO: 699692 - DNA, 859 bp, Homo sapiens
  misc_feature (581)..(581): n is a, c, g, or t
  misc_feature (596)..(596): n is a, c, g, or t
  misc_feature (768)..(768): n is a, c, g, or t
tgcctggcgggcttcctggcagagcgagcggggcttccgtgagaagaccggggcgctgaggaatggcgctgcggggtcgcgccgagctcgtgtgcctcagcggcccgcacccggtccccgacccccctggtgcccctgatgggctgccagatcatgacttctgtgtgtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccataaccctnacccactctggtggncacttcattccagcagctgcaccccagcggtaggcctaccttaaggttttggaccagtttgcagagtgaaagatcaagaaatgtctctgctcctacatccagctcctctaggggcagcctccgtcatccatgccctcccaggaccctccactcactgctgtgagtgcgcctnaccagaaccagttaagagacaacttttatattttggaacctttaagggccctttcctggccttgagggggcgcccaggctttttggctggt

SEQ ID NO: 699693 - DNA, 1016 bp, Homo sapiens
  misc_feature (581)..(581): n is a, c, g, or t
  misc_feature (596)..(596): n is a, c, g, or t
  misc_feature (645)..(645): n is a, c, g, or t
  misc_feature (650)..(650): n is a, c, g, or t
  misc_feature (653)..(654): n is a, c, g, or t
  misc_feature (659)..(659): n is a, c, g, or t
  misc_feature (798)..(798): n is a, c, g, or t
  misc_feature (861)..(861): n is a, c, g, or t
  misc_feature (864)..(864): n is a, c, g, or t
  misc_feature (881)..(881): n is a, c, g, or t
  misc_feature (903)..(903): n is a, c, g, or t
  misc_feature (935)..(935): n is a, c, g, or t
  misc_feature (970)..(970): n is a, c, g, or t
  misc_feature (979)..(979): n is a, c, g, or t
  misc_feature (994)..(994): n is a, c, g, or t
tgcctggcgggcttcctggcagagcgagcggggcttccgtgagaagaccggggcgctgaggaatggcgctgcggggtcgcgccgagctcgtgtgcctcagcggcccgcacccggtccccgacccccctggtgcccctgatgggctgccagatcatgacttctgtgtgtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccataaccctnacccactctggtggncacttcattccagcagctgcaccccagcgccaaaagggggggggccccnctttnaannccccnccttccaaaagtttcttggaccagtttgcagagtgaaagatcaagaaatgtctctgctcctacatccagctcctctaggggcagcctccgtcatccatgccctcccaggaccctccactcactgctgtgagtgcgcctnaccagaaccagttaagagacaactatcaattcttgagacccaaattataagggccctgccctntantgaaaaaaaggggagcncaaggccttaatggacattganttgtgaaaacgcaaacatgaatatggttgganagccctggattaggagggtgacatggggaaggcanaggctggcnccatggtgactgccncataataaagtggtgatttgga

SEQ ID NO: 699694 - DNA, 353 bp, Homo sapiens
  misc_feature (85)..(85): n is a, c, g, or t
tttgtatttttagtagagaccaggtttcaccgtgttagccaggatggtctcaatctcctgacctcgtgatccgcccacctgggcntcccaaagtgctgggattacaagcataagccatcttgcccagccaataataataattattatagtatgattctatttatataaaagttcaaaaacagacaaaaaactcctggagttcttgtatgaggatgataaatttgtaataattgatcaagttgtatacataagattcatatatgtttctgtatataaactttatttttcaaaataaaacttaaaaatcttaactaaaagggagcgagatagaagagagggaggaaggagatttt

SEQ ID NO: 699695 - DNA, 127 bp, Homo sapiens
aaagcccgctttggccccgttttcccgcccttgaaccccggccccgggggggggggggggggtttcttgcgccccgggattcaattaaacccgcccggagaccacgccgggcccaggggttttgcca

SEQ ID NO: 699696 - DNA, 212 bp, Homo sapiens
tgtggctacagctactgtgactacccctgtcagcaagcccactgtcctgagcacatgaatgtctgctaccagtcagctactgctcctcagcaggaagcggatgctgaggtgaacactgggaacacttaaataagtactccccaggggagctccatcgaagcaacacaaaatacagccacccttcaagcacaaccgggaccaagcggcctccc

SEQ ID NO: 699697 - DNA, 135 bp, Homo sapiens
ccggaacacacagagtcttcaagaccaacacacagaccttaccgagagagccctgccggaaccctgcggcggccttacttacacccagaggcgagggccggggtctaaaattaattccagagggattgtattggc

SEQ ID NO: 699698 - DNA, 134 bp, Homo sapiens
  misc_feature (64)..(64): n is a, c, g, or t
gtcaggtctggtcttgatggtgaggcatctctgggcgctgcccaatcgtggctaaaaagtactnctggccggaagtggtgtcgaacgttgtaaggaataacatttctggcatttccaagaaaaggtgaaggacc

SEQ ID NO: 699699 - DNA, 429 bp, Homo sapiens
  misc_feature (7)..(7): n is a, c, g, or t
  misc_feature (11)..(11): n is a, c, g, or t
  misc_feature (17)..(17): n is a, c, g, or t
ccctggngccnaggttnctcacattgtcaccttaacctttaaaatcgactccttgcattttggtgtggtatgaaaaaagaacatctgtaattatctgaaaaggcgattaaaatcctctattctttcccatatacatatctacataaggctgaattttcttcacatacttcaaacaaaacaacatatagtgaccgactgaatgcaggaggaggcatgaaaccagctatcttctattacaccagacattcaagagccgtgcaaaactgtaaaacaatgccactcttcccactaattatttttgtttggaaagtataattatttttctaaaatacattatctatgtaatataatttctttccatgctaacatccttaaactcaatcactaaatatctaacaaaaaaaaaaccaacggcctgcgtggcctcac

SEQ ID NO: 699700 - DNA, 139 bp, Homo sapiens
ggaccttcaaactccataaccagttccctatattaattttttgggcccaggactataatgtatttagcgctcatatttctttagtatccttcatcctcgaacacttctgcagatcttttattgtgctcaggcagtcctg

SEQ ID NO: 699701 - DNA, 471 bp, Homo sapiens
  misc_feature (55)..(55): n is a, c, g, or t
taccctggatttgatttcctcaatttgaagtgttgggcaaaaagttttttttgtntcgtaattcagtgggaacctgtaacggggttggggtaggttcctccccccttgggccaagggcccctttcccttggtgttttgtccccatccacctcctttaaagtggttttgggcctcagctttgcccagggccaaccaggtttttctgggaaaggaagggaatggggagaagggaaaaacaaccagtgttttagcctcaggagcttcccctcccccttcctaattcccctcccctttgcttgaaccttgaaccttgactgggagctgaaaagagtttcaactgttggcattaaacctccttttccccgttttggggaggtggggaccaacaaataaatcccccccttcctttaactgtcgctgtacttttaagttcagccagctcaaattttataaaaattaattaaaatttca

SEQ ID NO: 699702 - DNA, 244 bp, Homo sapiens
  misc_feature (38)..(38): n is a, c, g, or t
  misc_feature (89)..(89): n is a, c, g, or t
  misc_feature (99)..(99): n is a, c, g, or t
  misc_feature (123)..(124): n is a, c, g, or t
  misc_feature (157)..(157): n is a, c, g, or t
  misc_feature (212)..(212): n is a, c, g, or t
agcctcccaagtagctgggaggacaggtgtgagctgcngcacccagcctgtttctctttttccacttttcttttttctcatctcttttntgggttgccngtcggctttctcatcaacatgttnngcaagcaccttatacatgtgtccttgggagccntgagacttctttctctccttgcctccacccacctccaaaggtgctgagctcacanccacacccctctgtcgttcttctcgcagccgt

SEQ ID NO: 699703 - DNA, 629 bp, Homo sapiens
  misc_feature (272)..(272): n is a, c, g, or t
  misc_feature (274)..(274): n is a, c, g, or t
gaccaccaaggaccaatcaaaaccagactggctattagtcagtcacatttaatgactgcacttggtcacacaagaccatcatttagcgaagaggactggatgtattttgctgagctatatgaagctttcaaaatcaaagaggagaaaaatcaaagtggaacaatgtttcgacctggcagaaagtactttagcataaaatatacttctttttgattggatctgttaggtttattggggggctgcaaggtcatgaaaaaagggtcatttccttnanacccaaataggggtgggttgcgcaccccggcaaatttttttttgaattgtaatccccataattcccccatgttaaaggagggactgtgggggtgaggggattggaccaaggggggggatttccccccccgcggttttcataattgggagttttcccaagacccctgttaatgaaataatattagccaaatggtggaactaatttatttctttgaggaaaagataataaagaatgtaattaaatttaaatttcttggaattcccagttgtatattcatcacctttgtagcatttgacaaattttatgcttagcagcttcttcactgttttgaaataaaatatcctattacctactg

SEQ ID NO: 699704 - DNA, 364 bp, Homo sapiens
  misc_feature (85)..(85): n is a, c, g, or t
aatattccaaagagtccataattccaaagccagaatccaagtaagtacctgttgccataccccctgaaagatggtcctgaaaggncccaatgtttgtaagataaaatgtacaagagtaggaaacctcactggatatggatgccatgagaaagaaataaagatgacagtttctggcttaagtaccctgggattgcactgctactattaaccatgacatccctggaataaaagcaggtttgaaaaaaggccatttggctgggtgcagtggctcacatctataatcccagcactttgggaggccgaggtgagcagattatttgagtctaggagttcaagaccaacgtgggcaacatggcgaaagcct

SEQ ID NO: 699705 - DNA, 711 bp, Homo sapiens
agcggggcgctcagccgggcacttgtgtgagtgcgggtctctgctgcaggacgccggggtgccggcgcggcgttggccgcccccgtgcctccgccgaggtgcagcgctgcccgagaggccattgtgcctgctgctcctgctccgtgcggccctgtgctgccccagggtgtgggcggtgtgagtgcctgcctgctgccagttcagccgcaactgcttacagccggcacggctgcacgtcggttctcgacgtcagccctggcttccgggcccaccgctggcgcgccgatttttgtttcgcgccgcgaacgcgccggcaggtagggggtgggaaaccccagagcggtgagacgcccgcgaggactttgcgggcccgcgcgccaatgcctgtcagtcgcccagctggcgggctggcaggtgggtagtgctccgaagcaacacagaagcctggacgcatgggacgggcgcaacagacatcctccagcaaaaccgggcgatccacgcggtccggatccttttggaacacaggggactcaccgtgacagcttcgcaggaccaggctccctgacaagcccaaatgttgatgatttcagaaaccacattatgaccagcatgtacacatgatcttcttaggaaagacaaagaactgtatcccaagcgggttgccctttaaaaaccccccgttgttggtcctccctggaaggtgtacgtgtg

SEQ ID NO: 699706 - DNA, 385 bp, Homo sapiens
  misc_feature (166)..(166): n is a, c, g, or t
ccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctaatggntatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaa

SEQ ID NO: 699707 - DNA, 283 bp, Homo sapiens
agcggggacactcacttgacggtcaggatgttcaagacagtctaaccaacgcggtaaaatcccgactctactaaaaatgcaacaattagccgtggcgtggtggtgcatacctgtaatcccagctactcgggaggctgaggcagaagaatcgcttgaatccgggaggtggaagttgcactgagccgagatcgcgccattgcactccagccggggtaacagagcaagactccatctcaaaagaggaaaaaatggtaagtgatggttccccgctgggtacggagct

SEQ ID NO: 699708 - DNA, 373 bp, Homo sapiens
actggaaacaaaataatgaaaccctcctgaagaaaccagactttgggcttactataggcaagactttaaaccattgtgcttaactaaggccaaagagggtaaagggaaacctgggccaagaactaacgggagacacgatgacctatgaaccaaatgggaatttccatcacagaccccgacgttataaaaagggacccaagattaatcttggagctgaaaagtaccggaactgaaattaattccctaaaggagttccacaggtgatccggaccgggagcacgaatccaccaacttggaaaaactaaacgcaagggccactgcataatcaagtctgaggaacaaaagagaacacagcctaagaaacgggggagac

SEQ ID NO: 699709 - DNA, 398 bp, Homo sapiens
aacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgcctaccgtgtggaatgaggtcattgtgcccgcaggttgtttgtgattagctgtctcctaacaattgttcatacaataattgttcattattgttctcaaccttggggctctccccaaccctggggacccttccttattgttgcttacttatccaggtctccacataaaaggtgtggaaacttcattcattcatatcttcaacacaaattgtaggtag

SEQ ID NO: 699710 - DNA, 184 bp, Homo sapiens
tgcgacgtatgatgggaagcagaagagtagggaggttctgctgcagcaggtcgaagttcaccccattcaaacagagctggcctgttccctgatggagttccattcctgccaggacacggctgagtaacaacgaagccattcaagaaaggcgggtgtgaaatcactggcaccccatggagagacc

SEQ ID NO: 699711 - DNA, 145 bp, Homo sapiens
caatgatggtcctcagctcacttggatcttgcatgtgagctgagagaacaaagtataaaccataacgctttggccatgcgactatggtgtgctcacgcctgtggtcccagcacttttggaagctgagtgaccatcgttggcgtgc

SEQ ID NO: 699712 - DNA, 446 bp, Homo sapiens
  misc_feature (229)..(229): n is a, c, g, or t
ctagatcactgcaataaaacaagtatcgcaataaaacgagtcacataaatctttggtttcacagtgcatataaaaattatattcacggcatactgtagtctattaagtgtgcaatagattatgtctaatagatactttaattaaaaaatattttattgctgtaaaatgccaacaatcgtttgagccttcagtgatttgtaatcttttttctttgatgagacggagccgncttctgtcatccggtctataatgcaatggtgtgatcatggctcgctgcatttttgaattcctggggcttagggtgatcctcctgcctcagccttcctattgtcactgggtagaggggtcgtgactgcaagttgtccaggattcttgggcgttttgaaattaaagaattgggaccaaaacgcccagccaaagcaaaggaaaggatggaagccaaccaa

SEQ ID NO: 699713 - DNA, 561 bp, Homo sapiens
  misc_feature (163)..(163): n is a, c, g, or t
  misc_feature (409)..(409): n is a, c, g, or t
  misc_feature (556)..(556): n is a, c, g, or t
gccaaaggggtcctcagcccacggcaacctccccatcctggctcaagtggtctcgtgcctccagcctcccgagtagctgggaccaccaggagagcccccaccaggccctggctaatttgccatgttttgtagaggccagggtttcacccatgttgggccaggntggtctcagactcttgataaaataaaatgattaattgtggcatttgggttttcaaaatgagaattgtgtttaaaatgcaaaagagggaaagaaagttatatgtaatcttcctatatttagcttttattttacttcattggcagtctgggtaaaaaattcatagaagacagaagacttggtttctagtcttggcctgaaacttttagctgtcacaactgggggatgctgttggcatctagtgggtgnaggccagggatgctgcaaaacattccacagtacacaggacagcgcccttacaggttgaaggtttatacaaataatattaaagctctttttttatattaatgtggaaaaatgttattttggttcccatgagaaactgctactatttgnaattt

SEQ ID NO: 699714 - DNA, 991 bp, Homo sapiens
gtagagcttactcttggagtaccaaagctgtgcaagattgtaagcagtcataagatgtctcagtgtacaggctgtgctttgaaatcatagtagtatattcgctgtggctccattagttaaatgagatatatatttagtgcagaaaaaagacgattgaaaacagctattaagtgcacctagtgaagagtctgtacattttagatggctattaagaggcacatttatttacattggtatattatctttaaatcctcatagtcgaaataagattctccagagggacgttttaattagtcaagatttcgagactgtagactatgtatacatctgtttaggacatcaacttatattctgacaaagcgtgcctgtgttgtataacgagtcaatgtgtgctaaagcttcagtcaacttctagagctgcttgtttgcatcttcagctaccacagcatccacagcgtgccactcgtacacagtaacagctggacagacccagtaacatgtacagtacatcgtctacgtgaatgtcgtactcgacagtggctaaaactgaaccagccttctcttttgtaactcattaagagatttcctctctaagggaccgatcttcgagtagcacgttccagcctagtcgtaatcagttactaatcgtaacttccgggaatttcccgattctcctcttgtgcaccactagaaaaccagcgatacactattcacacaaccgggtagccctcaactaaaattaccaggcccgcgaaacacccctctggcgcctcgtaccggcgcacgccaggttctgccagacacaaaccttgaccagcactggcaacaccaacctcgggggacagcacaccgacagcccacccatacgggccccacactccgcagccacccccgtcctacacgccgagaaacccccggcaacccacacccacccctacgtgcaaaacccggacatacaataggcggcaacaccgacactcacaccccgcaa

SEQ ID NO: 699715 - DNA, 905 bp, Homo sapiens
cttccgccgcccctccccgatcgaggaatcatttccccctgcgctctggaggaggagatcttcccttgcccgccgcttcctccggaggaggagggaggacctgaggacccatagcgacccacacagccaggagacggtgagcagatgattggagatcgatctcgtgtctcagtgtggatgacatgattaagaatgatcattgaaagcgggtgtcatactggatatgtgccccacaccacgtggccaactccatatcaagaacaaagtccaagtaaccaagggcctgcagacagggggcaaagcaccccatgcttccaataggaaatacccattacgagcatcacagacaacctgcccaggtacggctccaggttcagaagacagacacacgtccagtagacaagccccagaccacagacaaagcctcaggtcaacaccatgacagacccagacacccagcctgtggtcaatggctaaacaccacgccccgagggccacgaagcgtacaactgctggctcgagaccatacggtgggctccagggccctacagtaactccatgtaggctaccaagagcaggcgatgagcccaggagactctggggccacaccgagtaggagggagggcgcagagaccagcaagtgacaaggtacccgtcactcagaatacaggcagccaaggagagacgagtggaacgtgtgccagaccggcggccagcagacagtggacctgaggccgcccgagtaaggaggacgcgaacaccggaagcgaataaccgaagagaggaggcgacgagcagcacacaagaagaagcacgaaagcacgaacaagcggcaacaaagaccggtgcacagccgccgacgcgaagggaacaacgagcggaaaggaaaggcaccggaacggccg

SEQ ID NO: 699716 - DNA, 101 bp, Homo sapiens
gcacataattacacacacacacacacaatttcgaaatgagacagaattggttttttaaatgagaccattattacaggagagccaacagacaataggagatc

SEQ ID NO: 699717 - DNA, 238 bp, Homo sapiens
agctataaaatactgagcatgccttggggtagcatgttttccatccaaaattatgattcatgaattctctttgttataaactaacctgcagaatgaggaaggaaagaagaaaaaggcaggagaaacatatttttggctttaattctgagacttgggttgtgaggcattccaagaactccactgaaatttgacttatcataatagcattttcaaaaatataaacaagaacacaacaaat

SEQ ID NO: 699718 - DNA, 310 bp, Homo sapiens
tgtagacaactagggtagttttgaggtggaagcatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 699719 - DNA, 143 bp, Homo sapiens
ctagctcagtacctctgaagtgaacgcagctgcaggaagagtggaggggggcctgtcattatgtttcccccccaccccccaactgaaaggaaaactaagactcccaacataaacagtggctttgaggggaaaagaccctgtgt

SEQ ID NO: 699720 - DNA, 304 bp, Homo sapiens
aaattgttgaacaggccataccttcagtgtcctgccctcacctgtggtacaagtgtgccaagggacaagaggccaatggcagggcctggttgggctcaggatgaaaatgggatggggactcccagagtggtggcaatgaaaaccagcagatgaatcaatgtgaggccaggggttgtcacatgccaccctatgagcatgagagcaggaaccgtggatatagcaccggtctttcctctccccaatccccgagggctgtgcttcccaagtttctccatcctttgggaagggggtaccggagcctcga

SEQ ID NO: 699721 - DNA, 513 bp, Homo sapiens
  misc_feature (38)..(38): n is a, c, g, or t
  misc_feature (75)..(75): n is a, c, g, or t
  misc_feature (361)..(361): n is a, c, g, or t
  misc_feature (454)..(454): n is a, c, g, or t
  misc_feature (463)..(463): n is a, c, g, or t
  misc_feature (512)..(512): n is a, c, g, or t
ctgtatttcatctggcaaccctacttcaaaaccccagntgtaaggtacatggatgtgctttggtcaaggaatagnccaaggcagagatcccatgccctgcatgacctcagtgggttttggtgcacaggcacacaccctcccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcntttcacgcccagagagagaaaaagttaagctgctgaccctgaaggcaagggagagcaggctgcacagctgtgtgtggaaccaccgggctcaangcatccaanggcagggcggacagtgtgagagagctaagtgtaaagctgttgatgaganc

SEQ ID NO: 699722 - DNA, 358 bp, Homo sapiens
acgctctctctgtggggtgagcatccccatcacttgtgaagcacaggccccgggaagtctgggatttgtcgcttaggctttgggttccctgtatggtcatgtagggatggtgacatcctcacgtggggctgctcccatcctttggcccaggacctgatgctcatgtggtgctcagacatgtgtggctgtttacttaccacatcctccgggtccatctactctgatggatcagtgactccccggtggccctgacttctcctcccagcccttgagcatactctgcatttcttgagctatgagcaggctggtaaggccgggcacggggctcatagagaggctctgtggccagcaccatggc

SEQ ID NO: 699723 - DNA, 192 bp, Homo sapiens
caatgtacagcaaggaagtgaacgcgatgggaccaccgccccctgcgccgcggcctcaaccaccgccactacagccgttaccggggttcttctcccgcggggacgccgagagcgggggtgacagcgggtcggaggcgacgggggccaggtccgctgtgcccgaggcaccgaattgagtattgcgggcggccg

SEQ ID NO: 699724 - DNA, 284 bp, Homo sapiens
atccttccctctctcagcgtctctgctggtgtaactttccagatacgctgccactcatcactgctttcaccagccctcctgatcccaccccacacctactcatcaattcaggaaatgcgtctcctagtgctcacgagctccttgggctgagccactttcaccttcctacactcgctccacgccccgcgttgcgctctccaatggtatatggctctactcgatttctccctacagtgatacctttccacttttctagcttctccagatacatacgcgcatcatcc

SEQ ID NO: 699725 - DNA, 877 bp, Homo sapiens
tctgcagaagggggccgggacaggagggatgggcggattcggtctgaagaagtgcacagggaggacctaaaggagtgtgggttcgagagcagcttcaaggacaagtcagactgtgacttccccaagaacctggagccctgggaacggccccatgcagcgcgggaaaaggagaaaaaggatgccctggaaaaggaaaggaaggaaaagggcagggcagacaagtacaaagagaagtccagcgagagggagagaagtgacaagtccacccttgacaagtgtcagaaagacaaagaatttgaaaaatgctttaaagagaagaaagacggcaaggaaaagcataaagacatacacagcaaagacagaaaagcatcctttgaccaactgagagagaagaaggagaaggtgttctctagcatcatctcagaagacttctcagagagaaaggatgacaggaaggggaaggagaagagctggtacattgcagacattttcacagatgagagcgaggacgagaaggacgattgcgtggccggcagcttcaaggccacagaggccagcgacacccagcgagtggacggctcccagaaaaggaggaaggacgagaacaaccctcggacaggcaccggaagtcctcttctgacaggcagcacacagagaagccaagagacaaagagcccaagggaacgaagaagggcgagggacttcggaacgagggaaggccagaaggcaccatggccagatctttggaagcccaaggaaagaagacagggggttggcagggtgttaattccctgtccatctggtcacctttgggacattacaagggggcacctcttaagagggccccggggtaaacaggaatgggttcgcaggttcc

SEQ ID NO: 699726 - DNA, 217 bp, Homo sapiens
aactgcacatgcacacagtgcccaaatttttgaattgctcaacatatgtgttcccagctgaggctgaacaaggtgacacacaaacctcttgtatcagctctcatactgtaaacaagcgtccgtcttgtggtctacttagtgccaggttttttgtatttttcttggtgatttcacagtttacaagggcccccaagagcagtgttgcagtgtgcttccg

SEQ ID NO: 699727 - DNA, 660 bp, Homo sapiens
  misc_feature (26)..(26): n is a, c, g, or t
  misc_feature (31)..(31): n is a, c, g, or t
  misc_feature (599)..(599): n is a, c, g, or t
  misc_feature (606)..(606): n is a, c, g, or t
  misc_feature (609)..(609): n is a, c, g, or t
ctgaccttttgccgcagagtctggcntgccngggtagtccgacagcatatttccaccgatcaccaggggcagtttgtctttgtaggttcttacaatgcgggtaacgtgagcgtaacggtcctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggccaggacctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacaccgtgggcggctgatatcatatcacccggatggtcgccatttatacgcctgcgaccgtaccgccagcctgattaccgttttcagcgtttcggaagatggcagcgtgttgagtaaagaagcttccagccnacggaanccnagcgcgcgcttcaatgttgatcacagcggcaagtatctgattgccgccggg

SEQ ID NO: 699728 - DNA, 135 bp, Homo sapiens
ggatgcttgcaggtgtcgtagaaacccagcgggcggtactggtctgcaagcgaattcacctatggtgatattgtgaaggtatcaatactggcgcttggatcaagtcaggtgaccctatcaaggacttcgttctag

SEQ ID NO: 699729 - DNA, 367 bp, Homo sapiens
  misc_feature (8)..(8): n is a, c, g, or t
tccccggngagtgctccaaagcaggccagcaagggcaggcccttcagcctttgcagccccctggcggtgagcaaagccgactacggggaacccaaagttttcgcctgggaagtccccccttgggggcttgggttgcccgtccccaagagctttaccaggggagggtgtttgagggggaagtgcccccccctggtcctcagtttcagcctggccccctcccctcctttggcctttggccctttttccccagggggcctcccccttttgggggcctccaggtcttttttcccctcccccccctcctcccccttgggttttattttggtaatgttgggggggaatgaattaataaagtgaatttttgcca

SEQ ID NO: 699730 - DNA, 188 bp, Homo sapiens
gcccgcattctggttacaaatcatgactatgaaccatgatgtttggattcgatccctggccttgctcaatgtggttaaggatcttggtggatgccatgagctgtggtgtacggttgtcagactcagactcaaatcctgtgttgttgtgactcttgcataggccagtggctacagctccaattagaccc

SEQ ID NO: 699731 - DNA, 163 bp, Homo sapiens
aggaaccccctccctgcacggcaccgggcatgaaggcgccctttccgtcgtacattaaggtttcaatctcaccacgtgcaaccaccaggtccgcagccggcggcttgagctcttccagaacaacactgaaaggacgccaggccagaccgtgttcgtcgcggat

SEQ ID NO: 699732 - DNA, 255 bp, Homo sapiens
tggaaatcattcaggagcgcctctcccgcgagttcaatctcaacctgatcgcgaccgcgcccagcgtcatctacaagatgcacctcaacacggcaccgagatcgagattcacaatccgatcgacatgccggacgtgacgcagatcaaggaaatcgaggagccgtggatcgaggccaccatcctcaccccggacgaatatctcggcagcgtgctcaagctctgtcaggaacgtcgcggcaaccagaaggaactcac

SEQ ID NO: 699733 - DNA, 316 bp, Homo sapiens
  misc_feature (155)..(155): n is a, c, g, or t
gttttttttttttgggaaccccccccccaaaaaaaaccatggggccaaaccgggggcccccaaagggtttttttaaacccccccctgggaaaattttccaggtttttaaaggggaggggccggggtttggtccccggtcccaaaggtaaaagttnccggtggttttttaaaacccccctggggggaaaggggggggggtcccaaaaaaacttccccaaaaaaggggggggggccaaattttcccccccccttttcccgccaaattttggccccaaccgaaagggggccccccataaaagggattttttttttttga

SEQ ID NO: 699734 - DNA, 102 bp, Homo sapiens
cgttgaagcagcagagctggaggtgctgtcaagagtctcagcagactcatatggccatgatgcacctgaactcaatgagtgcacttagatgatgagaaactg

SEQ ID NO: 699735 - DNA, 182 bp, Homo sapiens
gggtgactctacaggattttacacgtacgcttcggagcgaggataagacacttgaggcaggagtcgataccagcctaagcacatagcatatcccatctccacaaaaaaacaaaaattaaaaaattagctgggtgtggtggcaaacacctacagtcccagctacttgaatggcgttactgtgt

SEQ ID NO: 699736 - DNA, 103 bp, Homo sapiens
gcggccgcctactactactactgctcgaattcaagcttctaacgatgtacggggacatgcacccaatgggtgcacaataaataacaggtcaacaaagaaaaaa

SEQ ID NO: 699737 - DNA, 248 bp, Homo sapiens
gcgtagatcgagctggtaccagcgactgggtatcttcgatcactgcatgccgttcacgtgtcgcgtgcctatgacgaggccaccggcacgtccatccgcgcatctggaccgacaagcgcgacctggaaatgtgggcccagctggagggctgatcccgcgcggccggcgcgcctgccgctgttccacagatcgaaacggctgcacgcaatccgccaccgaagtcggccggcgacgcgtgcagccgcgca

SEQ ID NO: 699738 - DNA, 466 bp, Homo sapiens
gaaacctcactgtccttactaaaattcagcatcctttctttaaatggttcttgtatgttacaagccttatttaattttcagagttgtgagataagttgatttggatagtttttgccagtgttctttgttgcttttgaggaagatcagtttttcagaggtattgactccacaattgcagaagtcccacccaagataattacatttctttggtttgttttttggtttgggaattttttttttaattttttaaatttttattttttcacatgcctgctatgtcaaattttgggaggctgaggcatgagaatcgcttgaacccaggaggcagaggttgcagtaagctgatatctcaccactgcactccagcctgggtgacagaacaagattctgtcaaataaatacataaataaatgggagtatttgtcacctaaattaatctgtataataggatttctagtggcgtaac

SEQ ID NO: 699739 - DNA, 134 bp, Homo sapiens
aaaacgagaggatccatacggacgggcttacttgaagtgatgtcctccagcgagttcctgttgaggctcagagctcatgaacctgaccagtacctatgaggacacggggttcgacccttggcttgctcagtggg

SEQ ID NO: 699740 - DNA, 265 bp, Homo sapiens
agtacaactctctttcgatccatgatattgtctacagagttgtcttcaggttattgcaaaaggcttcttgtacagtctgacttgtctccagacgttgcgctcagtctgacagttgtccccccaggtcttagttccgaatttctacttcctgtagtttctgagtcctagattccctctatgcttgtacgttctctggcgattcatgcaagtttcttgtgttaacctttctatttcctcttccttcattttctgtgcccattccccg

SEQ ID NO: 699741 - DNA, 394 bp, Homo sapiens
ggtcagcctttcaatgtgacacaaggaaagtattctacagctcaagactgcagagcagatgacgacagcttacttgagcccatagcggtgggagctgccttggcaggagtactaatgctagtgacggtggcttattgtagtggtctcaagcaccatgatgctggatatgagcaattttagaatctgcaacctgatagattatatcgaaattcatgcatataacatgattttgttacctctcaggtgttgaaacacttggcttcttagaactgacatgctgagaactttaattcttttatcaatccgagcatgcagagatcaggctttattaatagaacctgtactctacaatcagctgtccagtgtcatatgtactggtgctggagccttgttc

SEQ ID NO: 699742 - DNA, 419 bp, Homo sapiens
ctaattcaactacatatatagcagccatgtgcccttctcacggaacttgcaaaggtctgcaagctatcctctgggatccttcactggtgctaatttggcatcatttgcagtagcggtatatccagtccagcttattgtagcgattcggtgcatcatgtaaggtttaaatgggccatctctcgtagccattagaatctatctacaggagacgccgtgtttgatgaaggccctgtggagtcagacgaatgtatagtggactcgacgttagacatttaaagttaaccttatcagttctatatttgatgggcatctacggcatatatcccagaactcgatcaccaaggacacaattgccctctcatactatagcatcttaaatctgacaaccctgtcccagtcccattcaaacttctcgtacc

SEQ ID NO: 699743 - DNA, 332 bp, Homo sapiens
gccgggcgcggtggcgcgtgcctgtagtcccaaagtgctgggattacaggcgtgagccgccacgtccggctaacaagtactttttgtttttattttatttttgggatggaggtctgggtgacagagcgggactccatctcaaaaaagaaaagtcaagcagaaacattttgtgtacaccctatcgggcgcgtatttgacccacagagaacaaacctaaggctatccaggttttgtggagggcttgaaacacccccaaaggatgtaaaggcgcccctagtgaaatgtgcacccttctttgtggacgggggtgagtggcccctgtgatgaggctg

SEQ ID NO: 699744 - DNA, 726 bp, Homo sapiens
cgttttcgtactccagggctgctcctggcggctctgcggcgtcaccatgccacagaatgagatatattgaattacaccgtaaacgctatggataccgttctggattcaccatgacgaaaaagagaaacgaacggaaagtcgagaggctcatgaacgttcaagagaaggcaaatgaaaatgattggtctgaaggctagagcgtttaccataaacagacgtcgatgctgagaaatatacaaatgaaaaagactatcaagatgcatgacacagagaaacaccgcaaagcaaaagaatgatgaaaagacaccacagggagcagtacctgcctatctgctggacggagagggacaatctcgagctaaagtactttccaactatgattaaacagaaaaggaaccgagtaaggcgggaaaatgggaagtccctctgagcgtaaagtacgatgcccagggagaaacagaagtatcaaaagttattcgaacaggaacgagaaagaagaaggcatggaagagaatggttactagagtgtgctttgttggagatggctttacaagaaaaccagctaaatatgaaagattcatcaggccaatgggtcttgcgtttcaagaggagcccatgtacgacatctgaactgaaagccacttttgctagcaatacttggtgttagaagaatccctcattcccatgtatacactttgggtgttattaccaaggtactggcttgaa

SEQ ID NO: 699745 - DNA, 537 bp, Homo sapiens
  misc_feature (17)..(17): n is a, c, g, or t
  misc_feature (33)..(33): n is a, c, g, or t
  misc_feature (96)..(96): n is a, c, g, or t
  misc_feature (514)..(515): n is a, c, g, or t
  misc_feature (531)..(531): n is a, c, g, or t
  misc_feature (534)..(534): n is a, c, g, or t
cggggccatagtccccnggggaaccccctaccnaaactaaaggctaagaaaaattaactctctttcacctattcccattactcccttatttccctnactctattactgaccaccctagctattaatgtaacccaagtcaattttgccctcaaactattacatttgatgcttgcccttgttatactctgtggagactggccaagtcaaagatagctctcccacttcagaaaattaccctctgtccttccccaggtgctcctcagactggacatggtgaattgggatcatttagtctaggaagatttcaatgaagaccccagtgtcaactgggagtctttccccccatccccaatccagagcttttatgccatagttggtccaacgttctgtggaccactaaagagcaaggatggactgccccaaccagtagttgtaatttcctaaaatcataaagtcattttactaaaggaacagcttcccctaactgtcagctaaaccagtgcaatccaatacnnggttattatcccaaantcntca

SEQ ID NO: 699746 - DNA, 191 bp, Homo sapiens
tcatatagaatcgagccggacctgcaggctctctctgactgaaggcgggtgagtcacaggctcctgtggaccaagaactatgagatcggagcggctctggacaccatccagtatgcaaagcatcccccgccgttgtgaccagtttaagcccagctcattctgcgtgcgccatcgttctgtctcataggttg

SEQ ID NO: 699747 - DNA, 931 bp, Homo sapiens
ggatgggctctgtgcttggagctgaagaggagtgcacggacactttgagcacggcttccgtgatgcatggaaagaacttgtcacctgatccaggtccaacaaggtgcgacacacggtgcagtggcgctgatgtgtgtcgatgatactactacgctgtggaagaagtcggagtcgctacgactacttacgtctccatgcagacgcggtctgggccggtaggaagtacgtcccgtccggaaccacaggaactgcagaccagtgacctggcatgagcatgcgactcgccgtagtagggccccgagcgcgtccgactgcccgagagacaatgacacacctgagtgggatgcgcacagatccactgagacagtggatggcacaggacggtggtctcgatgaggcccggagtggcctctgatggactcccgtccatcggagccagtggcctgtgtatccttccagacagctggatgagtcccccgctgtagccctgtcccatcggacccccagtccctggccgaaaccaggctcatagcagccagctgtcactgctccggagccagacgccagcccaaggctggccgtggacttcgccctgcccaaggagctgccccatcatctccagccatgtggacctcagcggggatcctggaggagactgtggcccagacaggtggctttgtcggtcacagagtttggactcatcggcattggggacgttgaaccccttcctggacgccaaacaccaaagtgacccgggaaacccgaggtataaaacatcggagacccaggtgaagacaatggtaacacgtgattgaccatgatggactccatggaccggagagagcggcgtaatgagagacaaggacaggaaataagaggcatgcagaatgaggaccagcatctggaaagcatacagaccacttcccaaaac

SEQ ID NO: 699748 - DNA, 399 bp, Homo sapiens
  misc_feature (202)..(202): n is a, c, g, or t
  misc_feature (225)..(225): n is a, c, g, or t
  misc_feature (228)..(228): n is a, c, g, or t
  misc_feature (256)..(256): n is a, c, g, or t
aggaattcgtgctgctactcaagggaatcatgctggtgctgcatggcagaagaaagaagggagcatgtagctaaaatgaagaagatggagatggagatggagcagctgtttgagatgaaggtcaaagaaaaagttcaaaaactgaaggactctgaagctgagctccagcggcgccatgagcaaatgaaaaagaattctggangcacagcacaaagaattggaggnaanacgtcgtcagttcgaggatgagaaagcnaactgggaagctcaacacgtattttagaaccacagaactcttcaagaaccttggaaaagtacaagaagaaagggaagatctttaaactctctattgaccaccagttaacgtattagtgccatcggccagcttggacatcagtg

SEQ ID NO: 699749 - DNA, 310 bp, Homo sapiens
  misc_feature (14)..(14): n is a, c, g, or t
  misc_feature (16)..(16): n is a, c, g, or t
  misc_feature (49)..(49): n is a, c, g, or t
  misc_feature (56)..(56): n is a, c, g, or t
  misc_feature (62)..(62): n is a, c, g, or t
  misc_feature (91)..(91): n is a, c, g, or t
  misc_feature (104)..(104): n is a, c, g, or t
  misc_feature (111)..(111): n is a, c, g, or t
  misc_feature (143)..(143): n is a, c, g, or t
  misc_feature (171)..(171): n is a, c, g, or t
  misc_feature (198)..(198): n is a, c, g, or t
  misc_feature (251)..(251): n is a, c, g, or t
  misc_feature (298)..(298): n is a, c, g, or t
tatagtcagttccntntaatttcattcaatggcattttcctcatgaggncactgtnaattcnattgcagctggacatccaatattgcaccnccatcacagcacnaaaaagnatggaaagctgggttttctcgtgtaccaagtnccaaaacatgtgctaaaaagttaacatncacagttgtaagagatcaacgtcgggntgcctcaagtttatagtagttgcttcacacggttttccaagacttgggtgccnccagtgttgccgtgtttgtgcaaatgccagctctgggcggcctgctnctccttttgcca

SEQ ID NO: 699750 - DNA, 225 bp, Homo sapiens
ccggaagactttaaaatcccgtatgagatgtaaaaccatcgagcggaatgaagagcggaccgcatccgcgggaggtgctgtacgaatatttgtgaatttctccagaccagccgtggtttcgagagaaatacgactattatatacgacttacggggcggttacacgaacacacacccctttttaaagggggttatttgaaactctctccggggcgggcactgtgag

SEQ ID NO: 699751 - DNA, 113 bp, Homo sapiens
gaagcaggagcttggtgatacctctgtcccttaccctgaagttgtcaccctatcctataccctacctcccgctgctgtacatactagtacccctctttctagaaatagccttt

SEQ ID NO: 699752 - DNA, 103 bp, Homo sapiens
cagtgtcacagatacagatctcagcttgctgcggtcctcctcctgctgctgcagcaactcgggaaccgcggcatggcgacgcgggactccggaagtatgtagt

SEQ ID NO: 699753 - DNA, 127 bp, Homo sapiens
gtctgactccagaggatcccggaggaggcaagagccacaggaggtggaggacctggtggaccaggtgggcctggaggagctaagggtggacgtggatggagtctgtccagctggaaaaggtgggggt

SEQ ID NO: 699754 - DNA, 222 bp, Homo sapiens
tcgtatatatgctgtctcatagtctcaggatatgtaggtgagctggcaagctggagaccaggagagctgacagtttagtttcagtctgagatccgaaggactaaacccaggaaggcagacagtgtcatgccagtctgaagactggcaggctcagacccaggagtagctgatgtctcagttcaactcctgagacaagcctatcagggctaccgacgctcgcaa

SEQ ID NO: 699755 - DNA, 259 bp, Homo sapiens
aatctcagccctttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcccttgagcccaattcaaagctgcagtgagctgtaattgcatccctgccctccaacctgggcaacaaagtaagcccttgtttta

SEQ ID NO: 699756 - DNA, 248 bp, Homo sapiens
cacaggatcttacttattccggtgtcttattaaatataatcgctgggtccgtggctcacacctatatctcaacactttgggaggcaaggcaagtggatcacgaggtcaacagatcgagaccatcctggctaacacggtgaaaccccgtctctaataaaaatacaaaaaattagccgggcatggtggcaggtgcctgtagtcttagctactcaggaggctgaggcaggagaatggcgtgaacccaggag

SEQ ID NO: 699757 - DNA, 268 bp, Homo sapiens
gagatggccgtgagcccgtccctgtccgatagacctgtaggcaaggcagtgtttgcaggcggtgtttgggcagctggagcagtgggtagtcctacgggcagagagctcccctttgagccctttgcggccagacgctgtgtggagcacttcccaggagttgttttgtagactcaccgagaccttgggggaggaaatgtgcttttggctggcttgcccagtcttagactctcttgttgtagccctctccttttgtgacgtcacccagcct

SEQ ID NO: 699758 - DNA, 693 bp, Homo sapiens
gttgtcattgacatccagtcatctctttctaagggaatcagaggcaatgagcccgtatatacttcaactcaagaagactgcattaattcttgctgttcaacaaaaaacatatcaggggacaaagcatgtaacttgatgatccccgactctactaaaactaaaaaaaaattagctgggcgtggtggcgggcgcctgtagtcccagctactcaggaggctgaggcaggagaaaagtgtgaacccaggaggcggagcttgcagtgagccgagatcacaccactgcactccatccagcctggtgacagggtgagactctgtctcaaaaaaaaacaaaacaggggggacccaggatttccggcaaaatttttttcccagggtttggggaaagaaaattggcctggtatccccaaggtcgggtaacctccaaggcaaaaaggtgttcccaatttgtccgagtatgagcttggccccccaaaaattcggaccattcccggaaatttactctccaggaattgggcaaaaatccaagagatacggaacagtccacaattctacccttattggttagaccttgaatgtgcgaccccttacttacctttcattgtaactcacccttagggaccctgaatggttgcataacgcctaaaatcgtgggatcgccaatttcccaaaattataaaaatcactaaccttg

SEQ ID NO: 699759 - DNA, 119 bp, Homo sapiens
atgctcacctgggggtgtgggtgctgttacatgctgtcagatgctcacctgtgggtgtgggtgctgttccaggctgtcagatgctcacctggggttgcgcgtgctgttccaggctgtca

SEQ ID NO: 699760 - DNA, 100 bp, Homo sapiens
ctgttattagtgaggagttgaacagctcgatggggacaataaatacgacgctggggaacatggcttacaggaagcacgagaaaggtgtgaaattcctaac

SEQ ID NO: 699761 - DNA, 702 bp, Homo sapiens
gggaagggagaggattgaaccccggtcgggtctcttacctggccgtgtggcggtacctctgatgaagccacgcatcatgcttgacctgtaggcacatcctatacctgcggacttgtggtttaagaaagaacgctgaccttatctatgcctcaaaggtcttcagccactggataccatatgatgtttcactagatggggaaaatgacaccacatcttaagcatctcaaggaatactactgtttaagacaggtgctgttcaatgaatggactcaggttgctgttagaggttcagacaattggtgtgacgcatactgaaatagaactgataacgtagcttgaatatgtgtctgaagtgaaacgtgcactagcacacgcactaatcattcgtagccgccgtcttcatatccacagcctatgcactcattccttaattattcgtgaagactgctgatgcgtttaagaagctcccaacagtatcttgcatagtcacaggagcgttttcaaacattatgtaatgaggttttttgctctcatgattaatacttgcatgatttaaatgcgtcgtttaacgttgaccacacctggattactaagataacgctctgatactttgtaggtctgacaaaacctgcgagagcccacgtccttaaagtattttaaagagtttaagttccaagcttatattccttttggattacgtct

SEQ ID NO: 699762 - DNA, 453 bp, Homo sapiens
gcaacatgaacgtgacagctcaacggcttccacgacgcgtcatcgaggagggcacatccttttcacctcagaagtcgcgtcggggaaggccgaccagcataatgatttgtgaccgaaatcagtgatgcgtgtccttgatgcccacttcagcaggatcctgatgccagaagtagcttgtgaaactgttgcttataactggaatgatccttcttgctcggggaacattacactccatgaggctgctgtagagctacctaggaaaagtggttcggtgaacgctgttaaatcagcattggatagtgatgattcttccaaaggttttgactagctgagacttgtaagcggtgcttggtagccttggagcaagcagtcaccagaatatttgctcacgggtgttcatcttgacagacacctgaacacgacattggtgctggagaccaggcattaatgttg

SEQ ID NO: 699763 - DNA, 138 bp, Homo sapiens
atttgtgactgacgactgttcaacggtgtggtatttggatatagcttgggagatctaataatagttcagttgagctcctattattacttgagctcccgaaatctgagtagtattttcaattctgagtgatagtacaga

SEQ ID NO: 699764 - DNA, 167 bp, Homo sapiens
tgtgtggggtacttagaggatccaatgcagcggactggcatatagtggcaggtctggaggagctggggtaccagctggcacaggagcaggtggcatggcacctctgttgtttatgcccatagcacctcccatagccatctgacccatccggaatctccgtgctctct

SEQ ID NO: 699765 - DNA, 238 bp, Homo sapiens
aatcagtttacacaacgtacttagcatgtcacacgcgtctgtatttcagtacacagtaacatgctgtgcaggtttgtagcctagcagcaataggctataccagatagcctaggtgtgtagtaggctagactgtataggtttgtgtaagtcactctatgatgtttgcacaacgacgaagtcacctgacgaaggatttctcggtctgtatccctgtcattattagttgtgtaaactgatt

SEQ ID NO: 699766 - DNA, 250 bp, Homo sapiens
agtagattttagcacctaggctataggaggcaggggtaaagtagaccaggctatagcttgtaggaagtaaatagggccaccagggtttaggggaaatacaccatacccgacggatagctagtgacctaccctatctacgagagatatgcaggcagtagccacggagaggagggaggctgacctagcgaaagctaaggaatacaagagggcactagtagatacctacgccgcatacgcttactactatata

SEQ ID NO: 699767 - DNA, 306 bp, Homo sapiens
ggcccccccccccccgggcgttttcctgggtttttattgtccccacccaggagagttgcattttcccgttgattggggcgtgggcccttgccccccccctgggttcctttggttctttgccagtgtgggggattttttccctttgatttccccgctccccgggcggcccaggggctcccttcctttgtattcccctcccccccggccctgttgtttgggccttttaaaccccacctttggcaaaacctttttttttttttttcccccattttttttttaaggggggttttaaaggaatttttttta

SEQ ID NO: 699768 - DNA, 499 bp, Homo sapiens
  misc_feature (98)..(98): n is a, c, g, or t
gggccattaggcgagtctgcgtatagacgcgtcagaattttttttaaccaaatatttaggaaatgacatcaatatggggtttgagatagtctcgcttngttgcccaggctggagtgcggtgacgcgatctcggtgatactggcaggaggcagctgaatgccaggcagatggggcgggttcccggtgaaacccacctccaagccaaagacagtttaaagcctgacagctgagctacaagttaaatcctcagactagatgaagaacttgccttcctgtttgccacactttcctctgattgatccccatccttcacctattttacacatacctaccctttcctaatttttatttttgaggtggggtctcgctctgtttgcccaggctggagtgcagtggtgtgacctcagttcactgcaatctctgcctcccgggttcaagcgattcttctgcttcagcctcccaagtcactgggactacaggcacgcagaacgcgcctaat

SEQ ID NO: 699769 - DNA, 260 bp, Homo sapiens
gagctgcctctcataactgcctcatactttagctcaataggtgtatcttgaaactagatttcctttattagcagtgcatagaagtatctcaatacatgtgtcattactttaagctataccttcccaaaaacaataaaaagtttaagactaaaaactgtcatttatttataaaatatcaaataaggcctctgactgaaaaaaagaaatctatattatgtttgggccattagcccttttctattcaatctgtcaatcataat

SEQ ID NO: 699770 - DNA, 477 bp, Homo sapiens
ggacccatcaaggaagaaattttgaaggcaaagctttggcccttatgccggtggagaccataactttccaaaccacgaaaccaagggtggctaagccggtcccagcaccagcagtagctatggcagtggcagaagattttaattaggaaacaaagcttagcaggagaggagagccagagaagtgacagggaagctacaggttacaccagatttgtgaactcagccaagcacagtggtggcagggcctagctgctacaaaaaagacatgttttagccaaatactcatgtgtatgggcaaaaaactcgaggactgtatttgtgactaattgtataccaggttattttagtttctgttctgtggaaagtgtaaagcattccaacaaagggttttaattagatttttttttttgccccccatgctgttgattgctaaatgtaccagtctgatcgtcacgctgaataaatgtctttttttta

SEQ ID NO: 699771 - DNA, 448 bp, Homo sapiens
gtagccccgtcctgctacctactccacgccgcgtcacggcgcgaccacgcttacccgagattcaaatgtgcaagcctttctctgaaacgcttgccataactcgagcttataggggaagaaaaagctatcgtttacaatgatatcaccattaaggcaactgctacaccctgctttgtattctgggctaagattcattaaaaactagctgctcttaacttactgggtaactctgtgtccatctcaataaccaaaggaaggtgggcatggtggctcacgcctgtaatcccagcactttgggaggccgaggcgggtggatcactcgaggtcaggagttccagaccagcctgcccggcgtggtgaagccctgtctgtcactagaaatccacaaattaggcaagcatggcggctggcacctgtaggcccagctacttgggaggctgaggcagga

SEQ ID NO: 699772 - DNA, 531 bp, Homo sapiens
  misc_feature (126)..(126): n is a, c, g, or t
  misc_feature (148)..(148): n is a, c, g, or t
atgcacatcctcagctcaactctgaacttgaacacagcagttcgcagtacatgccgctctgcagagaacagcaaccatcgacccaacccctacaccccttccctcaccactgcaaaaacttgagcncacgattggctggtacccatcntcaagggaggccgtttctaccaggtccctgtacacctaccccgacccgccgccgcttcctacccatgaagtggatgatcactcagtgccgggataacaaccaccagcgcacactgatgccggagcagctgtcccacaagctgccggaggctttccataaccagggccccgccacccagagcaagcctgacttgcacaagatggcagcaggccaaccgtgccctggcccactaccgctggtggtagactctccacgcggcgccccgggccctctgccgcacgaaacagtgtcagctactcccacgctgaaaactacctgtgggtcaaggatgtagttccttcgtcagcgtggcaggcctcgtacgaaagatgccgcagcatatt

SEQ ID NO: 699773 - DNA, 471 bp, Homo sapiens
tagctgaacgatctgtgagttagatgctaggtgatctgctgctctttcctctgtgtgttaccatagctgccagaaaacacaggctgaacctgatctctcgttgcagtgcatttcattcttaacagttagttgcatgaaggaaatggggtcatcaggctgtactgtcacattcctcttttcagattctttcttttgggataatttctcttcttctagtttagcagataacatgtgagaaagggactgtctgcattccttattgaaaatgtcattcattaaaggtgaacattcagacaagaccttgaggcacagggaaattcgatccacatcatcatcagtaattggcttcttaggaagagaggattttcccaaatgcaggatagtagccatgagcaacatagcctcagcaacaaaagaattttgctttttcttctcctgaaccaaagctacatagcgcaatgcaatcttggt

SEQ ID NO: 699774 - DNA, 554 bp, Homo sapiens
gaggatccgtgatacaccagcgaacaagcgtgtcttcgataccaagtgtcttcctgtgtgtggacagataatgaagataaaattactactgagaaaaggaaacttggagattattgagcccgtattttgagaccaattggaaacaccggccatccttcccagatgttcctggggaaattggttggattggtattggtctaaaagtcccccaaatcttaatcagagggatggatggttattatttggcaccaggaatggctctaagtctacagatagccccgtctggtatacgttctacttcactggaccggaacaccttggaaaatatgcttgtacggggttctatctagtaaacgatatttatgaatacaagacaattatgaactggatgaaggacacagactaagaaggaacgtttgctgaagccaatcgggataaaacagcattagatagtcatgctgctagatctttatcatgggaaacatttcaagttaactccttcagtaaagaggtaggtagcagagtacccacgctggagtatccgggaaccgagc

SEQ ID NO: 699775 - DNA, 101 bp, Homo sapiens
  misc_feature (47)..(47): n is a, c, g, or t
cttgagtatgtgcatcccctacaagatgatcgtcttgctcctggcangaccacgtatggatgacatctgaacagaaccttggggtgccagcattagcctgg

SEQ ID NO: 699776 - DNA, 358 bp, Homo sapiens
ccacaaaccttctcgacattgttttgctggagctggtggctggccttcctgaggggtacatgttcatatggaatggagaggtgtcacccaacctttttgatgaaatcgacaaggatggccacggagaaggcctcctggaagagttctcagagtacattcacgcccaggtggcatctggcaaagggaaactcgctcctgtcttcgatgctgagctgattgcgaagaatatgttcaccaaccaggaccggaatgcagatgggaagttcacagccgaggattataaactcaaagaccaggatgccaaacacgatgaactctaaacctggcatgaactagatggtgccaggggagtacgtga

SEQ ID NO: 699777 - DNA, 335 bp, Homo sapiens
ccgctcggccgggctacctagcctctctatcactgtgctggtgcaggacggctcccgtgcgattgacgcagcccaagaaaacttgggtaatataacttggaccctctcactaaagtctcacaccctgacgtgggacgctatttctcagagctttactggcactcactacatcccaaacgcacagtctggagatccggtatccagtaaaatctggcagtttgtctatgaaacggtgcagaatatttagcagtgcacagaaagagaacctagatgagtaaagtctagagaggacattgcacctttgctgctgctgctatcttccaagagaacgggac

SEQ ID NO: 699778 - DNA, 316 bp, Homo sapiens
gtgaatattccagagagcaaacagctgtcagcacagagtgacttgtctctacaatgaaacaaaattaaaaaattagccaggcatggtggtctgtgcctgtagttcccagctactcgggtggctgaggcgggaggattgcgtgagcctgggagtttgattgctacagtgagccatggtctcacccacagcacttcagcctgggacagagcacgactctgtctcaaaaacaaagaaaacaaacaaaaacccttagcatggaaaatactatttgtgtggcacacactcatctggtaaaactagctgacgcgttgggacc

SEQ ID NO: 699779 - DNA, 325 bp, Homo sapiens
gtctctcggccttagcgccatttttttgtgaaacctgctgcgccatgagagccaagtggcggaagaagcgagatgctgcaggctgaagcgcccaaagaagaaagatgaggcacaggtccagatgtaaaccgctagcttgtaggcaccgtggaggccaccaggagcagaacacgtggaatgccagacgctggggatgcttggtacaagtcgtgggacttgcatgctacgtgtctagagcttgtctcatgtggatctaggaacttcaatcggccctctgatccgccgatcaccgtctgagatccaccttgctcatagacaataggcc

SEQ ID NO: 699780 - DNA, 106 bp, Homo sapiens
gcgttattgatacctctcgctgcacccactctgtcagttacctggctggtgatctgtgactgctcttcttttgtctgactcttgatgcactgctggctgctgactt

SEQ ID NO: 699781 - DNA, 229 bp, Homo sapiens
ttttaaaaaaaatgttttttttttttgggttggtaaagcaggttctttgtcttaaacatttaaatgccccttgaaagcaaaaacaaatggtggggttccagagtaaactgctaattttttatctttgggggatgaaaaaaacaattattttgacttttttccttggacattgccccttgatttttttatgcccggcctttaaattgaaaataaacccaataaaaatcca

SEQ ID NO: 699782 - DNA, 411 bp, Homo sapiens
  misc_feature (11)..(11): n is a, c, g, or t
  misc_feature (19)..(19): n is a, c, g, or t
  misc_feature (38)..(38): n is a, c, g, or t
  misc_feature (45)..(45): n is a, c, g, or t
  misc_feature (403)..(403): n is a, c, g, or t
ccaaacctttnaacggggnaagggcctctgtacccagnggtactnagcttaaaaactagccctactttgagggcccttgaatgggttaactgcttttaccttcccactagcctagtgaattcccgaaactttttcatgatgaagtgccccatttattgggcccaggtgtgttggctcaagcctgtaatcccagcactttgggaggcaaaagtgggcagatcacctgatcccaggagttcaagaccagcctgggcaacgtggcaaaacgccgtctctacaaaaaatacaaaaattagctggtcatggtggtacatgcctgtagtccccgttactcaggagaccaaggtgagaggatcactttagcccaggagggtagaggttgcagtgagccaagatcggtacntactgcac

SEQ ID NO: 699783 - DNA, 1478 bp, Homo sapiens
ggccaggctggtctccatcatcctgacctcgctgattcacccgcctcggcctcccaaagtgctggcgcattacaggcgtgagtcacagcccccggacataatttagcactttacaaaaataatagccatgttgggccgggcgtggtggctcatgccatgtaatctgagcacatttgggagaccaaggcgggtggactcccttgtccccaggaggttcaacgaccagcgatgggacaacgatggccgaacaaccccacttctctacatacgtaagctcacaacaacaccttcacgctggagcgcagacgggagataaggcccgacgattcccagggctgatacccggaggcgccaatataagcaaggagaagcacagacgtccgatgtgcaaagaaatggaatctataacacgacgaactttgaagcgtcgcgccttatgtcaccctgtgtaacggcaatggagaacacattcacccgagccacgcacatgcaccacaccgcgccctagccactgacaccgaaaggaactcactcgacatcttcacaataaacatgtaacccctctccgccgttccacatccattcacccaagattggtagcaccccttagacgtggctcaaaccctacaacccagtccacaaattaaatcaactgcgttataagaacaaccgcaaccacaacttccgggacacacaacgcacaaacttacttgatcaacgcacattctggaggatcacaaacttcgaagcgacttgactggagcaaacctcgggcatattggtacactcactcgaagcaagccaacgtcaccctaggcgctactcaaccaacgcccaagaaccaataacccaatgccatcccgcctcccactgccacacacgtcttccccgcgtttaagtggcaaacatactaaaccccaagcagatcacatacagcgaaagccgaccctccatataaacgaaccaacggcaaacagagattacagacataaaactacacataggcccgttgatgcgcttctcaccgaaacacccaaaacacgtatcaggcacgaaccatatcatcgcgggctcaacatcctcggcacctccgcatctacaatctcatacggacggttaaccacctgtcttcttttacgcaccacacataattcttagtagccgatcaatcacgaatcccctgcactctaccatgcatgatggatactttcactatatgactaacacccccaagtgacattagaatgtaaaccactactgcaacaaatgcccccactagatatctaataacacactcattatgatgcaaacacgaaccaatgtacactaaaacactatattataggatctacagattaaccttatggtatacacaacatcacacatagctatcacacatatcccagcccaacaacttcatcacccacagaagcaaaagtgaatctgttaacaccattaaattatacaaaatcaaggaa

SEQ ID NO: 699784 - DNA, 358 bp, Homo sapiens
gaagttgcctctgcagcggtgcaggatgcccttgtgcggctacagccgccgattttcttgcgctacccctctcatgtggtcaacccaattcccgtcaatggcgccgccgtggagatcccgtggtacgcctggcgccaacccaccgacaagattatgttgatcatgcgttatgaggtgccgggcagccacgaccttatcatttacgatgactccttcacggtcggccaggtgcccgagggggtgccgatcagacgcctgattccgtatgacgggctgttgaaattcaatggcacgacgccggacctttactacgtttatgaatccgcaaacattctggccagcagcagggacccactcg

SEQ ID NO: 699785 - DNA, 370 bp, Homo sapiens
acccagctctttttcagcagcacaggcatgcaggcacaattcaagcagttggcaacacaacaccaattgcaaccaacatccaacacaccccagtggccatgcacagcacacagcaccaggcaccattccacaaccagcatcacactctcgcatcatatttctccacagcaacaccacaacagtctccagcagacctctcaatcatcagcacaccatggccagtgcaccacagccatgcatttcatcctcaacagctggcaaaccggcacacagcattcagtcgcaccaggccatcacaccagcagcgcagcacacgggcagcatttcaaacttctcaacatgcacccagcaatcatcatcttttcacact

SEQ ID NO: 699786 - DNA, 149 bp, Homo sapiens
ctcgtcgagaaggggcagatccgtccgacgatgacccgccatatcgagggtctgacaacccagcatgtgcgtgaggccaccgcagccgtcgagtccggcaccatgatcggaaaagtcgtcattacgctgtgatccttcgataacatact

SEQ ID NO: 699787 - DNA, 419 bp, Homo sapiens
ggtagaacattcattagattgtgttttccagttttgttttttggtggtgctgagtatcaaagccaaccaaggcctcatacatgctaggcaagtgttctgtttctgagctagatcccaaggctagctctgttcatcataggacatcttgatgtatattccccaacattgattgtcagttgttttattcagaaagtatttttgtacctgttatacagtgttggggacatattagtgaatgaagtctcttccttcatgaaataaactcttccttgagtagccagatcattaggtggtttgtaactaagaacaataggaataataataaagcatgcaggagatgaagactgaatgggggttggctggaaaagccactgtagacagtatagttaagattttatttttatttataaaaaaaaaaa

SEQ ID NO: 699788 - DNA, 669 bp, Homo sapiens
  misc_feature (106)..(106): n is a, c, g, or t
  misc_feature (109)..(109): n is a, c, g, or t
  misc_feature (111)..(112): n is a, c, g, or t
  misc_feature (115)..(115): n is a, c, g, or t
  misc_feature (121)..(121): n is a, c, g, or t
  misc_feature (139)..(139): n is a, c, g, or t
  misc_feature (142)..(142): n is a, c, g, or t
  misc_feature (147)..(147): n is a, c, g, or t
  misc_feature (306)..(306): n is a, c, g, or t
  misc_feature (437)..(437): n is a, c, g, or t
agcagaatctgttgagttgctgccacaaacaatacaattatttgaacccccctcccccccagcacaacccccccggaagaggaggaggagaaggggagtgagcggncgncnncanggcggngatccaggagctggcggncgncgatncgatggagaaggcagggcccgggccgtggggaggcgggggcgcgggggcgggggcgcgagcgtggagcggggaccggcggtgggggggcgggctgggggctggggggtcggctggggggggcgggggggggggggggggggggggggacgagagggggngcggacgatgggggagagtggagcggggcggggggtacgggagagcgggtggagcggggagggggcggggggtgacgggggggcgggagcacgcgggggggacgggggagcggctgcgtagggtggcgggngtggcagcggctgacggggggggggatggtgggaggaggcggagggagggggtgcacgggcgtgggggaaccggggggtggcgcgagtgggagggggaggggggggtaggcggagggggacggagggaggggggcgggtgggagggtaggggcggatgaccggggggggggtgggtggggggggtggaggggggcggcgagcgggggggcgggggggggggggggggggggg

SEQ ID NO: 699789 - DNA, 372 bp, Homo sapiens
  misc_feature (106)..(106): n is a, c, g, or t
  misc_feature (109)..(109): n is a, c, g, or t
  misc_feature (111)..(112): n is a, c, g, or t
  misc_feature (115)..(115): n is a, c, g, or t
  misc_feature (121)..(121): n is a, c, g, or t
  misc_feature (139)..(139): n is a, c, g, or t
  misc_feature (142)..(142): n is a, c, g, or t
  misc_feature (147)..(147): n is a, c, g, or t
agcagaatctgttgagttgctgccacaaacaatacaattatttgaacccccctcccccccagcacaacccccccggaagaggaggaggagaaggggagtgagcggncgncnncanggcggngatccaggagctggcggncgncgatncgatggagaaggtgggacccagaccagcaggtgacaggaccctcgaagctgacgcctcgatatggagcataagccggagtggcgcagcacgctgccgccttacccattacggagggaccagactggccactcgtagtaggagtgagactgtctgatagccccacccttcttgagactggagctggagcttgcataccacagactggggcgctggttgctccttgg

SEQ ID NO: 699790 - DNA, 652 bp, Homo sapiens
gagcgggctcgtctgcgcttccttctccctctctccagacgtcgtggtcgattcggatcctatgtcgcgccgggccctccggaggctgagcgtgggaacagcgctgccaggagtcccgtcgggtgccggcgcctttcatttcgatctccgtgagtgacgagtgacagcggaaaaagaagggcccaagcggtgagcttggtgtccggcgatccctgggggcgcagggaacggaggagcgtccgagtcaacaagcgcttcgagctgattaacacattgacgagtcttgagagatgagcccgtgatggttgaagcgggcgtcgacggtcttggcctgtgctgctcacaaggacgcttgtgtgcacccagggacacaacacgcgacaggggtcacgccgtggcaaaacacaggagagcaaagacggatggacgatgaccaccgagcacagtggccactccagcaggcaggtctcatgcaacgttgcgccacactccgggacagcaagaaccaaaaaacaacccgaaacccaccacagaacaacgccgcaccgggcagaacgcatcggcaacacggacctagaacgctatctggagcgcatcctagaccaggattgcggacaaggcactgggttgaaccgccccgggccccctcccc

SEQ ID NO: 699791 - DNA, 313 bp, Homo sapiens
  misc_feature (288)..(288): n is a, c, g, or t
tgtttatcgattgccacgacgagtactgagggcctgtggggtgtgccttgaagcctataggacgcgggcccgtcctggtgcctgccgcgaaggtgcaagcatcttgcgatgttacgtagacaaagtatctcaagatcgagtagatctttgatacggccgcaaggtggaccagaggcgttccaatgtcgaagccagcacgattgacacgtcggtgtcaagttcggtgtcactcgaggacgagtgggcggacgccgcctgattctctgatatggtgagcgaggactgcantgtgccataccgatttggcgccatt

SEQ ID NO: 699792 - DNA, 151 bp, Homo sapiens
acctccgctggttgcaagtaggagcaggctgcgcgaactccaacctgcttgatatgtgtgagttctcgccttctgacgcaggtcctgtccacggcagatgggcagctaggctcccagcagatggcagcttcacatcgtgatgagagctcga

SEQ ID NO: 699793 - DNA, 103 bp, Homo sapiens
cccgcagaagatgcgtttcggtcaagatggcatgacgacgctcgtttccgtaaccgactccttggttcactaatcatgtggccgaaaacggcatcttcatcgg

SEQ ID NO: 699794 - DNA, 883 bp, Homo sapiens
gcagctgcggggagccgcaatgaggcgcctggcggagctgacggtggacgagttcctacgcttctgggcctttgactacctgagtcctgaactcctgatgtcctgaaaattctccacaatgctggcagacatcggtgaatgcactgctgaggtctgcccgtgatgtcctgtgataatgcctgggctgtggagcccctcggccagcctggctgtaaatggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccatgatgtgctggaggaagccagtgaggaggaggatggagcgcgaggacaggagaacatggggacagacgtccccagagcggcctgcccgggcgcaacgaagcacttctgcccctgtgcaccgctcgccatggcccgcacacgacggcaccaggcagccaaccgcaacgcctcactccaaagctgcacccatgcaactgcgcacaggccgtacccgagcagcctgtggccaaccacccgacggcggaccacgcaccgtgcctgatgccaacaaataccaggtcccggacagcgctgccatacaatgctctgcgtcaccttctgcatcagaacacctcattggcctgtctacacgaacccgccgctcggcccgcgcgcccacggcaaaccacccaggtcctcgaccccctgccaatcatgcctagctctaagacgaccaccctcgtccccatccctcgctcacctcggctctgccaatcaacctcggtgcttatgccccaacctctccccgcccag

SEQ ID NO: 699795 - DNA, 426 bp, Homo sapiens
tccgctagccaaaggattgtaaacgcaccaatcagcactctgtgtctagctgaaggtttgtaaacacaacaatcggcattctctcaaattggaccaatcagctctctgtaaaatggaccaatcagcaggatgtgggtggggccagataaaggaataaaagcaggccacctcagccagcaacagcaacttttcatgctgtggaagcttagttcctttgttcttcctgctaaatgttgctgctgttgactctttgggtccgtgccgcctttgagagctgtaacactcaccacgaaggtctgaagcttcactcctaaagccagcgagactaggaacccaccaggagggaggaacaactccagacgggaggaacgaacaactccggaggcgccacctttatgagctgtacctcaccgtagctgtacctca

SEQ ID NO: 699796 - DNA, 211 bp, Homo sapiens
atcacaccactgcacacctgtcctgggcaatcaaagcgcaaccctgtcaaaaaaaaaaaaaaaaaaaactacccatgaggaaaatttgtttttgcgattaccactataaatttctttagaaaatttttaataaaggcgtagggagattaaatttggcttcctcgggcatttttcaccccaatatggtccccccgtattgtgatggcgttcc

SEQ ID NO: 699797 - DNA, 135 bp, Homo sapiens
cacttagaaataccctatgcctttgtagctgtcatggtgcatttgtctttggaaaattcagattatggtatttagtgtatatgtgattttcaaatatgtcaactttaacttccactttgtataaatttttaagtg

SEQ ID NO: 699798 - DNA, 431 bp, Homo sapiens
cattgagcccctggagtgccacagtgttgcgtttggaagctcggagagtcctagtgtcacatgccagcgctggtgactgggcacagctgtgtgtgtatatgagaaaggagggttcagtctctggtgtcattgactgcccgctctctgctggattcctactttgcccgtaaaacctgtgagatatctcgaatgctagatgggctgctttccaattggaaacctggctagatcccaagatcagccagtctccaaaagacctgttcgtcccagcctgcctagaaatcaggagagtatgccaggctgcaggcatcgggggctggcacctggtgtgtggaccctgcatcaggagaagagttgccgcctggctcgagcagcagtgcccagtgcccaagcctctgcaatgtgctcaatagtggagtcctctccaggag

SEQ ID NO: 699799 - DNA, 270 bp, Homo sapiens
  misc_feature (5)..(5): n is a, c, g, or t
gagtncgtatcactccaatgcctgggtctgacaggacggcgggccaaagaggggggctgctaaggacggccccaggacccacagtgtggcctctggagctgtgtcttaactcttgcttgccgatcaatcccatgctctgaaatgcgcacactctggctccttagtagatgccataggtgggctcatgattgtccctgtaccggtccaggtaagcgcaggggttgccggtgttgaaagcgcttttatgtttggggtgataaggggggtggc

SEQ ID NO: 699800 - DNA, 414 bp, Homo sapiens
atgtcccccataaggggctcatggtctcaacagagtgtatatccagtaggttatttagttaaggtgtagtgatagtttaaaataaccccactctttccatagaaagttagcaagatctttcttttcatttgtgcttggttctacttattctgtagaaagttggggtcatgttgaactgccctggctaaaataccagtcctctttaaatgtctaattcctgagaaagctgggtaagatggcagaacagtaacaataggactcagggtcgggcttgtcttttctgccctgggattcttaccatttctggccatctttgaccaggaagtcaaagctccttttatttatttgtagtccaagctctttttcatggctgatttagtaatgatttttaaagatcatcagatccccattaga

SEQ ID NO: 699801 - DNA, 256 bp, Homo sapiens
tactttcacagggggagcacttacttctgtgaatttctatcccttcactttcctagaggttcatatactgcttgttcctcatagacttggtcatgttagcatcagtctgtatcactggctgcgatctttcatcttctactactggttcactgtgaatctggtattttccatggcttcagactagtcaatcttcttccagtaatccctgatgttactagatctatgttgcaaaccctgctcgtcttccacgttggtt

SEQ ID NO: 699802 - DNA, 339 bp, Homo sapiens
tgcatgagctgaatctcgcattgcactccagctggtgacagagcgagactccatctcaaaaaataccatactcaaagaaaagaaattgaccctaagaaggtgtcccagaactctctggagcattggtttgaggtagaattaccaaattcccagagtgccgaattgttctgccccgtggggctttagagccatgcacgctggaagtcccgccatttttgcaccttttgggccaccagcgtcaagggcccatcctcatttctctgcgtgggggggggtggctggttcctttgaggcccagaggtcatggtaagggtcacactcattcacttgcttcccgtc

SEQ ID NO: 699803 - DNA, 216 bp, Homo sapiens
  misc_feature (116)..(116): n is a, c, g, or t
tatgttatcccaacactgaggaagcactcctttaaggcagggtgaagggtgaagcctagtgtcatgtgccaggttagctgagcctcgtgtgaaatgtagagtcggtgccgacgtgnctcgacttgcgccctctgaccacatttgcagatggcgccttttcagggcagggtttggggcgataaaacacgtggttaccgagcctcgaaattcggtaaa

SEQ ID NO: 699804 - DNA, 778 bp, Homo sapiens
gagccgagagagcgcctggtcggtggccagcacagagcggctacacagaacattgtggtgctgtctgctgctagcgtgacgtgcgacattaccatctatgattgccaatggacgtgcgacgccactactgtacgctgctgcgcgtggaaccagcgatgaaactgcgattgaggccttgctggtcctgaggcgcttgatcatcaccatcgcgaaaggtgcgaactctggtcgtacgaactcctggatggtagccttggccgttgcgtcccatggggcaatacccggtaaagttgcataacaggatgagtcgaagaaccatgattccttcaatgctcttccagcagtcaagctggttgcccgttgtgcctgatgtgacgggcctgcctgtgctcgcgtagcgaacgatcatcgaaagctctagggggagacagtaattcgcgtcagatgaaaagacactcgtgcggcagcgactctaagatactagacatttcaaaccataggggaaaactgacctgcgaaccatgagatagagtgaagcgaagcgaagacacccttttcccatatccgtagaaccctcaataaaagaactatcggtggttgctcgacaaagaaaacaattagatcctttaagaaagtattcaaaaaaatcccagcaaagtagacctcgtaaaacacgcgaagtaaacgagggtggttaccgtgaatgatatcctggttgcctatcaatatgagcgctcaacaaatactccaccaaggcacaacctattgctgttactag

SEQ ID NO: 699805 - DNA, 92 bp, Homo sapiens
ggaaaattggcatgaccctgttaaatgtaagtggttaaagaaatggattaaaaagtgtgatgatgacagggaaacctccaattgggttggag

SEQ ID NO: 699806 - DNA, 374 bp, Homo sapiens
tctagaggatcccggtcatcttgctacaccaggcttgctgcttcaccttgcaactttttttttttaatagtatttattgatcattcttgggtgttctcggagagggggatttggcaggtcataggacaatagtggagggaaggtcagcagataaacatgtgaacaagggtctctggtttccctaggcagaggaccctgcggccttccgcagtgtttgtgtccctgggtacttgagattagggagtggtgatgactcttaacgagcatgctgccttcaagcatctgtttaacaaagcacatcttgcaccgccctttatccatttaaccctgagtggacacagcacatgtttcagagagcacgtgtagaacttgaa

SEQ ID NO: 699807 - DNA, 506 bp, Homo sapiens
  misc_feature (198)..(198): n is a, c, g, or t
  misc_feature (209)..(209): n is a, c, g, or t
  misc_feature (480)..(480): n is a, c, g, or t
  misc_feature (506)..(506): n is a, c, g, or t
aagggctaaaagccaaaggaggacacacatcaggaggtcattgtgttcatgtttagaggagaaacaaggactacttaagcaaaagaagtagggctgcagaggagcaggggaagacacatctttgggaaaagtagaaatttgtattcttacagaagatgagagtgttaagaccactgttccacgccgtcagaactcatntgagcattatntgaagcaactatgccgtcacttggggaagatgcctcataaccctaacagaggcctgactgaagtgcgaacgctgatctaaacaaagcagtcaggaacacgctggctaggattctcctgacctcttcttttgttgccatagttacctttatcaataaatgtccaaagatgtaaccgaggcattgttgtcatagttcattggatggcaacaaactgttattgaataaattagtgtcccaattaagagtctttcctatttttcagcacctttcnaatctgtaacaggtatttcctttcan

SEQ ID NO: 699808 - DNA, 467 bp, Homo sapiens
  misc_feature (30)..(30): n is a, c, g, or t
  misc_feature (175)..(175): n is a, c, g, or t
  misc_feature (185)..(185): n is a, c, g, or t
  misc_feature (243)..(243): n is a, c, g, or t
  misc_feature (316)..(316): n is a, c, g, or t
  misc_feature (414)..(414): n is a, c, g, or t
  misc_feature (451)..(451): n is a, c, g, or t
ttttgttccctcaaatacagttcttaaggnagattagttacaaatagttgtcagtactttcaaatgacagaaaaaattacattttagtaaaactggatgaatttttcatgtgtgaaataacaatcctttcaccaccaggtgggattactcccgttcatgccatagataactatgncatttttaanaactgccctaatttttctagttgcgatttcatgccttttgtaagtcaaaacatcgttntgttcccgcgctcccctccccctccctgggaagtggcgggggcacccctggtttctctgggacaccactgggnccctgcttagcgagcttttgtctcagtgctttcctcttgctgcgccggtcccccgggggtgttgggttcagggggagtggctctggttgcctatgggngaatactacaccaggggttacgcggggtgggggcccngggggtgggcgggggg

SEQ ID NO: 699809 - DNA, 377 bp, Homo sapiens
tgtttacagcgtcggggcgcgggttagggtacgtggtgtcaggcctggactgtgggctggggccggtcagtccctgtagccggggcgcccctagagactgaccccccgagagcacatggagagggtgtcctggatcctggcctgcctggcccagcgtgtggatggtgcacgtgtggctccaacctggcaaccgatcaggtcctaggtaaccccgagcaggctgtgggggatctgtgtagcctggttgccgttcaggtacctatgtaaccccgagcaggcttgtgtggaatcgtgggatcctgggggccgatcagatcctagttaaccccaagcaggctgttaaggagattgtagagagcctaggggcaagcacaggt

SEQ ID NO: 699810 - DNA, 224 bp, Homo sapiens
  misc_feature (138)..(138): n is a, c, g, or t
cccaaagcgcggccgggaagcctaacggttaacatttttgggggcccctaattatggcacctattgggaggcgcccccctaggaatatcacccattacccttcccttaacatttttttttttcccaattttaattttncgggctatcctagaaatgggggtggccttaatccaagccaaggttttcccatttttggtaggcctctcccggccggcccccccata

SEQ ID NO: 699811 - DNA, 581 bp, Homo sapiens
tggccctgccccgttaggagccgcgagtaagtgcgagtgtcaacgcctgagctggctgacagagcccgtgccgcggcctccgcgggcccagggtgcctccatggcccctgtgaccacctggaccgagcaccctgtgaacggccccagcttggcctcgggacagtcctgcgctgctcacctgactccctaggtgaactgcctgctttggcctgcacgccgccgcctgcaggacccactgaagaagcgggaaaccgggctgcaaggaccctggtcccccctggctgccggaatgtaggtaaggaaaaacaaagaactgattgaccaaggagaatttgttgtcgagcctgattgcaccggagttcccagcccgagggaaaacatttggacgaggaacgcggaggagattccaacaaggtttgggcttgattgcccaaggattattttattggagccgaacttggcctttgcgccattgttgaaccagctagttattgaacttgccacgaagcgaaagcggagttcccaagcttatttcccaaatccaaaaaattgcccaagggcaacctttcctttcccggacg

SEQ ID NO: 699812 - DNA, 1123 bp, Homo sapiens
acgttggggcgaccagtggggtcgctcgctgtgttcctcatgtgacctgcgcgctgctccctcgcggtggtatactcgccgcgtgtattcctttgcgccgggccctcgttgtcccattgcccccttttttgggcccacttatagccacggtttcgccctaaactccgggttgttcccgtgctggtgttttcccccgggattttggtcgtccacacgtgtttcgccccacagggttcctactgtacccggcgctttcttgtggggctcttggccgccgcgctgtgccctggccgggacccatgttgcgtcgttccggggacgacctgccctcgtccgcggcttccaggcacggagttttccccctaggaccatccacggagcaccatgggtgaacctgggaccaagtactcggggcttcgtggtgcatccgtcaccaacgtggcctccccgtgaggccagtccggaggttactcacctcagctcgtcgaacctgcacgtcccgatacgcctgaggtttggttttcggatcctggccttcccgtgtatacccgttcgggaaaccacggagccccggggagtttaccgatagagaattcacacagagtttcgcccccggggctacacacgttccaatttcgataatagtttcagcccaagattctcggcgttgaaccgcggggacgtacgccccacccccttgtgggaaattggattgaagattccaaacccacagggcacagggcacttcctctgggagaatagccctctcacaagttggagaactttccgcccaagtttccttcattcgacacagaacggctgcgtggtgaagcgctatcggagcccactggaaggagcccctggtgataagagaaggacctgccccacctatttctagctccacacacaagtgtgtggccccgcccgaggcccctgcccaccgcccttggaggccttccacccggcacctcactgacggcctgcctgcacaacctgctggtggggcacgacccggaaatccacgcgtgcacccccgcccggagggaaggtcccctggcctgctgggcttggctcggcgcccccaacccctggctaccttgtgggaataaacagaccaattaga

SEQ ID NO: 699813 - DNA, 715 bp, Homo sapiens
tattccttctaaacatatttttttttaaaaaataaccccccaatccggggtataaaaccaaagcaaaggccctgggggtgtggggggtggagggagtggcccccagaaggccaaaacgtgagagtggcccgggcacaccggtggttgccccaccaaaagtggagccgtagagactcccccaaacagcagggacaggaaggcgagaaagtgccaagaggcataagtgcgggcccagtacaccccgagtggtggcccccctcacccacaggtgtgtggcggccacaaagagttccctctcatctactctaaaaaggcacctcacgaggtgtgtggtagacacataggtcggcgacgaacgatgaggtagagaggagtgacggagagtgtgtgcgcacccccagcaaacgataccattatcaccaccaacaattactctcactcacaattaatcaatgaacagaagagagcccatacataccgtgagagcgcgagtaaacaacccctccaggcgtgtgaccacaaaccagagagaccgtgagggggggacaagaagaaagattacaccgcccacacagaggctaataaaaacacacgagagagaagggaggaatcaacacgaggggcacgagacaaaacaaagcacgcccccccaccaaaacacatacactgacccaagaaggtagcgaaaccaacggaggacaacacgacacaaacc

SEQ ID NO: 699814 - DNA, 363 bp, Homo sapiens
tggatcgggagatcgggagtcaagtccagcctggccgatgtggtgaaaacgtatctctactgaaaatacaaaaaattggccaggcgtggtggtgtgcgcctgtggtcccagctgcttgggaggctgaggcgggagaattgattgaaactgtgaggtgaagcttgcagtgagctgagatagcaccactgcattccagcctgggcaacggagtgagactccatcttaaaaaaaaaaaaaaagaggccagattgcaggggctgatgccggtaatcctagcatttatggagtcggatgcaggcgaatcacgggacattcctgacgtgggacgtccgagattagccggaccaactgtggagaagcccg

SEQ ID NO: 699815 - DNA, 132 bp, Homo sapiens
tcagctctaatttctttcgacttgcagtagctgagtcacagggagatggcactttaccagaaaaaacatggtattaaactctataaacctctcattctccctgtgactcaggcccgcaagtcaaaagaaatg

SEQ ID NO: 699816 - DNA, 856 bp, Homo sapiens
  misc_feature (18)..(19): n is a, c, g, or t
  misc_feature (44)..(46): n is a, c, g, or t
  misc_feature (91)..(91): n is a, c, g, or t
  misc_feature (96)..(96): n is a, c, g, or t
  misc_feature (99)..(99): n is a, c, g, or t
  misc_feature (111)..(111): n is a, c, g, or t
  misc_feature (119)..(119): n is a, c, g, or t
  misc_feature (128)..(128): n is a, c, g, or t
  misc_feature (131)..(131): n is a, c, g, or t
  misc_feature (139)..(139): n is a, c, g, or t
  misc_feature (143)..(144): n is a, c, g, or t
  misc_feature (146)..(146): n is a, c, g, or t
  misc_feature (155)..(155): n is a, c, g, or t
  misc_feature (159)..(159): n is a, c, g, or t
  misc_feature (162)..(162): n is a, c, g, or t
  misc_feature (171)..(173): n is a, c, g, or t
  misc_feature (176)..(176): n is a, c, g, or t
  misc_feature (182)..(182): n is a, c, g, or t
  misc_feature (184)..(184): n is a, c, g, or t
  misc_feature (187)..(188): n is a, c, g, or t
  misc_feature (190)..(194): n is a, c, g, or t
  misc_feature (197)..(199): n is a, c, g, or t
  misc_feature (202)..(202): n is a, c, g, or t
  misc_feature (207)..(207): n is a, c, g, or t
  misc_feature (214)..(214): n is a, c, g, or t
  misc_feature (221)..(221): n is a, c, g, or t
  misc_feature (226)..(226): n is a, c, g, or t
  misc_feature (229)..(229): n is a, c, g, or t
  misc_feature (234)..(234): n is a, c, g, or t
  misc_feature (236)..(236): n is a, c, g, or t
  misc_feature (239)..(240): n is a, c, g, or t
  misc_feature (244)..(244): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (262)..(262): n is a, c, g, or t
  misc_feature (269)..(269): n is a, c, g, or t
  misc_feature (271)..(273): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (285)..(286): n is a, c, g, or t
  misc_feature (289)..(290): n is a, c, g, or t
  misc_feature (300)..(300): n is a, c, g, or t
  misc_feature (306)..(306): n is a, c, g, or t
  misc_feature (332)..(333): n is a, c, g, or t
  misc_feature (340)..(340): n is a, c, g, or t
  misc_feature (342)..(343): n is a, c, g, or t
  misc_feature (346)..(346): n is a, c, g, or t
  misc_feature (363)..(363): n is a, c, g, or t
  misc_feature (367)..(367): n is a, c, g, or t
  misc_feature (371)..(371): n is a, c, g, or t
  misc_feature (376)..(376): n is a, c, g, or t
  misc_feature (379)..(379): n is a, c, g, or t
  misc_feature (403)..(403): n is a, c, g, or t
  misc_feature (409)..(412): n is a, c, g, or t
  misc_feature (420)..(420): n is a, c, g, or t
  misc_feature (422)..(422): n is a, c, g, or t
  misc_feature (433)..(433): n is a, c, g, or t
  misc_feature (444)..(444): n is a, c, g, or t
  misc_feature (454)..(454): n is a, c, g, or t
  misc_feature (458)..(458): n is a, c, g, or t
  misc_feature (461)..(461): n is a, c, g, or t
  misc_feature (470)..(470): n is a, c, g, or t
  misc_feature (477)..(477): n is a, c, g, or t
  misc_feature (480)..(481): n is a, c, g, or t
  misc_feature (483)..(483): n is a, c, g, or t
  misc_feature (485)..(488): n is a, c, g, or t
  misc_feature (490)..(491): n is a, c, g, or t
  misc_feature (494)..(494): n is a, c, g, or t
  misc_feature (498)..(498): n is a, c, g, or t
  misc_feature (500)..(500): n is a, c, g, or t
  misc_feature (502)..(502): n is a, c, g, or t
  misc_feature (505)..(507): n is a, c, g, or t
  misc_feature (509)..(511): n is a, c, g, or t
  misc_feature (514)..(516): n is a, c, g, or t
  misc_feature (518)..(521): n is a, c, g, or t
  misc_feature (523)..(523): n is a, c, g, or t
  misc_feature (529)..(529): n is a, c, g, or t
  misc_feature (532)..(533): n is a, c, g, or t
  misc_feature (535)..(536): n is a, c, g, or t
  misc_feature (538)..(538): n is a, c, g, or t
  misc_feature (541)..(541): n is a, c, g, or t
  misc_feature (544)..(544): n is a, c, g, or t
  misc_feature (546)..(546): n is a, c, g, or t
  misc_feature (552)..(552): n is a, c, g, or t
  misc_feature (554)..(554): n is a, c, g, or t
  misc_feature (558)..(559): n is a, c, g, or t
  misc_feature (561)..(562): n is a, c, g, or t
  misc_feature (564)..(568): n is a, c, g, or t
  misc_feature (573)..(573): n is a, c, g, or t
  misc_feature (575)..(576): n is a, c, g, or t
  misc_feature (578)..(578): n is a, c, g, or t
  misc_feature (580)..(581): n is a, c, g, or t
  misc_feature (586)..(587): n is a, c, g, or t
  misc_feature (589)..(590): n is a, c, g, or t
  misc_feature (592)..(592): n is a, c, g, or t
  misc_feature (594)..(595): n is a, c, g, or t
  misc_feature (607)..(607): n is a, c, g, or t
  misc_feature (611)..(615): n is a, c, g, or t
  misc_feature (618)..(618): n is a, c, g, or t
  misc_feature (622)..(623): n is a, c, g, or t
  misc_feature (626)..(626): n is a, c, g, or t
  misc_feature (631)..(631): n is a, c, g, or t
  misc_feature (633)..(633): n is a, c, g, or t
  misc_feature (638)..(638): n is a, c, g, or t
  misc_feature (642)..(642): n is a, c, g, or t
  misc_feature (644)..(645): n is a, c, g, or t
  misc_feature (649)..(652): n is a, c, g, or t
  misc_feature (660)..(661): n is a, c, g, or t
  misc_feature (666)..(667): n is a, c, g, or t
  misc_feature (670)..(671): n is a, c, g, or t
  misc_feature (701)..(701): n is a, c, g, or t
  misc_feature (709)..(709): n is a, c, g, or t
  misc_feature (712)..(712): n is a, c, g, or t
  misc_feature (714)..(714): n is a, c, g, or t
  misc_feature (717)..(718): n is a, c, g, or t
  misc_feature (723)..(725): n is a, c, g, or t
  misc_feature (728)..(732): n is a, c, g, or t
  misc_feature (735)..(736): n is a, c, g, or t
  misc_feature (772)..(772): n is a, c, g, or t
  misc_feature (836)..(836): n is a, c, g, or t
gtacagattctcctaaannacccagaaacggttagacatttaannnaccaacaaggaagatctccattaaatatttgtgaagaaaacaaanaaaanaantggtgtagaagntgcaaaantgttgaagnaancaattaanaaannanatgaaaaanggcnaanagacacaannnagnccgcananccnncnnnnnaannnaancatgnaaataanaccacantgcancanataangnaannaatnccncncncncaacaaacncaccaanannncacnanangganntgnncagaaaaccncagccntcaactcaaaccatatcataaacccnngcaacangnncgngactggccagaaatacntgcngaantgacnaanctggatcctcaaagggaaacaccncagctnnnnctaagaananatgtgagactncccttggaacntgaaaaacanattnaanacccactanctattcntanncncnnnnannaanccanananaannnannnaannncnnnnanacaccnccnnanncnaancgnanaacagntncaanncnncnnnnncaaananncnanncaaannannanannaaaaaacacaancaannnnnccnaaannaanaaaancnaaaanccancnnaccnnnnaccaaacnnaaaannaanncaccgcacgggacaaagcgcagacggcagnaagacaanaancncannacaannnaannnnncannaaagaaaggcagcaccggcagcgcaggggcggacanaaagggcggggaaaggccgacggagggagcagcagggggcacaggacagagagggacaaaggcnagcccagcaagcagaaaggc

SEQ ID NO: 699817 - DNA, 525 bp, Homo sapiens
tgcaacctggtagatcgctctcaggcagataaaaagaactaattacgacatgggcaccactgggatgaatccagagaatgtgctgagtgagcaaagccaatcataaaagttgcacactgtatgattccatttacataacattttgaaatgcaaaattataggaatggcgaatagataaggggttgccagggaggagtggggagaacaagagagttgggcataactataaaaggatagcacaagagatccttgtggtgatggacatattcagtatcttgaccaaatcaatgtgaaaatcctggttgggatattgtaactgtagttcagcaagatgtgccattggggaaaactgggtaaaaagaacacaggatctctgtattatttcttacaactgcatgtgaatctacagttatctacaactatctcagaatctacaattatctctgagtaaaaagcttaacataaaccagatttagggcttagcttaataaagcatttatactctctctcttactaagtccctaa

SEQ ID NO: 699818 - DNA, 329 bp, Homo sapiens
gcttagagatcatctaattcttattagaaaactggatagttctgcaggtgtgggaatgcggggacacacacacacacacacacacacacacacacactctctctctctctctctctctctctctctctctccttacataggaggttagctggaatatgccttagagattatataatttatattagaaaaagtgaagcttcgtgagggagagtgatgtgctcaagatccctcatatcggggagggtgaacagagcctgaagaacaggatcgtgacccgaggtatgtgccgtgtattatcccttttacaggctgcagaacagatacacggc

SEQ ID NO: 699819 - DNA, 225 bp, Homo sapiens; identical to SEQ ID NO: 658517

SEQ ID NO: 699820 - DNA, 208 bp, Homo sapiens
aaaatactgctttccccagttccccccctattttttttaagtgggcgggggggcctgttaaaatctaaaaaaaaaatggtggattgatattttcccgggttcggtgtggaaaacaaaacaaggacatgctttaaaaacaacaacaatgaaatcccttttaaatgtgggttaaaatcgtttaataaaaaaactagttttgaaaaaaaaa

SEQ ID NO: 699821 - DNA, 325 bp, Homo sapiens
cctgtaacgtggtgttatatctcctcgctgtcaggaaggctgaggaggggcggtgggaccatggccatcatggagcgggatgccaccgagttctcaaagaccttgtcgtgccctggcccttcctgtcctggcctcctagttgggcaccagtatctccacccagatgctgtgagcaccaccctccccaccaatccctcagcgagattctagcagaggggagagagccaggtgtcctgtgcggacccagtgtgttgagaaaggggggctggctatgatgatgcatgtggagtccaccctagggtcagggttcagggcctgcatttga

SEQ ID NO: 699822 - DNA, 207 bp, Homo sapiens
acctgtaaaatggagcaagcaattgcatcccaggttttcttccgaaatgtaaactctgaataattttatgtttgtaagggaagggggatgaaaggattcttctagtaatgacataccgatgtttcccgcgtgatggaagtagtagagggatcctgctagtagatcgagctgtcaggacatgcgaatgcttgtgaaactgcgccgctc

SEQ ID NO: 699823 - DNA, 296 bp, Homo sapiens
actcgtcgactccgtgaccaccgtcctgctgtctatctcatccaatcaccgttttctggaggtctgataagcgttggcatcgagcgccttaccccggagttcggtatcatcccgtagcgccaagtctcggttaccataagtggcccactaggctctcgcgttccatggcccgggtccacgccagggaaccgggcttcttacccatttaaatgttatcgaaaatccgttgagatcggtctcggacccgagcacctcatcatcaattcgctattaccgtgatggtagtgcttgacggg

SEQ ID NO: 699824 - DNA, 315 bp, Homo sapiens
cgcgtcgacgttcctttccactcttgctttcctttccattcaattccattccattccattcattccattccattccattccattacactgaggttgattttgttcaattccattccaatccattcaattccattccattctagttgattcctttgcattccaagccattccattccattgcattctattccaatgcattccattagggttgatttcattccattccatttcattccattccattgcattctactctgcttaattccattccattccatgtcgatgcggccgcgaatttagtagtagtagtcgacc

SEQ ID NO: 699825 - DNA, 867 bp, Homo sapiens
  misc_feature (56)..(56): n is a, c, g, or t
  misc_feature (58)..(58): n is a, c, g, or t
  misc_feature (65)..(66): n is a, c, g, or t
  misc_feature (70)..(70): n is a, c, g, or t
  misc_feature (73)..(73): n is a, c, g, or t
  misc_feature (93)..(93): n is a, c, g, or t
  misc_feature (96)..(96): n is a, c, g, or t
  misc_feature (100)..(100): n is a, c, g, or t
  misc_feature (104)..(104): n is a, c, g, or t
  misc_feature (127)..(127): n is a, c, g, or t
  misc_feature (137)..(137): n is a, c, g, or t
  misc_feature (142)..(143): n is a, c, g, or t
  misc_feature (157)..(157): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (172)..(172): n is a, c, g, or t
  misc_feature (174)..(174): n is a, c, g, or t
  misc_feature (176)..(176): n is a, c, g, or t
  misc_feature (181)..(181): n is a, c, g, or t
  misc_feature (192)..(193): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (205)..(206): n is a, c, g, or t
  misc_feature (224)..(225): n is a, c, g, or t
  misc_feature (228)..(228): n is a, c, g, or t
  misc_feature (266)..(266): n is a, c, g, or t
  misc_feature (270)..(271): n is a, c, g, or t
  misc_feature (494)..(494): n is a, c, g, or t
  misc_feature (519)..(519): n is a, c, g, or t
  misc_feature (546)..(546): n is a, c, g, or t
  misc_feature (858)..(858): n is a, c, g, or t
agaagattgtcatcacagatgtggcccgttcccctaatctgtgtccaggttgctgncntggtgcnnctgnaantgtccatgcacccaggtggncgngttngctntcagccaaagtgcctgaaacganactgtgcccnatccnntgtcactgtgtgcntgaggnangctnctngngnatgtnagccatcggcnnaggncnancaannttgcttcctaatacccannctncctcacgacctcatttctgggcatctttgtggacatgntgtnncccaccccttgtcaagcattgcctgtgattgcccagccagattcatctgtgccttggacatggtgatggtgatgggttgcatccaagtgaagtcttttccttgaccaagggggacagtcagttttgcaaaagactctaatacctgtttaatattgtcttcctaattgggataatttaattaacaagattgactagaagtgaaactgcaacactaacttccccntgctgtggtgtgacctgagttggtnacacaggcacagaccccagagcttggnttttgaaacacaactcagggcttttgtgaaggtcccccgctgagatctttcctcctggtaactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggcacatgntttgtgttc

SEQ ID NO: 699826 - DNA, 117 bp, Homo sapiens
  misc_feature (2)..(2): n is a, c, g, or t
  misc_feature (8)..(8): n is a, c, g, or t
  misc_feature (19)..(19): n is a, c, g, or t
  misc_feature (25)..(27): n is a, c, g, or t
  misc_feature (73)..(73): n is a, c, g, or t
anattttncataaatgctntaattnnnctccaaatgactattgcatagatgatcttgatatttgcaacaagcnctagtggatttggtagggtcctgaatcatctctataaggcaaga

SEQ ID NO: 699827 - DNA, 329 bp, Homo sapiens
tgacactatctcaggctatactgttatttggggttgactatattttgacagtaagggtggataaagccatagtcattagaggaaggtctagattcctgctcttaataaattacattgaattgattttagaggtaatgaaaacttcctttctgagaagttagtgttaaggtcttggaatgtgaacacattgtttgtagtgctatccattcctctcctgagattttaacttactactggaaatccttcacccattataatagctttttttctttattttcaaaatgatttcctttgctttgattagacactatgtgcttttttttttaacc

SEQ ID NO: 699828 - DNA, 440 bp, Homo sapiens
tgtattggccactgatttctagtaaacaaggtctggcagggaaatttcccatcttggttattatttatttagagtgtctcaatctctcacaaggcagcggtgtgatggcatgatcacagctcactgcaacaaccgcctcccaagctcaagtgatcctcccacctcagcctcctgagtagctaggattgcaggcatttatcaccacgcttggctaatttttgtatctttagtagagacagggtttcaccatcttggccaggctggtctcaaactcctaacctagagtgatccacctgcctcggtctcccaaagtgctgggattacaggcgtgagccaccatgccagccctgccatcttttttttttttttgggaaaaagagcctcgttttgtcgccaacgcggaattgaaggggaacaattcttagctcagggaaacctca

SEQ ID NO: 699829 - DNA, 378 bp, Homo sapiens
  misc_feature (27)..(27): n is a, c, g, or t
  misc_feature (37)..(37): n is a, c, g, or t
gtcgactaacgggctgcgagaagacgnacaggagggnaaaatccctggggattactttttcctaggggatgtaatacatatatttacaaataaaatgccttcatgggcaaaaaaaaaaaaaaaaaaaaaaaaaaaaagttttcattacagaattgtaaagtaaaaccacaatgcaattccacaccatacacactaagatagctgtattcaaaaagagagacaatgccaagtgttgacaaggatttggaaaaactgggtccctcatgaatttctggcgggaatgttggtacggccaatttgggaaacagtttggcagttttctcaaagtcctaaccttgccataggatctagctttcattcctaggtcgcgcggccgcg

SEQ ID NO: 699830 - DNA, 669 bp, Homo sapiens
  misc_feature (456)..(457): n is a, c, g, or t
ggtcctttttcgatttgggggcctccccaaattctgtaaaattttagagccctagcaataaataaaccctggaggggagtgggaaaatcccgggtccttgttcaaggcccatggagaagctgtggccctttaaaaaacggatctcaattaattgtcccatgggtcaatatataattcccgtttaatcccccgcaattttttatccaccaaaggcctcaggagcatgggattctgacagcccattttccatcccgggtcaagaaaaggggtaatagttagcctttcacatggaagagggtgaccaacctgtttctaagatttgggacgccctcatttgaataagcacactatgttctaagcttaagccgcgccttcgggggctccacgcagtcagtatcaactgacggtggcattcataaactgtaattgccccctgctagggcacgtctaaagttnnctgccccttcaatttgggggacccatcacatccttatcccgggggcagtcaaggcgatcagatccatagttttctgaacaattggtggcaattcccagtcttcgatcgacaagtgccctgtggtgcattcccgtgttgcatagctccctaaggctcttggatccgttccttccataattggccccttcggtggaatacagtaaagaacggtt

SEQ ID NO: 699831 - DNA, 323 bp, Homo sapiens
  misc_feature (57)..(57): n is a, c, g, or t
  misc_feature (61)..(61): n is a, c, g, or t
  misc_feature (96)..(96): n is a, c, g, or t
  misc_feature (103)..(103): n is a, c, g, or t
  misc_feature (177)..(177): n is a, c, g, or t
ggaacagctgtgtagctcctttcctggcagtggtggtagtggtagcagcagcggcanagtnggcagcagcagcagagcagcaatggaggggagcanagcgganttggacccttcagtgcaacgtcattcaccaggtcacattaccttccttctctccctcggcggctcccacaggcncaactctgcaagtcaaggtttctcccacctcagttcccaccacacccagggcaactcctattcttcagccctgccccagcccagctcaacctcaaactcagctgcaacaacagacggtaatgatcacgccaacattcagaccactc

SEQ ID NO: 699832 - DNA, 757 bp, Homo sapiens
taccatagcttgcgagcatgcagtagctggtaccatcaccaaacggatcagttgtgcctacctgcctactgtgcttggcatagcattcgaccgatgcgctccgcgctggcacgtgtgagaaattggatgcgagagcgttctaccagtatgtaactgtgccagatccttagacaggttgatagtctttataacacgagctttacaccttattgacatgagtcgacccaacattcttagttttcagcgaggccaggttgctctacatgttgtgttgtatcttgaacatgagttgattcgttatactagtttatctgtactgaactgctacgaattagaaggctctttcctgtggtatggacagtagtactttgatttattatagtacctatattagtgtggagtacttatatgacaccatttttggatctgtgggtgagcgttagtttaacttggggccagggccttcacaataatgctcgtctatgtgtgcgtgccgaaggaggccctatgtccgcatgagacttcttcggccttctcaagcttccaggccccctttctgccctgggtgctcatgggattttccttgtcgtttggggaactccctcacttgtggagctgtggggtattgcagtttggaccccatattatttttttcttggccgatgtatttccccaatcaactggtggcataagagttctgacaaagcagcatctatttgggagacgctatctgttggtgaccccagatgaggatcca

SEQ ID NO: 699833 - DNA, 340 bp, Homo sapiens
tgagatacttcgattggagaatgcagttcaggaggagagtacccaaaaactagtgttcaggactgagctggcccgggataacggattctatgcctggtacatgttgtcacgaaagtcagcggtagctgaacagagtctgcggatctagccctgctttgtgcctccaggaagtgaagatagtgcgcagtttaccggcagggaggcaaacagtcgaattgcatagcagtatcatgatgaaatgctagaaggcccagccttggaaaaacggtggccagtatgagcaagtgcaaatgagggatgccaacgcacaagagggatgcaggaaggccgcttgtggggg

SEQ ID NO: 699834 - DNA, 408 bp, Homo sapiens
  misc_feature (316)..(316): n is a, c, g, or t
atttttagtggacatggggtttcacccatgttggtcagactggtctcaaactccctggcctcaggtgatccacccgcctcagcctctgaaaatgctgggattacacacatgaaccactgcgcccagccgctctactttattagatttaaaaagtttgctctcagctgggtgcagtgcttatgcctgtaatcccagcagtttgggaggccaaggcggggagggtcatgaggtcaagagatcaagaccatcctggccaacattgtgaagccccatctctactaaagatacaaaaaattagctgggtgtagtggtgcanacctctagtcctagctacttgggaggctgaggcaggaaaatcgcttgaacctgggaggcagaggttgcagtgaccaagatggaccactgcac

SEQ ID NO: 699835 - DNA, 868 bp, Homo sapiens
agtcccagcactgtgggaggctgaggcaggaggatcatctgagtgccaggagttcgggatcagcctgggcaacatagtgataccctatctcttaaaaaagaagaagtttttaaatttgaaataataataggtactggatttatgcaaaatggtccttttcctgcgtcttgtgagaatgagtatcaggttttttttttccctttatatcatctgatgatgaccttaccggttcccattggtttcaggggactactaagtccctctgtgatttctgaaccaagctattcctaggcctgagtttatttggtggacacagcaactaattcagaaggccaacgcgtggtggcatgtgccgtgtagtaccatagtggctgaggtaagaggatggctgtgagcccaggagtcacggctgcagcaagctttgatggcgccactgcactccagcctgggcgacagactaagacgctgttctcaaaaaaaaaacaaaacgacaacaaaaaacaacacgcggaacacactacacatagggccaggaagcgtcccggggcaatagtgcggggagcggccagcaccaccactggtgccccggcggaaagggaacacgtgcacgcaggactttgcacagcgccactaaacatgggacgcccaagctgggtggacccgacggcaggaagccaaaaccgccggacaaacacgagtacacgcggacagactacaagtccaagataagaccacgaagacaacacaaacgctgcggcgcggcccagaaaaagcacacacatgtgggggcgagcccagagacgcgaaggcaacaggtcaccgaagactgggctacacacggcgggctcacacaaaaaccgggacaggc

SEQ ID NO: 699836 - DNA, 1689 bp, Homo sapiens
  misc_feature (255)..(255): n is a, c, g, or t
tgggacaatctacaaacacttttattagccaaagaggagttaaggtgcagcttgtgggagaaaaggaggggcctcctcctttcccctcaagaggcgatcacgtgcccctttcccagaggggccaggtccagcgagggaaactaaggaggaaccccgaggggttgtgcaagagacagggctgtgagaagtctcagagaacacacaagggtgatctccgggtgtctccggggataccgcattgtgactctgtgccangacacatgtgtgagcgctctcgcctcatatattctcacttccagagagaggcggccgtgagaaccgtgggtgagcgagaggtggatagacacgccgaaggagagagaataacaaaaagagcggcgatggcgtcggggcgcctcaaagaagaaacgcgggagaaccacatttgcggggcccccccttagaaaggatccagcagttcaaccggagaccgggggggggcgcacaaaagttatttccacacatttcggtgggctgtggggctactctctggtgggaagtgtcctctaataagagctgtgtgtgctgtggcgcccactgtggtgttcgttcctccatagaagaaaggagagaagagtactccctctgtgtgggacaatttcgctcgcgaattattagccccgtgatagtggggctttatcattgtccacacaattttcatatcctttattgcatcacacaaacaccaaatatgttcacaaacacataattttctctacgaagaaaacgtggtgtgcgcaccaaggaagcacaaggtgtgggtgcacaaagaggtggggccgcccagagaggaaaatgaggcagcacccaagtagacgagggggtctctcgcgtggggccccacgaaacaagcataaactaaggggggtgggaaacaaattcccctatattaacctatcagggcgccccgaaagcgtccctttctcgtcaggcaccatcacatattactctcaccaagaagtgatatgattggcgctgatgccatatgagaggacatatgattaatggatccaacgctcccacaagcagagaaacttctctggggggcaccacccaaagtggggaggcttcgggagaatatcacattcacgacgggaggaacacaactgtggggcggttatcatcgatataaaagcagccaaccaagagtgggaagcgcctctccgaatgagctccccaagcagaagggggtctccaaccaaccgccgggggcgaagaacgggggggagacactagcaaccccgcacgatcgagctagccatcggcgaggttgagccaacacactaatgaagccgaaacaacgaggggtcacgtcggggacccacaaaacccgcggagagaggaccaatcagtgaccaccacgagtactgggagacacccagagaacctagtaaaataaatcacagagcaacacagagggagtggtctaaacaccacgggggagaagcaagcacatgtcgtcagacaggacgacaggccgagagagatgatactacggtgcacacacacgaagagtcatagacgacaaagaagtgatgtacgtacgctcaccccgccaaagaaacaaggaacgtgcgtggccatatcacacacacgagcaatacacagggcgatctacacatcgaagcgagacgacagtaaccacaccca

SEQ ID NO: 699837 - DNA, 421 bp, Homo sapiens
  misc_feature (118)..(118): n is a, c, g, or t
  misc_feature (122)..(122): n is a, c, g, or t
  misc_feature (134)..(134): n is a, c, g, or t
  misc_feature (138)..(138): n is a, c, g, or t
  misc_feature (149)..(149): n is a, c, g, or t
  misc_feature (158)..(158): n is a, c, g, or t
  misc_feature (165)..(166): n is a, c, g, or t
  misc_feature (169)..(169): n is a, c, g, or t
  misc_feature (173)..(173): n is a, c, g, or t
  misc_feature (179)..(180): n is a, c, g, or t
  misc_feature (189)..(189): n is a, c, g, or t
  misc_feature (194)..(194): n is a, c, g, or t
  misc_feature (206)..(206): n is a, c, g, or t
  misc_feature (208)..(208): n is a, c, g, or t
  misc_feature (372)..(372): n is a, c, g, or t
  misc_feature (374)..(374): n is a, c, g, or t
  misc_feature (384)..(384): n is a, c, g, or t
ggttcgaactactagaagtggaaagactacaagaaacccttcaacagcaagattagcatcattaaggggcaaggaggtacatttaaaaaaagataactcaactagatggcccactganggantcacatcacctnactncacttctagtntctagactncaaggannatnagtncacttnnctgactctnggttnctttaacagtanantgaaacgtacagactttcgttcattctaatgccctttcaaactctaaatgacctaaccttgacaggagccatgacagtaaaaaaagggcaaggtacgaaagtgtagagctagcccaggttaggaggttagccccatcatataagccacataaatcaagcttgantngcagatattnccatcatacagaagctgagagagggactcaaatcata

SEQ ID NO: 699838 - DNA, 1298 bp, Homo sapiens
  misc_feature (481)..(481): n is a, c, g, or t
gtgtatgtctatgaggtcgaggtcaagtgctgtgaggcagctgttataggataaacatttacagtcctactgcctgctggaggcagttcctggttccgacgggcttcggacttcgtcgtgcgtatgagcacaagtggtgggaatggtcgctagtactaggttattgtacccccagtcaatcactcgcaaatcttggattgccttgctgcgcaccatcatccgcatgattataccaatgcgagtaagtgtgtcgtccgagacattgtagactcgggccacttgacgatcgttattataggaatctcctgattgcttgtcattcggggcggcccatcgtccgcgagcgtaggtatgacttgaacttatgagtaatctctctacgtcagcaactcgcgtcatggtcatgggcgccttatcattgtgtccaatggagaactgtatagctccgttaacgctggtcttgcgcaactcattcagcaangcgaggacagataggcaacaagaagtggcgaagtttgcgctttgcgcctaaccaccccaagggtagtagctttcctcgtagggttgttggggtggcgtttgcatccccgtcctggagcgacatcctggtgactagtcttgaatttccctcgcgtactccatcaacacgaaatgatacatagccttctacagaggacctccactttgggagagttagcgccatggcgaataaggtggcttgccgaaaaacttagcgattgtcggtggcgagcgaatcgtaggtaagcccgagtttcaggaaggttgaggatagtccatgtgtgtgttccccgcatatcgcgttcgcccccaaaaggcaggtaaagcgagaacccccttatgttatcccgttcttcgccttgttcggcgttgcggaccagaaagctttgggtccgaaatgggttacttcggacaaccctttggggcttagacttgggcaatgcgttgaaaaggaagctaataaccaacaatttggggacatcgaaccaggggctaactcttgaaaccaacgggttggaacttggtatcggcttcacgagggactcgagagtcccccttcttgattgtctcttcttgggaagtggcaaagtggacttggtcccaggggccattggttcatgggggaatcttcagaagcgaaacggcaaataagaggctttgtaagaccgacgtagagtgtgtgtggggacaattctttccaaaggccccctggtgactttcagggcgcttaaagcagactacatttggggtttgatggtgcttgaccaccaggggcctcc

SEQ ID NO: 699839 - DNA, 374 bp, Homo sapiens
gcaggctgggtctcaaactcctgacctcaggcgatccacctgccttggctcccagagtgctgggattacaggcatgagcaccacacctggccaaaaaaagctagatttttaaagtctatttgtagcttagaattcatggaaaattcattttcaatgcggaggaaaacttggtaatgggctggtgattcaccatttgctgtgctagcctccttgtgtgtaactctctcaccttttactcacttaaaattcaatttgcagcacaacccaattcaatttaattttccatcagatcattttcttttggcagcttcagaggtggtcaactttaacataaaaacaatttccttccaattaagttgagcttcatcaggaag

SEQ ID NO: 699840 - DNA, 399 bp, Homo sapiens
  misc_feature (96)..(96): n is a, c, g, or t
  misc_feature (100)..(100): n is a, c, g, or t
  misc_feature (112)..(112): n is a, c, g, or t
  misc_feature (116)..(116): n is a, c, g, or t
  misc_feature (127)..(127): n is a, c, g, or t
  misc_feature (136)..(136): n is a, c, g, or t
  misc_feature (143)..(144): n is a, c, g, or t
  misc_feature (147)..(147): n is a, c, g, or t
  misc_feature (151)..(151): n is a, c, g, or t
  misc_feature (157)..(158): n is a, c, g, or t
  misc_feature (167)..(167): n is a, c, g, or t
  misc_feature (172)..(172): n is a, c, g, or t
  misc_feature (184)..(184): n is a, c, g, or t
  misc_feature (186)..(186): n is a, c, g, or t
  misc_feature (350)..(350): n is a, c, g, or t
  misc_feature (352)..(352): n is a, c, g, or t
  misc_feature (362)..(362): n is a, c, g, or t
cacaaaaccccttttatcagttttgataggagtacaaaccttgcgtgtgcatgttttacctccaccccccgatactcctctagatggcccactganggantcacatcacctnactncacttctagtntctagactncaaggannatnagtncacttnnctgactctnggttnctttaacagtanantgaaacgtacagactttcgttcattctaatgccctttcaaactctaaatgacctaaccttgacaggagccatgacagtaaaaaaagggcaaggtacgaaagtgtagagctagcccaggttaggaggttagccccatcatataagccacataaatcaagcttgantngcagatattnccatcatacagaagctgagagagggactcaaatcata

SEQ ID NO: 699841 - DNA, 407 bp, Homo sapiens
catatccgacatacactcattaggatggctaccaccaaaaaaaaatcacatcacatggtgatgatgtggagaaactggaactcctgtgcactgctgatgagaacgtaaaatggtacagccactgtggaaagcaatgtagtggctcctaaaatagttaaaagttgaaccacaggatccagcaggttgaaagcaggggctctaagagatatctgcccgctcgtgttcagagcagcattattcacagtagctacaatgtggaagcaacctaagtgtccatcaacaggtgactggataagaagaacggatcgtctatccatacaacagaatattactcagccttagaaagaaaggacattttggcacatgccacaacatggatgatccctgaggacattatgttaagtgaa

SEQ ID NO: 699842 - DNA, 317 bp, Homo sapiens
cttgtcaaagataccagaatgggttacacatttaacctggcaaacattgaaggactcttaatgttttctttttaataaggatgacggcccactttggggactaaaattgtgctattgccgagaagcagtctaaaatttattttttaaaaagagaaacttgcccattattttttgggttggtttaattttaatatataattttcgcggctttgggcattgtcaaatgttggaatctctctgggttctcagatataaatttaatcctaggtgtataaactctgtagccagtaaaatgtatgctacagatagggaatgta

SEQ ID NO: 699843 - DNA, 412 bp, Homo sapiens
tttcacgtcgttcaaggtgaggtacaccgagtagcccccgagctcggcctctttcggaatcacccactcggtttcgcccgtgccgctggagtcgaacttcaccggcaggatgatgcgcttgccgttgccgctcacgatcacgagggttttcggcatatcgccctgcttgtagcgaatgccgcgcaggaaaccttcgcgcaggaagtgcttcatgtgcaccgtttggcccgcgcgcagaagcgtgcggtcgaacacggtgtgggccatcgtttcctcctcgtcgccgcccgtgctcacgtggaagcgccagtcttcgatgccgctgtcccagcccgagtacacgaggctgaaatcatcgtccttctccgcaaccaccaccacgccgccggcgaagtcgttgtacttgcggccg

SEQ ID NO: 699844 - DNA, 110 bp, Homo sapiens
gtcgacctcgtgtctcagcctccagagtggtcccttttacaggcacgcactaccatgcctggctaatttttttgtatttgttttagtagaaacagggttttgccatgttg

SEQ ID NO: 699845 - DNA, 276 bp, Homo sapiens
aatgtgcacgcaggacacatgatgcgaaggttggtacattagtgggggacgacacaatatggaaacaaagtactatgaagactactagcaattattgggccatcaccgagtggttgtatatactactgaaatgaatggcaaatacacattctgggatgtggattgaagcatggtgcctcctgaatggcatcgttggtttcacagtatgagtgatgatcctccatcaacaaaaccacttactgctcgtacattcatttggacgacccataaattcta

SEQ ID NO: 699846 - DNA, 218 bp, Homo sapiens
aagatatgattcttaaaaacccattaatagaatcctgtggttataaaatatattgttgcccaaatgacacttctttgtagatgtcgtagaaagagccatggatattttataaggagacctactcagtttctagcagtggtagatcatcattaattggctgtgtgaccctgagcaagccacataacctctctgagctttggtttcctcaacagtaaaat

SEQ ID NO: 699847 - DNA, 203 bp, Homo sapiens
ttcccccggccgccccgcttctcgaggtgcctcgacaacatgagcactgagttagctagactccggccgccacagctttctctagtctgtggtactaccggtgcgcaccaccatgccctagactattttttagtgttttactaaatgatatggtttcactcacgtttgtcttaggacggtctccgatctcctcgagcgcctct

SEQ ID NO: 699848 - DNA, 273 bp, Homo sapiens
  misc_feature (236)..(236): n is a, c, g, or t
  misc_feature (256)..(256): n is a, c, g, or t
caaccccaactgaagctgagataatcagaccaggaagtgaaaatgacattcaaactaaattatttaaaacaaggcatacctctccccaactcagtctaaagacacaatttcattttgagaatgtttacagcccatttaattaatcagtgaactaaaagtcatagaaattggatttgtgcaaatgtagagaaatctaccatattggcttccaaaatttaaaaattttatgccacagnacatttcatccaaatccagntttggaccaaagggcac

SEQ ID NO: 699849 - DNA, 512 bp, Homo sapiens
  misc_feature (11)..(11): n is a, c, g, or t
  misc_feature (148)..(148): n is a, c, g, or t
  misc_feature (154)..(157): n is a, c, g, or t
  misc_feature (183)..(183): n is a, c, g, or t
  misc_feature (237)..(237): n is a, c, g, or t
  misc_feature (255)..(255): n is a, c, g, or t
  misc_feature (297)..(297): n is a, c, g, or t
  misc_feature (305)..(305): n is a, c, g, or t
  misc_feature (314)..(316): n is a, c, g, or t
  misc_feature (319)..(319): n is a, c, g, or t
  misc_feature (339)..(339): n is a, c, g, or t
  misc_feature (355)..(355): n is a, c, g, or t
  misc_feature (362)..(362): n is a, c, g, or t
  misc_feature (366)..(366): n is a, c, g, or t
  misc_feature (407)..(407): n is a, c, g, or t
  misc_feature (422)..(422): n is a, c, g, or t
  misc_feature (424)..(425): n is a, c, g, or t
  misc_feature (428)..(428): n is a, c, g, or t
  misc_feature (442)..(442): n is a, c, g, or t
  misc_feature (450)..(450): n is a, c, g, or t
  misc_feature (459)..(459): n is a, c, g, or t
  misc_feature (470)..(470): n is a, c, g, or t
  misc_feature (499)..(499): n is a, c, g, or t
  misc_feature (502)..(502): n is a, c, g, or t
tattgtctgantggaaatatactctgtttcacaactctaattataacaatttttacagataatacttcatttatatctctgtaattcaaaagtcattaaattacaacagaattcatatttaagataactttgctataaatatataatnattttnnnngtttttctttaatataacatcttganatcatgaacatttattttttctggtttacattacatagaatcatgactattttncctgatttgccttaactngctcaatttatcttgtgctatggatttgccctcgaccgttcngctttccnatgttttannngcngcattttagtcaacaattgngggtgctcatcacccnacatgcngtgnacaaagtcaaggtactttattcttatttcttatcctatatnctgtgttacgggggngnngcnaccatgggcggggnaccacccngccccagcngttgtgctccngcctgacaattggtctggtcttcacgttnggngggggggtcg

SEQ ID NO: 699850 - DNA, 410 bp, Homo sapiens
  misc_feature (395)..(395): n is a, c, g, or t
caagcttaaatcctatcttaaacttaaagaaggaagatttgaggtgcagtagtggaaagttaaccagcaaaggcacattaaacaggggtaaggttcattatccagagttaagtccatgcattcttaattgataagacttttcagggattaagttatccttctcttcttggggtcaaaagaggtagcttttaaagggggatttcctttataggggtaaattttccttacacaagtaactttaactctgttttaacaacttccttggttagcatttttttttttcaaaataattagctgggaataatttttaagccaaagggacatatttgggggttgcatattctggtttcctaccattatatttgggggtggcatagttgggccttatacactgngttctactggcaatg

SEQ ID NO: 699851 - DNA, 358 bp, Homo sapiens
gagcgtacatttgcagatcggcctgcggtggggatggtagtttatatcgggaacaaaagcggtgcaaacgttgttgcctcacaatcacgataaagaggtatccatttgcgaaccagattggcgttgatccgcagcaggcgcagcatgatttgctggccgagaaacagccgtcgctggagtttgtgacgccgccacagctgggtgagttggtgttgttcctgtgcagtgaagctggcgcccaagtgcgcggcgccgcgtggaatatcgatggcggctggctggcccagtaagtcaggcactgaagatcacatgtgggagctggcttgcctgcgatagcggtgggtcagtaaccaatgag

SEQ ID NO: 699852 - DNA, 127 bp, Homo sapiens
aatgttgatccctacttttttttttcactgctccatggaatttaaaagtttgggaacccctaagccaacatcctatttaaagttttgagacttattaaggtattaaagtaacagttttattttgaaa

SEQ ID NO: 699853 - DNA, 558 bp, Homo sapiens
  misc_feature (21)..(21): n is a, c, g, or t
  misc_feature (95)..(95): n is a, c, g, or t
  misc_feature (98)..(98): n is a, c, g, or t
  misc_feature (139)..(139): n is a, c, g, or t
  misc_feature (150)..(150): n is a, c, g, or t
  misc_feature (176)..(176): n is a, c, g, or t
  misc_feature (182)..(182): n is a, c, g, or t
  misc_feature (185)..(185): n is a, c, g, or t
  misc_feature (192)..(192): n is a, c, g, or t
  misc_feature (217)..(217): n is a, c, g, or t
  misc_feature (258)..(258): n is a, c, g, or t
  misc_feature (285)..(285): n is a, c, g, or t
  misc_feature (288)..(288): n is a, c, g, or t
  misc_feature (328)..(328): n is a, c, g, or t
  misc_feature (458)..(459): n is a, c, g, or t
  misc_feature (466)..(466): n is a, c, g, or t
  misc_feature (469)..(469): n is a, c, g, or t
  misc_feature (472)..(473): n is a, c, g, or t
  misc_feature (479)..(479): n is a, c, g, or t
  misc_feature (484)..(484): n is a, c, g, or t
  misc_feature (546)..(546): n is a, c, g, or t
atttaaagttggcttgtccanatatactataacttagtgtctgtatttaatattgacaaccaaaaatatatataaatatcttgcatctccccccncgngggcgggagctctccatgtcttcttgagccgtgagtttgcnggctcccacangccctcttctcatggtaatagtgtgnccctcngtnccaaggngactagaacccggccgcccagactngcccttcccctctcctccctgccctccagtgctcccaactngtctcaggtaaagaaagatttatttgngtngttgggtagggagagatgggaaggggcaaatcctaatggngcctgacccctagagtggggagatccaggccagccgaacgggtggccatagccacctcctgggatagaagctttgtagttcatagttcgattagtgtgtccttaggacataggtccagccctacagattnnctgggtnaanaanncaagtntctcnacagggcttagtctccaccctcaggcatggaaccattcagggtgaagcctgggatgtgggcncaggagactcag

SEQ ID NO: 699854 - DNA, 346 bp, Homo sapiens
tttttcccccgggtttttccaaaaaaaaaaaattgtggggccccccccccccaaaggggttttttgccccccgccgccccccctttttaaaagggttttttttggggcccccccttttttggttttccccccccttttttttttgggggttgtttttttggggccccccccttggccccccccccttggggggggccctttttttttttccggggggggggggtttttttttttttttttggggccccccccccgccccggttttaaattttttttggggggggggggggggggggggggttttcctttggccccccttttttttctcccgggtttccccggggga

SEQ ID NO: 699855 - DNA, 80 bp, Homo sapiens
ggaaaaaacatacaaatttacttaacgtgtatacacaggaagaatcacagcgtgattacccacccttctgtcgtcttctc

SEQ ID NO: 699856 - DNA, 127 bp, Homo sapiens
  misc_feature (33)..(33): n is a, c, g, or t
  misc_feature (35)..(35): n is a, c, g, or t
  misc_feature (40)..(40): n is a, c, g, or t
tcccggaacgctgcgtgttgtggaacgctgccnanactgntggtggaatttgcccgggctggcctcacggagcccgtgctcatccggcttgacgtggataccaagctcaacgagcagcgttccacaa

SEQ ID NO: 699857 - DNA, 1220 bp, Homo sapiens
ctctggtgtgcccccggtggttgtggatgcgagaaggggggctgacttcctagggccgcctgggtagtgttgtgtttcgccccccgcgcagtattagtgtgtccctcaacggtagcggggttcttgtgggcgccctccctccctccgagtgcggtgttgatggccccctttttgaaagagggatgtgggggcgacgcgcgtcccggtcgcgggggtcagcccgccgttggtgtaaattttctcccttgtttccccagggggagcccccctcgtgttgttgccccaagggaagtgcgcgccctgggggaaagcgcgtttgtgctcccaattccgaccctgaccgtgataaagttgtgtgctcccccattttcgcgaccccctttccacgggccccccaaaagttggggcccaaataaaccccctcgtgtgggcctctttggtgagaaatttttctctgggaagagaggtatctccccttccaagcgttgaaaggtgatcgcccaaggatcccgccagaacttcggaaagaagattttgtgttccatggaacacgtttcttttataacaccctctctttggggttctcttatccgatatcttttcgggggccccctaaaccccctcgtgggtccccagattgtctttcagaatgggatatttaccctcggacccacagcgcacctgtggaaagattatatcccactttgtagacctttctcactgtgggaattgtggttaaataataggcgccaacggagcttctcttatcccgagatatttttcttgtggtgcacatatgaggtgtgtaaaacccacaggtggcacaccctcgaaagagcccaccagatatgagaatataaataatactcctcgacgctctggctctttggggaaaatcactggaaaaatatataagttctattgtgttataagactgtctggcacagctcttcacaagcgtccactgtctcgtgtatagcgcactaagctcttggcacctctcacacaaaaagcgttataatgtataagtgacgcacacccacaccaccctcttccacgccactatgagagttttaaattatgccccacctatgaagcctatgtgtgtgtgctttcttaaatgtgtgtgcccacatggtggagtctttgctatctgaaatgtgtttgaacaatgttttgagattttttttaaataaattattatttgaccaccatcccca

SEQ ID NO: 699858 - DNA, 893 bp, Homo sapiens
  misc_feature (678)..(678): n is a, c, g, or t
tcaaacaatttgtgagcatctccagtacttgtgtaccttgtgcaaaacagtaataggcgatacattgatccatcaggatttgttaaagccttgggcctggacgactggacaacaggaggatgctcaagaatgttcaacagctctttatgtctctattggacagatacttgtgtctaagcaaaagaatccagatgtgcgcaatatgtctcaacagcagttctgtggcagaatatgcctatgtaactgttgtgcaaccagtgtggcagagagtctaagctttcgtcagaatttctatgagctggagttaaatatccaaggccacaaacagttaacagatggtatctcggaattttcgacggcagaacaagtttagatagggagacactcgctattttgtgcgagaactgtcaaagcaagaccagacatgcaacgaagaaagattcgacttctttagccttccttgcatttctgaactttgcagctaatgcgtttggtcttttgacaggcaaactggcacataatgaaaaaagctgatacctacatgggttctcacccaagtttgcctatggacgccttctgtggcccttacacggtgggtcctacgtgtatgaactcagggcagtcttcatacacagaggattgacgtgctatctggcattacatcgccacgtgaagatncacggctgtgaatgcaaagttatgtgaggcctgaacccatggggacacttcaactaggtgccgaacatggaactctagctcaacgtaaccattggaggacctgcccaagctttttgctagggcaccaaaaccattgttcccgtcaacggagacggtcaccacgcggttgcgcccacagagtagaacacagtctctctgtttaacttctcatataa

SEQ ID NO: 699859 - DNA, 641 bp, Homo sapiens
  misc_feature (189)..(189): n is a, c, g, or t
  misc_feature (238)..(238): n is a, c, g, or t
ccctggtaaatccaacttcgcccagattcgagcccgccccgaatatttcccaagacgattcgccccacttcccacgaattcgtatttattctcaccacgctgagccaccctttgtggctgaagcctaccacgcgagtgaaaagtttcaaccccgcgggaaagtggaccacgccctccactcccaagggngtatatagagaaaatgaggccccctatgtgtccacccccacacggagancctcccccacccctcccctctccaccagcagaggcgagataagtgagagatatctgggcttttctcccccaccactctttttttgagagagagaccccacacccccacgcgggtccccagcaccagccctattcccccgccccccagtatcacatgccgatgggtccccccacaccccggttcccctgaaccccctctcttggaattaaggaagacctgaagacttatgccccccttttctctgtgggaaattactttcccctccgtcccctgtgttaactggggctgtttggggaccatgcgtgatttttccgtgatttcctacagtgttgttccctccctcaaggctgggaggagataaacccccaccccgggattctccataatttttattacttaaccc

SEQ ID NO: 699860 - DNA, 132 bp, Homo sapiens
caaacataaaatgatgatggtctccgataacgtgcagagctccgactggaagagaggccagcgcgggactccaggtcccaggaactcgaggctcactgccgggactcccctcagatctcctttccattgagc

SEQ ID NO: 699861 - DNA, 248 bp, Homo sapiens
  misc_feature (147)..(147): n is a, c, g, or t
gactcggtcatcgtggtgctgatcggcggagactgactcaaattacacttcgggcagtaactgagaacatcaaggtcttgttccccacggagatccattctggggtcctggaggtcatcttcagcgtccccccaattctaacctganttctcccccctccgagagtcctttggggaccccaaggagagagtcaggtggaggaccaaacagaaactcgattacttgtgtctcatgatgtaagcgcaatc

SEQ ID NO: 699862 - DNA, 137 bp, Homo sapiens
accgtggaggggaatagactccatctatccatatgagctgctgcagaagaatattttgcctgctggaacctgctgtatctactcaagagtggaagttttcacagatgtagaactatgacagactttactttcaccat

SEQ ID NO: 699863 - DNA, 887 bp, Homo sapiens
  misc_feature (30)..(30): n is a, c, g, or t
  misc_feature (93)..(93): n is a, c, g, or t
  misc_feature (149)..(149): n is a, c, g, or t
  misc_feature (155)..(155): n is a, c, g, or t
  misc_feature (161)..(161): n is a, c, g, or t
  misc_feature (280)..(280): n is a, c, g, or t
  misc_feature (293)..(293): n is a, c, g, or t
  misc_feature (389)..(389): n is a, c, g, or t
  misc_feature (782)..(782): n is a, c, g, or t
  misc_feature (886)..(886): n is a, c, g, or t
ggtgcccggagtcttaagacaccgccagtntctgggccttcagtcatggtaggggactccagagggcacgcccgcctcttgaagccctaagtncggcttggaggcagcggaacctccggagaggtcagaggtagagcgaggacactgtnggaggnggtggngctggtctggagggtaccactaggggggggatttcagcccctggggggggcaggtcacccgatggggaccgggcctgggggttggcagggagtgggttccttgggggtggggggttggntggcccctgaganttagtgcctcgtgccagcagggccctctgcggaggtcctggccgtttagagggaccagattgggctgctctgtactggcaggtgggtcccttgagntgggagagttggtggtggagggggggacggtaccagtagctggcaccaagcatcaccaggaccaataagaccaggaggctgaggagcagccgctgtggtcagggagctggttgctttgagctgagtggtgcagtcagggggtgcccagccctcctcacagtagcagtgcctgttgctgtcacagaccccatgtccatggcatttgcttcgacattcctgtgcccccaggagatccacacgctggcatcgatggtctatacacaccaggccagggccacaggctgtgccaggcagagtcaggaggggctgggccacatcactgcccaggtccaggtgcaccagctgcagttcagctcagtcccattcacatctattgtctcccagagtagatcncggatggagcccagcagaggctgggtcctacctgtctggcactggagctgcccacaaatggcatctctaaggggtgcaggacacataactgccactgggggttnc

SEQ ID NO: 699864 - DNA, 576 bp, Homo sapiens
cgctgggaatctgccccctatactttgttttgccgccccttttaccgcagttgcctcccgtctgccgtatcccggagcaaatttcccccggaattctcgcccctttccagccctggtgcaaactcctcacacgccacctccctcattatttttctaacaaataaagtccaacccatgtaggctaattcctctacaattcttttcgcgtacaaaatagtttaaagcaaaatttgcgagacctcttcgtccgcggtaattttaaaaggcctctcttgttagagttttcttccccctcgctgtgagatttcttgcggggaagcggccgaggtcccctctcgctttaattccgcggagaatatcagacctttcgagcagaccctccgcgcggtcgtgtgcggagcacaccacacacgagctttttcaaagtgtgcccgcccgagctgtggcacagctttcttgtaatgcgcttttgaatccgacttattggacaccaatccccgtctgggcctcgggtgcgcgcacaatatcccccgcattttattccacaaaggaaacaaataacaaacaaaaaatcaa

SEQ ID NO: 699865 - DNA, 116 bp, Homo sapiens
  misc_feature (74)..(74): n is a, c, g, or t
cattaaacagtctgcaggaagctgcacagggcaagagacttctcctgttccgcgtatcttctggagctcttgtntactgagcatccagctggtcctgagctataggctctgctcac

SEQ ID NO: 699866 - DNA, 573 bp, Homo sapiens
cgagatggctcacgcctgtaatcccagcactttgggaggctgaggcgggtggatcacctgaagtcggaaattccagaccagcctgaccaacatggagaaacctcatctctactaaaaatacaaaactaggccaggcgtggtggctcatgcccgaaatcccagcactttgggaggccgaggtggacggatcacgaggtcaggagatcgagaccatcctggctaacacggtgaaaccctgtctctactaaaaatgcaaaaaaattagccgggcatgtatcaggctggtcttgaactcctgacctcaagcgatcggcccacctcggcctcccaaagtattgggattacaggcgtgaggtgccgcgcctggcctaacaaatgagtttcttgacacataaggaaccatcatccctagcatccacacgcacaggatacatgcccggacacggcacacacgaacacaccataacattggtcaaaactgtgcgggaactcctcaaatgaactcattcacacctactctattcctcattggcaatgcttgtcttgtgagtcccacaaatctctgccatatcc

SEQ ID NO: 699867 - DNA, 676 bp, Homo sapiens
gaagaggcgagaacgacccccgtgatccgaccaaagcccgcggcgccgctgcatcccgcgttccagcacctacgtcccgctgccgtcgccgacgcgcgaccggatgcccaagagaaaggctgaaggggatgctaagggagatacgagcacacggtgaacggacgagaccacaggatgaatgatccgcgacggttgtctgctaaacctgctcctccacaggccagagcccaagcctaacaaggcccctgcaagagtaagggagagaaggtacccaaagggacaacagggaaaagctgatgctggcaacggaggggaataaccctgcagaaaactggacgatgccataaacatgaccaggcacagaatagcttgaatggtgctggaagattgccataggtgaacgtgtgtgcattttgtgataacctgtgtacttctgtgtgactgtaccagtttgaaatactatttctgtactcaaacggttctctagtagaacaactgccagacatgtctggtactcaacgtgtatgaacgcgcgaccactgatcccaccacgcgccacactatcgcgcctaaacccaccgcgcacagccccttcccacaccgacgccttaagcgggccaacagggggccctaagtgcactctcaactacaaattggccgtccccaagccgggcat

SEQ ID NO: 699868 - DNA, 145 bp, Homo sapiens
cagaattatctatggggtgactaaaagttcaaggtgctggctttacaacatcagtttaacagactgttatactgtctaggatacttagcatctacacatcaacaaagagaaaacccaggaagatcactatgaagaaggataataa

SEQ ID NO: 699869 - DNA, 1060 bp, Homo sapiens
ggagagagagagagaactagtctcgaggtttttatttcttctatttttaatctgggaaaccggctccattctgggtctgagttaggaccttggggctgtagtggggagctaggagtcccattggaagggcgcctgcagcgacaggctgtggatgccggcacaggctggcccatgctggcccgtgcagctaggcgccactataagccagaattgtcagcggccgaaagcccgtgcactacaaccagcttcacggtaaaacgcaggggtcacaagggtgctcaaattgcggcgcggttgaaaggctgggggatgccaagaggtgtgcggaaggcagggttgaggctcgggccgttgagcccgacaggcggcttgtagaacacttgtcccagaaaagacgttcgtcgaagtggggaagaagtctcgactcgtggcgacacagggcgccatgccgagggcgagtgacagttgttggccccggaaatagcacaaagccacgcgagcggcccggtgtaaggccggataaagggcgggacaggcccgtaacagcggcccttcgaggagattgtatgtacttgtgcaataagccacgaagttagggagattgaggccagagcaattggcacaatttaacgtgtaagcacaggtaatgcaaagagtcttttagacgcacgggggtacccaagggggcgcccaggagaaactcccaggaaaattttcccccacggttttcagcagaaaagcagcaattcgtgaggttacgacctcttttacaaagcaccgaaagctcaacaatagtttcgggtggccaaaaaaaaggtcttgaagggcccccaaggtgcttaagaaaagcgtggggaactactccctttggtaagcgcgtatagaggcgtttaaacaacacaaaggggtggatctgctccgacacaggggcccccaagaagtacgagtgacatggttcccggtaatatcacggccaaaggggcttccatgcggagaccccggaagacaaatagggtatcgtcgaccaaagttaggtggttttcggtggccgctattctca

SEQ ID NO: 699870 - DNA, 111 bp, Homo sapiens
cgcatcttcttttgcgtcgccagccgagccacatcgctcagacaccatggggaaggtgaaggtcggagtcaacagaaatttagtcagtatgggacgcctggtcaccaggct

SEQ ID NO: 699871 - DNA, 344 bp, Homo sapiens
ccagcaaactacagcccagagcatgtctggccacggttgtttttgtaaataaagttttattggagccgggtgcggtggctcacaactgtaatccccacactttgggaagctgagccaggcgatcccttattagcctgaccgctgtggcaaaatcctttctctactaaaaatacaaaaactagccgggtgtcgtgctgcacgcttatagtccaagctactcaggaggctgaggcaggagaattgcttgaacccaggaggtggaggttgcagtgagccgagatttttccactgcactccagcctggacgacagagctagactgtctccaaaagaaaaagttgtact

SEQ ID NO: 699872 - DNA, 199 bp, Homo sapiens
gcaacctgaacttgaggctgggcagtctcctctgccacctgatgggcaccatgccaagccacccacacccagcctgcagctgcctggggcacgctcttagcagtggagccctgtggtctcagtgcctccaacttttggccttcagtgacacccgtgtaagaacatgagcacacgttgcttggacatgtgccatgttcca

SEQ ID NO: 699873 - DNA, 1310 bp, Homo sapiens
ggcaaggcctatgtggtcaggtccatcctggaccagcgtggcacgtggccagcgggctgaccctgtgtctgggcagggctgtgcagcgccacttagtggacacagtgcacttccactcaatggctgggccgcggctggatggagggtgcgcgaccgtgctcagagcgtcatcgggggccgtggccgctgcagttcaggggcgagctaccatagatccccttgatgatgacatggtagtccactcgctggccctgctgaatcacgacgtgacatgcttgaggacggcaaagggctactacagcctgtcctcgcacgatggtactacactcgctcaatggttgtcggcatggctctgggagaggcacccgtctgcccgtgagcggccttcactggcgtcagtggcagcactcgccgcgcacgcgcaggcgcggaccgagctcctggcagtccgtgagcgtcggaccgctcttttcgactcaggcccgcctacgtactacctgctgtttagactcgactggacacacactacatgcggcctgcggcctgtcgtccgtaggccgtgcccccgccgtcctagctgtcccacaggacgctcccgcgacgcccagcacagcaaacaggaggagcagctcccagagccaggcagggcccctgggcccgtcggctggcccccgttcccagcacacaccgcacacacatcgtccgctccactgtcctgggccgccctgggacagccggtgggccacagcccgacttgccctgtctggtcctgtggctttcccccgtccctgcggttcagaccgtgctgccgtgcctgctctgtcctctctcactcctgttcggtggcggctaacgcaccctgacccagagccacggcactctgccccgctgcctttggcacgaccccacccaaacctcgcgccccgcacctcccgctcatcctgcggctccgcttcaatcacccggcgaagctccactaccccggaccctatacaacggcccgacggactgaccaccaataccgtcacacacaggcccccacccccgcgccctccctctcgcacactgcccgccatcacggcacccccgcccacgcgtgcgccaccaaggccacccccccaaccgcaccacaccgacacgcgagcagtatgcgcccacgcctcggacacataccacgacacgcaccaccccaccaacaccacaccgcacgccagaccacaccgccactcgacaccgcaacaaaagagcaccaaccacgccaccccaccgaccacacccgccgcccacacaacggcgcccccgccccccat

SEQ ID NO: 699874 - DNA, 588 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccggggaaacaagtgtactcaatttcatttcattcagttttaacaaacatttattaaatgtttgttaatgtgtcactcagtgtaattgctgccagttttccctaaataatgatttcatcactttttttgattagatagttgaactacactgtgatgaagattatagctattttttatatcttttttttggtttcagtactggttattttttaagctgaatttttattaagcagataatactgtatgcttttgagtacaaaattgtagtacaccagtatttccaaaagaaagcttaatctcattgctttagtattaacatagaagtgtggataatagcataattttatttttatatttgtatgctacaacgaatgaagtggaagttattcgggaagttattacaccttagagtttattttggactcttccattaatgacttaatggctctaaatgcgtcacataagtatttggatgttagtgatcatgatgaggatgatgaatgctatgttttaataaatagataattgttaagtaacttttctaccatagtagagtagaattgctttttactg

SEQ ID NO: 699875 - DNA, 338 bp, Homo sapiens
  misc_feature (215)..(215): n is a, c, g, or t
  misc_feature (317)..(317): n is a, c, g, or t
gggctgctcgtgaggatgggacagcattgacttactggggagactcccttgatgacagccttacacggttattcataaggaggcaggaagaggcgctaacagtaagcatgttctgggtggtcttcggggtgcacatgtgcagcagctgtacctgcttgcttgtatgttacatgtctcattaacatctgaaatctccacccgggagtgtgtttttnactattataatgagcaaaggttcagtctgaggacaggtaaaatcaaaaatgtgcaccctcttacgggggaaattccttactggagctagtttggcttgaagngaactggactacagtgtgaat

SEQ ID NO: 699876 - DNA, 137 bp, Homo sapiens
catatgcgcgccagcgcctgcaactgctggcgcacaccgcgccgagcagcagggcggtgtgccggttgaagtgcaattgcagcgtcctgattacgagtgcgtcgtgcagttgggcccgcaatggcgtgtccgtttgg

SEQ ID NO: 699877 - DNA, 903 bp, Homo sapiens
ggtaaaacccagcccatgacccctaacagagcgccctctcagccctcctaatgagctccggcctagccatgtgatttcagttccactccataacgctcctcatactagggcctactaaccaacgacactaaccatataccaatgatggcgcgatgtaacacgagaaagcacataccaaggccaccactagcgaccacctgtccagtagaaggccttcgtatacgggataatcctatttattacctcaataagtttgttgtctgtcgcgaggattgtggtctgagccgttttaccaactccagcctagcccctaccccccaattaggagggctagctggccccaacaggcaatcaaccccgcgtaaatcccctagaagtcccactcctaagacacagtccgtattactcgcatcaggagtagtcaatcacctgagctcaccatagtctaatagaagaagcaagcgaaagcaaataattcaagcactggcttatgacaattttactgggtctctattttaccctcctacaagcctcagagtacttcgagtctcccttcaccatttccgacggcatctacggctcaacatttttgtagccacaggcttgccacggacttcacgtcattatctggtcatatttcctcactatctgttcatgcggcaactaatatttgcactttacatccaaacatcactttggtttcgaaaggcaggcgcctgataatgggatttgggacatgtgggtgtgggaaaatcttggattggtccccctcttattggaggggggggttttaaacaaacaacaaaaacacccgctgggacagaacggaaaaaagggaacaacaacacacggcagggaagcagcaggaaatcgaaaaaaccgtggggcgaccatactccacaa

SEQ ID NO: 699878 - DNA, 713 bp, Homo sapiens
  misc_feature (411)..(411): n is a, c, g, or t
cctcataaacaggaaatgttttcccgaggacataagactttgggggttaacccttcaaagttaccgcatatcgccaaaaaaagggttcaaacatcggggtgaccaaaccaacccggtgttaaaaaccagggcctccctaaagtggcgggttcaaattttatgagaaccggggggcccgtcactaatttatcaggacccctccgactgcaattttacttgagaggtgttctgtgcttacccacattaaagcccgtcttgcagtttaaacccaaagtcttaacaaacctcttgggatcctatcactcacgttttgtcttcccatgagtcttgttttgttagatatgctcaccacttttcatggacagtctgtgcggccaattattcgtatagagtgtatatgaagcccccaanacctattggatacatgcttggtaattctccagttcctagcaggcacctatttcgaccgtttcaagtgatgaagtcacgataacttacattcgatactgtttctgataacgggccgacttaatacccatgttgcttttgacataagggatagtgttgacagataaattagtaggaatagatcggtttgtaaaagtctaaaaactggctgtatagatatgaaaatatggttcaccaatctggaactgtgagtttgtttttgacctttaaatgtgacaaataaaccttttgggagaaaaaaaaaa

SEQ ID NO: 699879 - DNA, 124 bp, Homo sapiens
taagttccttcttggtaaatatcctattggtggggtaagattttactatatctgtagtttaaaattctggctgtgtagactctgtgcagctgcctctagtggtgacgaaaccaagcttttttat

SEQ ID NO: 699880 - DNA, 604 bp, Homo sapiens
  misc_feature (325)..(325): n is a, c, g, or t
gcgtaaacccacaggtccacaaatgagcgttgaagattcacctcgtcacattcttaaaatctggcccacctatacaattataaaatacaatactctaacaaaagttatatggcgaattatacacaaaacaagctttatatcgcgcgaatcattataaaaaccaaaaaggggccggtttttattattggcggcgttgaaaaacaccttgatatattggcgggttaatattataaagaagggctgtatatgtagaacaaaaagggccacacggcgtggccacactgggtctatcaccgcccctcgtataattcccacgccacctctntttggggagaggtctcgagaggtttttgggaagagtttcacacggaacccacgccctcgggtgacacacacactgggtggaaactcgtggtgtcttctacttaaaatacccacaaattagccacggcattggtggcacacgtggcctcgtaattcccagctactcgggaggctgagccacggagaatcgcttgaacctcgggaggtggagccttcccatgggctgagatcacccccttgcactcccgcctgggcgacacgagtgagactctgtcttcca

SEQ ID NO: 699881 - DNA, 815 bp, Homo sapiens
  misc_feature (67)..(67): n is a, c, g, or t
  misc_feature (600)..(600): n is a, c, g, or t
aggaaacaatttttttgggataaggtagtttttccaagattttgggaactgaagacatgctttggancagaaaagtattcaacttcagacttgccagtgaatttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgttaattatcagcattttgccattntattttttatcttctacacgtacacgtttcctgcccacccctgccagattattttaaaacaaatctgaagaccatcatatcatttcacccataccttcttcaatatttatctctatctgataaggacttttaaaaaagcataactataatatcgtaatcagacccaacagagttaacaaccagcctaagcagcatagcgagaccttgtctctaca

SEQ ID NO: 699882 - DNA, 536 bp, Homo sapiens
  misc_feature (321)..(321): n is a, c, g, or t
gaatgttaatgtaataattacccttggattaaaaggaaacataaaccattctcccttcgttttttcttatattcttctttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgttaattatcagcattttgccattntattttttatcttctacacgtacacgtttcctgcccacccctgccagattattttaaaacaaatctgaagaccatcatatcatttcacccataccttcttcaatatttatctctatctgataaggacttttaaaaaagcataactataatatcgtaatcagacccaacagagttaacaaccagcctaagcagcatagcgagaccttgtctctaca

SEQ ID NO: 699883 - DNA, 1361 bp, Homo sapiens
  misc_feature (67)..(67): n is a, c, g, or t
  misc_feature (743)..(743): n is a, c, g, or t
  misc_feature (824)..(824): n is a, c, g, or t
aggaaacaatttttttgggataaggtagtttttccaagattttgggaactgaagacatgctttggancagaaaagtattcaacttcagacttgccagtgaatttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaaaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggaataaaaaattctttgaacagaaacaaattactcagactaaatctacaaatncaactaattcaaatgtcaaagacgtggagctgaagaacccagcagaaaaaatgcaacatctcttattcttttgaggaggtngatgtaattttgatgaagatgctgggttttgaatgcaatcaaaacattcatggcaacaactaaacgacctgtaatccttactacaagtgacccaacatttagtttaatgtttgatggctgtttgaagaaatcaagttcagtactccttccctgctaaatgtgcagtacctacaaatgattgttaatgagaatttagaacctgatgtaaagacttggtaacctgttaactggcaaatactgtgatatccgaaaagtatcctttacttacaattctggattagaagtggaggtgggtttagaagaacgaccattaacctttatcgtggaataggcgaatgtccactaggttggtctgacagtgtctgtacaaattacctaaatataaagaacgtgtgacctcccaatgtgcagggcgtggtggacaccgttgggctaaaattttcccccggaaattcttttagccaccacgggggagggtataccccccaacaccgggatttatggtttcaccccccaacaagtctcgtggccatatgc

SEQ ID NO: 699884 - DNA, 533 bp, Homo sapiens
acccgcaccccgtgacagcccccaccccatggcttccatctttgcatcaccaccactcctgaacccccatttctgattgtcagaatttttttttaacaaaactaacaacatgaaacacatgtgtctgtggtatctaaaatacaaaaaaaaaaaaaaaaaaaacacacaacaaaaaaagagagggggcgcggcacccaccaaatatacaccactaaaagagggaccaaagatattcacaagataacaccagagataaacaaggaacaacaagcaggggcacacatatagggcagactacaatatatataaaaaccaaagcgcacacgacggaaagagcaagtacaaacaaaacgcccaaacaaaagagaaacacaacgcgaccacaacacgaggaggaaccccaccgagaaaaagagacacaccacacacacaagggaagcgaccacaaacaacaacacacatgcgcgccaacaacacaaccaccaacacacccaaacaagacaacaacaacaaccccctacataacgcccacc

SEQ ID NO: 699885 - DNA, 1324 bp, Homo sapiens
tacttgaaagggagtttggctcttgttcgcccaggctggagtgcagagtggaggtgatcttcggcatcacgtgcaaccttctgtgccttccgcgggtttcaaaatgatttctcctgtgcctcagccttcccaagatagcgtgggattacggggtgtgtgcaccaccagtgtttgtggcctaatttggtagttttgaagcaatgaaaatgtgggttcccaccaagtgtgtgtggctcgagggcgtggctctctcgaaacctcctgtgaacacctcgaggggtccactcccaccccacctctcgagcctctgcgcaagaggtgcggtgagaaatatcacggcgctgtgaagacccaaaaggcggcccacagggctttaaacacataatattctcgtgtggccgcgtgatatattgagagattttctcttattgttctcctgtgtgccacaactgtgagcggataccagagatatctgttgtttaaccctcacgcggggccaccataaacatatacagaacaggggcatatagttctacaatagtggtgcaaagggtgttctcacaaagttttatacgggcgcattatacggcggaaaactcttcacacaatataagcgtggcaccattttttaccacttctaattagcgccggggcatagaatattttggggggagaccccagtgtgtgcccctcggggggataacacacgtgggggagaaacgtggcaccaaatagtttggtggcgctccccccaaattatatttttccgtggagcaattccacaccaacagctggtggggagttgtcacactatcataccgtgcaagatgttgtatccaccccccttgtattcaccaacagttgtttccaaaaaaccccctttctttactacacattttgaggcgggaacgtggctttaaccaccattcattaatatgtgggggctccaccccccttacagtctctcaataaggggataacaacccccttgtggttatgcgagacagagtgttgaaacataattgctgagggacgatgggagtgacaagcggacaaaaggcggaacatgcttgggtgtgtaacaaatctagggaaaccgcagatgatgcatatgcctggtgcgatggcaacaaaacagtgttgcttggtgttaagaacactactattgtgacgaatagctttggtagtaggactgatcacagtaccgcaagatgtattaatccaatcatcgaaagaagtagttgtcgctgtggatatctatagactggttggggaccaaaattaaaacaatatatattgatgacagtgaggaaaatactcatcg

SEQ ID NO: 699886 - DNA, 127 bp, Homo sapiens
  misc_feature (93)..(93): n is a, c, g, or t
  misc_feature (114)..(114): n is a, c, g, or t
ccatctgtccggcgggctgccgatgccaggtgacccttcgagacctgtttgaccgcgccgtcgcctgtccactacatccataaccctctcctnagtgttcaagcgaattcgatncggtataccctgg

SEQ ID NO: 699887 - DNA, 767 bp, Homo sapiens
taacgatctggcactctcacaggccgttctcggccccctagttgatgccctgtcctttaagcacctcacgtgctggcctgcaggctcaatcgtctcaccaggggtgttccaatgcgacagcctaagcaccaacatctatcactcttggggcggtcaacaatcaggcccatgaagtctgccgcacccctacccctgtgcaatgggacgaccccttctgtgaatgcactttgagccttccccgcagaccagtgacgcgccagtcaacgatgagcacccagacaaggacacaagccacatcctcaacaggacaggcagccgtggctcccaaagagtcagggtctactcaaccagggaccacagagcgtacctgcccggtaaacgcgacgctcgactgcgtattaaccatgggcgaggacgaggagctctgctgttctctccgccttgagcactccaccctcaacggccagggacgcttgaggggcactgactcccacgcgcgaccacgccctgcctcggtggacgcgccaatcgaggcccccgtcccacacatgaatatgaaggagccggagcagactttctgacaggcgagctcttcaccctgcctgaagacatctctcctgccactttgtcaggcgcacgtagcacgtgtctctctatcttcgtctgaggaaaccctatccttctactgatgcttacactgcctcgggatctttgtctgactagtgtttgtttgcctgcaaagtgcgaactcgagctcctccaaggag

SEQ ID NO: 699888 - DNA, 169 bp, Homo sapiens
catatgaactgagcaaacccagaatatcacttggatctccagtcagcatagaatatcgtcatctgacatagatacagatagacgactgctcaaaggctatgtactctacaagtagacacccatataacaatgaattgacaagtggtcaaggcaacacggtctctcaggc

SEQ ID NO: 699889 - DNA, 363 bp, Homo sapiens
  misc_feature (34)..(34): n is a, c, g, or t
  misc_feature (105)..(105): n is a, c, g, or t
  misc_feature (133)..(133): n is a, c, g, or t
  misc_feature (140)..(140): n is a, c, g, or t
  misc_feature (146)..(146): n is a, c, g, or t
  misc_feature (154)..(154): n is a, c, g, or t
  misc_feature (156)..(156): n is a, c, g, or t
  misc_feature (163)..(163): n is a, c, g, or t
  misc_feature (169)..(169): n is a, c, g, or t
  misc_feature (173)..(173): n is a, c, g, or t
  misc_feature (203)..(203): n is a, c, g, or t
  misc_feature (221)..(221): n is a, c, g, or t
  misc_feature (235)..(235): n is a, c, g, or t
  misc_feature (237)..(237): n is a, c, g, or t
  misc_feature (270)..(270): n is a, c, g, or t
  misc_feature (329)..(329): n is a, c, g, or t
ataaaagcacaaaaatggcgcaaccagaacagcnttggctatcagacaggcagagacacggaggcccctcaatagtgacctgtgactatccacaaagggcaaggncctggcactgactccggccagtggaganggctgtnccgcanacccggcnanaaaaaanacccanaggntgaaagcacagacggggccgcggggcagcngccccgggctctcgtganacacttcagaaggnanaaatcctaaggaacaagaatcctgaatggaganaacccaacttttttaaaaaagaaggaaagtgtaatgaagggaatctacgggggtgggtnttctttaagaggtgagaactatggaatcttgcaa

SEQ ID NO: 699890 - DNA, 85 bp, Homo sapiens
cggcacgaggcctcatgttcatacacctatcccccattctcctcctatccctcaaccccgacatcattaccgggttttcctctta

SEQ ID NO: 699891 - DNA, 110 bp, Homo sapiens
tcgatctactggtcaccttcgagtagagaggcccggcccggcccaccgtggggcaagttccacccgcagatgacacgcgttctcctaccactcccgttctctctaccact

SEQ ID NO: 699892 - DNA, 130 bp, Homo sapiens
cggcatcgtccagtcagcacattcagcacatggtgccgctgcatcacagtgtcagcagggcacaggttccatggttgcatgttgctcagggtggcgcttcccacattcaggtgccatgcagtcaggtggc

SEQ ID NO: 699893 - DNA, 156 bp, Homo sapiens
gagtaccaaacacacagagtgtttgtagaatgaatggccaccaggtttgtccgatgaaattaacagtctaaatgttttcgcaattgtgttatgtaggataactatgcctcacatatgaatataacttgttaatgcttgtggggagtcctttcttca

SEQ ID NO: 699894 - DNA, 138 bp, Homo sapiens
tgtgctgtgagtcctaggcacagctctactgcctcgcttattcgatgccgatgcttggccatgccattgaaccgtttctatggtcaccgcgcagcactctacaccggttactcgacacaggcccattgcattttgaaa

SEQ ID NO: 699895 - DNA, 104 bp, Homo sapiens
gactccccttacatcagctgcttagactagagctcttctccctacccctatctatttactcttaccaatcagagacctattaggacactgagtacatagtatca

SEQ ID NO: 699896 - DNA, 289 bp, Homo sapiens
  misc_feature (144)..(144): n is a, c, g, or t
  misc_feature (148)..(149): n is a, c, g, or t
  misc_feature (185)..(185): n is a, c, g, or t
  misc_feature (241)..(241): n is a, c, g, or t
gcctcactcatgtaacctatcaggaaaagaattgcatccaagccctgcgtgcttgtagatgtgttcaatattctacacatacgatgagaaaagttccatgaagtgcagtgaagtgtggacaaggccttcagcccggtgtctcangctnncttatagactcaccagcgaattcatatgtggagaanaagccgctatgacatgtacaggagtgtggacagagccttcactcaaatgtgcccangctctattagactatcagaaaactcattcgtggagaaaaaccctatga

SEQ ID NO: 699897 - DNA, 132 bp, Homo sapiens
atatcttggcctcactcttgacctcgctcaagccagtcctccacctccctaatagcaggggctacaggctacaggcatataccaccatcccaactaattttttttttagaatgtttactaccactagtctca

SEQ ID NO: 699898 - DNA, 162 bp, Homo sapiens
gtggccatacacaagctaagcgaaattgtttctggaggatgatagcaccccaggtcagcagagtaactgcctctccagagcgtctcagaagcagaggctctgcggtccatccggtcttgtaaggatgactgacatccattccctttctgaaccctgccctga

SEQ ID NO: 699899 - DNA, 417 bp, Homo sapiens
  misc_feature (149)..(149): n is a, c, g, or t
ctggaaagggatggtctggactctcctcatgcagtttggaggtgcctggtacaaagcattctgcttccagagaaatacattgctacaaaaactggccattattctgtgaaaaaagacatgagtttttagttgtgttctacagctacgtnccgacccaatgcttcacatatccacacgaaagtaaaaggcaggtaagacaaaaagggctgtagttttttctgaaataactcaagtcttcaaaatatagcttttatattctttgtaaagtgggattagcatattgcaactgaagggtgttctaacaaacaaaaattccagtctggataataattctatggtagacaaaagaattctcagcctcttgggtttcctggaattctttgcttcatgctctcctcttccactatgcagctaagg

SEQ ID NO: 699900 - DNA, 354 bp, Homo sapiens
  misc_feature (35)..(35): n is a, c, g, or t
gtgagctctgaatcgttccacactcggcagtcaantagcataaaaacccggcaacatgattgccattcgcaacttccagagtgaagtcaatttctcggagattgctttcagcagtaacttttgtacccgcttcggaaatgatccgggcgatttcattttctcgcccaagatcagaaaaagcagcaccctttgtatgatcggtattgagaacgataaacccagcatccttaccatcaaaaacagcatactttcccgccaccagcgcagcacaccacgcatctaaagacggcgactccttccatccggcaaaggccgcgctttgcgacggggaaccgccaaaagagttgacatcca

SEQ ID NO: 699901 - DNA, 151 bp, Homo sapiens
tcatgtggtcgatctagagcatccccttacaaccccacgatcacctggaagcactcattgatccatttgacctggacgttttcacgccacaccgtcaacagctaccttcatcgcctattttacacctaaccccgtgatcgtggggttgtaa

SEQ ID NO: 699902 - DNA, 157 bp, Homo sapiens
cccaacaggaggtactctgttcagagagatgctgtctgtgcttggatagtcagtccattatttgtgtatgaagacaatgtacaaatcaatgttttgcaaataatgatctcagactttctaagttaaattttaaaacatttttgattgtttgcccata

SEQ ID NO: 699903 - DNA, 1354 bp, Homo sapiens
cttcattttatgtagccatattcgttagctagtttattcaagatttcttgtaatttagtgaggtgaacgactatcagatttcattatatggattctcggctatttgaggtaaaatttcattcttgtatatatagtgctgactatttattaagtatgaaattaaacagattggtaacctacatatagtggcctcctgactttcaacggaaaacgtgtgcagccaattacacacagccctcaacgctgtcacagagacttgactcggcattgcctctcattcgcttaacacattaccaacctacaaaaagtaggatgctacattttgtctctgtaacttagcctctcagcactctcccactggtacctcttgaaccccaaacttagcacttacggcactttctcccgcgttgaacacagaccatggactttactctgagaaagcgactggctccctcccaaccacaacacctaatcctctacttcataaactggtaattacattggtgtccattctaaggttgctcaatatgcctagtaaaccagccgcgaccgtaaacgggactgcgcttacacacatggactccaccggatgcaacttaaactaaacactcggacacgaccttcgcttcggcctagaaaacccctgactatcctccccgcatatgtcatccactgttgtatccacgaattgacctctggtcacgctccagacaaaccatccaagagaaaaaacacagacttcatataaacaatgaccctcgacacaacaggcaagctaccaagagcacccccaactccagtgcacatactcaactaccatcccaccacttaccgatgagaccacacctttcgaccgaccgaacacataccatcctcgataccgcccctccgtccaacctcaaacaatgctctagttgtagccacactgacctcatgcgcccttgccagggcgacaagtacgggacaatattgccgctccacgcctacacctaccatcccgccctgtcatgggcatcttaatagtgaataaatccaaattaccggacacagcagcatccctgcctaagctctcaacgccaaagggacgcacctaacacatagagacccgcccacccacaggctgcggccatgctataatatctagagtaaccaccatctcatatttttcgctattcgcgtcaccttattcttttcaattcatcttatttatttcattattctataattcctataatcttactccatatctatcatcccatctcactactcacctatcatctatcacgtcctcataccaccccatttcacccccctacataccatctcaacattcaatattatcatttcccaatcc

SEQ ID NO: 699904 - DNA, 647 bp, Homo sapiens
gttgcaaggtaatttgagagaaatatgttcatatctcaaccatcgctttatggctgagatatgaacatatgttgaaaggtaatttgagagaaatatgaagaactgaggaggaaaaaaaaaaaaaagaaaagacccacaacctcaactgcctactccaaaatgtgggccatttatgtaagggaaaatttccagggattatggccagttggagttgtacaaagttattgtgtgggcagatttttcagcaaacttctttgtcccacgtggttaaaaggagtcaggggattaacttgccattcacttcactaatccagttaggatccaggatgatccttacaagttcagaaaacataatctcgtgacctctctccaatgatccaaacataagtgcctacagatctgtcgtggaaaagtttttacacccttactggcatattttcccggggtcccgggaaattattttggggctaatgctacgaataagcaaggcaccttcagtgtggccctttcccgtggtattgacaacaatttgacccctttgtccaacatagggtgtattaaccactcaagaacaaacatcgactttaagaggctacaagaaagcttccctgtaacgaaccaaaactgcgagtttatcccatgaccct

SEQ ID NO: 699905 - DNA, 444 bp, Homo sapiens
tcagatgcaactttaccctctccacccatagctagtgctggaaaaggaccatttttgtcttttgaccatgtggcttttgtaattactcttttaattataactattattttaaggactaactatgtgctaggcagcacgctttatagagattatcttaattcttgaaacagccttttgcttacggtaatattactatgcccattttacaggtgatgctaatgaggactcattatatatgcacatggagtgaataaatgaattaaggaatggatgggtgaaaacaacgaactgtgaatggtccagccatcaccaataagacacgtaacaacttttcccatctcgcttcacgctgccaggcaacgcaggctggcattgttgtagtgagttgcttctgttccacacaagccaggatttaataacagaataaaggaatgaactcgcaaa

SEQ ID NO: 699906 - DNA, 168 bp, Homo sapiens
cttgatgcagctgatatcccagaggcttagataaaagcccacttagaactatacttgtgtccccctagtctaccctatataccctatagatttccacatctgtcctgcccccgtccctcccttctaccccaaaccccacacacacatacatacacatatatatacata

SEQ ID NO: 699907 - DNA, 964 bp, Homo sapiens
cgaagcaaccatcgacatgatggctgatgtactgcgacgggacctgataggagtgcggagcattggtatctgacgaagatagtcgatctagattgatgagccatcaagacagcttgggatggtggttatggtacccagagggaaaggcacgctgggcagctaccaaaacgcgcggcgtactcgcactaaggggagagcgccgatggagtagcgggaaaagatcaaagcagagacatacgagacatcacagtaagcggcggcaaacacatagagaagaaagtgcggcgagaatacaacgcaaagggaggaggggagagaaaagacgagggctgagcaaccaggacactggcgagagcgcacagagagacgagccacacgacaccgacctgatgtgggaccacacggctcgagagagcgcgaaacacgcagacacatgcccgagcgccgtgccacacatccggagagcgagtgggaccacagacagctcccgcggagagagaggggagccagcaagggtgggaggaacacacatttgtgacggcgtagaaatgaccagaaccgacgcgaagggtcaagcagcgagggcaggagaacaaccgaccggggagagggaggagaacccaccgccgacactcagtgggtaggcgagccagagaagcagacgaggacagcaaatagacataaaacagatagccgagggacaaccgcacacacacgagaacgcagaaaacggcacaatgaagagcgggaagcgacgacaagaaaagcaaagcaaagaggggacaccaaagcagagccaaccatagcagcgagagaggggaacaacaagaaagacaaaacgagaagaaaccacgagacgagacatgtggccgacgcacaaggggagacgacgacagaaacgcgcgcgcagcagagggagcagagagggcggaacaaaaacacaccgcagggagaaaaaaacagg

SEQ ID NO: 699908 - DNA, 113 bp, Homo sapiens
aaaccgatatagactccgccaagatgcagaataataacacatcccaatcacaccgttaacaatcagtagtaaacccctcataaatagttatgctgataatagtcatatgctgt

SEQ ID NO: 699909 - DNA, 209 bp, Homo sapiens
tgagatccccatcaccctaaatttattatggcatttttagggttaagattgttcggtttgaaaataggaaaaagtttaaaaactgaatgtccaagttttcttggaacggcagcaggtagtaccatccacctccacaaaagacaatggcctatgatgacagcttctgcaactaagcatgtctgacataataaatttaggtgatcctctag

SEQ ID NO: 699910 - DNA, 787 bp, Homo sapiens
  misc_feature (746)..(746): n is a, c, g, or t
gctttctttgcggaatcaccatggctggctgggaccctgtacactgtatcctgaaaactggagggccttcaatggctctcatctgctgctcagtacatgcggggctcaggtccgctgtgctctcctgcaccaccccacttccattttggccaaaccaacctgcaccccttgaatttctccgcaaaatttcctgcctggcaaggtcccatgcattttgagggtgatgatgggattcttgtgtgttttgagagcaaacgccaatttgcctactcatgtgcagcaatgcaggagctgcgtgggaaagtcactccagaaggcaggcagcccagtgtggttgcagttggggtgcagctttgcttgattcctgatatcagtggcccccaagcccaggtaaccttgtggttgttccccaacctttggggcaatccatgcacccaagaactaaactagtgcccacctgcagcaatgcaacaggcagtgcaagttgagggcgaaattctgggggcttgcttggattgccttactttggcacggcacgaggcactttttctggttggggcgaaactgagttgaccatatgggcctgtacctattcaccaggttggttctgcaaacccttgttgtggtgggccttctcatacagccgaggtttcttacagacgccctatccttttctctggacacagtgccgctttctcgcccaaatttatgccaaaacgcggctgttgtgtttcccttctaaccgnttgcgcatttttactaccaacgccgcccatcgtgtttccag

SEQ ID NO: 699911 - DNA, 327 bp, Homo sapiens
gcatcatccctggcgggcgcgcgggcgccatccggtaccatgccgaccccatgaactacgaaatcctgctcggcctgcgctatgtgcgggcgaaacggcgcaacggcttcatttccttcatttccctgatctccaccttcgggctggcgctcggggtggcggcgctgatcaccgtgctgtcggtgatgaacggattccagaaggagttgcgcacccgcatcctcggcgtcgcctcgcacattcaggtgaccggctacgacaacgaactggccgactggcagcaggtggccgacgccgtgctgaagaaccccgaggtcaaggcggccg

SEQ ID NO: 699912 - DNA, 317 bp, Homo sapiens
ccaaaaggtttttgtttttttgtttcttttggggggaaagagaaccaggttccccccgggccccccggttgggggggggcctgttttttttttaaacatccctatttcccccaggggtcctcccccttcccatggggccaatttttacccccaaaagggactttggggttgtttgttttgttttgggtaaaaagggaatgttggggggatgccccccccctgggcgggggggttcctttcccttttccccgggtccggggtttttttggggggggggccggtaggggcccttttttttaaaaaaaaaaagcccttta

SEQ ID NO: 699913 - DNA, 662 bp, Homo sapiens
  misc_feature (662)..(662): n is a, c, g, or t
tgctcgccgccgccgctgtcgccgccacctcctctgatctacgaaatgtcaatgttacccaatcacctgggacggcttggcaaggactgctaccacgtcttttactcaccatggtgcaaagccgttggcactttggcaaaagcttacttgacaacattttgacaaagtgcactgccaaaactgcgcatggacgccaaactactctggctctacgtatgggcctttgacaacactggcaactctaggcacctcatatggacccccatctaagttcctccagaacagctgaccccagtcatcaagtaaggatggcccaaagctgacgaaacattcctctcacgttaacctcttgggccagttgtgccccactgggcaaccaccgcgcacacacacactctccttggacagcacttggcccctaccgacttctcggggtgctacctgacgcaaccacaccaccatcgggtggcccccccacattaactgggtccccccccacactactcatcttgcgctatacctattactggggccttccgtctgggcatccctttgctgctctcgccaacccgcgtaaccggcaccccctctgcgaaccaccgcccaacacatgggctcaaacactcgccacagctcttctctcacagcgaccgtactatttn

SEQ ID NO: 699914 - DNA, 330 bp, Homo sapiens
ttgtactgaagcctttgcctgcaggcagcctgtccaattcgaggattgtggattgtacctgacattctgggacccacgatgatctgcatcaccagtacctatgaatgcctcatatggccgttattaagtacagtcattcagcgtatacttgcctgctctgtctcgagaagatgttgaaagtgcaagagctccctccgggttctgctgaaaccccagattcctttgaaaagcatattagaacattttgcacgtagggttgccaatccagcattttgaaacttctgaaaaggacatagcccttctcctgaagaatgccttcaggtcttcaga

SEQ ID NO: 699915 - DNA, 282 bp, Homo sapiens
cacaagtgggagctacacatcgggtacacatggacacaaacatgggaaacacaaacatgcgactatgagagggggcagagagggggtggggtgattgttgaaaaaacctatttactatgttcactacctgggtgatgagaccaatcgttccccaaacctcagcgtcacacagtatacccatgtaacaaacttgcacatgtaccccccgaatgtaaaataaaagttgaaattatatactcaaaacaagtggccaggtgcagtggttcatgccttgaatcctag

SEQ ID NO: 699916 - DNA, 121 bp, Homo sapiens
gacggcttttggcatagacctttcatggctttttagatcgggggacggagcgcgcatgagacgaacaggggatatgaatttccccgcccccacccgcggggagaggaacattaggtgcaaa

SEQ ID NO: 699917 - DNA, 1655 bp, Homo sapiens
  misc_feature (610)..(610): n is a, c, g, or t
  misc_feature (907)..(907): n is a, c, g, or t
  misc_feature (911)..(911): n is a, c, g, or t
  misc_feature (937)..(937): n is a, c, g, or t
  misc_feature (960)..(960): n is a, c, g, or t
  misc_feature (1115)..(1115): n is a, c, g, or t
  misc_feature (1234)..(1234): n is a, c, g, or t
  misc_feature (1469)..(1469): n is a, c, g, or t
tggtctggttgtttgtcgggtttgtttttcctccttttgttctctctttgcgtcttgtgtttgcgtatttgtttgtttttgttgttctgtcttcttttgctgtcttgttgttgtgtatctcctcttgtttttgttttgcgtgttgtgtgttgggtctccggtgtttggtgtccgcgtgtgttgtgtgtgttggcttgctcctctgtgtgtgtttggtctctcctttgtgtttcctatatgttgtgtgttctctttccgcgtgggttgtgtactatcacttgtttggttcgcttgttttgtctgccgcgtcggaggtgttggtgggtgtcttggtgtgctgtgtatgctttgcttatggtgcgtcctcttgtttgtttgtgttgttgtgtttggtgttgcccgtacttcttctgttttctgctctctctggtaagtatgtgtgtttattcgtatgtgttgggtgttgtttgtgtgttgattcttgttttgtgtttgtgttgtgttggtggtggtgtgtggtgtgtgtggtgggtgtttgttgttgtgtggtgtgtgtgttgggtgccccccctgccctgtgtggtggtgtagttcgacgggcgttaccccnaaagtttgtgaagggacgcagtgcgaccccggcttgaatggggtattctccagaggaccacaccgcatgtacccggagtatttttaaggtggtgcacccaccgtatgttatggaagcctctcgaaaagggagtcctcccacacaagaggtgtttggtcgacccacaaaaataacagcccaaggcgctttgtttataaacacccgactcgcgcgcacacgttatatctctatttataccgggttctctctataagggttattagctcgagagcgccctctcgggttgtggcgcgaaanattncgcgcgcacccgagaggttctcgaanagatttatagatgggtcgccccncactctctcttgtgacgcgcagcccccccgcgtataatctatattccgcccactctatgagaaagtttttcacatgagtctcacaccctcgcaggtttataactttctcagcgagagggagaacacacacaatgggtccacttgaaatggtgccngtgtcacaccccggcgtgagaagggcgcaccacgcgtggctctataagacacacgagaaattttcgcggagaaaaaacgtatgcgcgcacacaaagtggtaccacacgagcccacaccncacccggcgagatggtacacattcttgtgttatatttggaagatttcacgagaactccacatcttttgtggtgggtggccacaagagacacacactgggctcttggccacatgagatgttatatgagatgttccctcggagatataatgccacacaagagaaaaagtgagaaccccaaacactagagacttgcacaagacacactggcctcgtaatgagaaagagaaaaagagcnctccacagagaaagcacacgagaaaggaaacccccagaaccacgaaatgaaagaaaatctccgggggaactgcccaaaggcccaatgttggtgctggccaaaagccgaaggagtaaaggtgctgccatgatgttagctgtggcccctgtggatttttcgcccagaacccttaattaacttaaaact

SEQ ID NO: 699918 - DNA, 862 bp, Homo sapiens
  misc_feature (29)..(29): n is a, c, g, or t
  misc_feature (143)..(143): n is a, c, g, or t
  misc_feature (234)..(234): n is a, c, g, or t
ggaagcggctcgaggctggaagaggatcntgggcgccgccaggttctgtggacaatcacaatgggaatccaaggagggtctgtcctgttcgggctgctgctcgtcctggctgtcttctgccattcaggtcatagcctgcagtngctacaactgttcctaacccaactgctgactgcaaaacaggccgtcaattgttcatctgattttgatgcgtgtctcattaccaaagctggngttacaagtgtataacaagtgttggaagtttgagcattgcaatttcaacgaacgtcacaacccgcttgagggaaaatgagctaacgtactactgctgcaagaaggacctgtgtaactttaacgaacagcttgaaaatggtgggacatccttatcagagaaaacagttcttcttgctaggtgaactcgcgattttctggcagctagcttgtgagccttcatccctaatgtcaagcaccgatggagagctttctcccaagactccccgttacctgctgtagtcctgttttctcttgctggtcacattctaaagggttgatatttaccaaatggatccgggttgggacatgaataaaattagcttgagcaacctggctagagatagaggggctctggtgagactttgaagacagtcctgttttgcagggaagccccacttgaaggaagaagtctacgagtgaagtagtgtgacttgaactagatgcatgcttgctccttatgctcttgggaagaccagctttgcagtgacagcttgaaatgggtgctctgggaggcctcagattattgaactctgggtcttggatgtagccgcgaccaattaggcccttggaggggggggggagttttacc

SEQ ID NO: 699919 - DNA, 548 bp, Homo sapiens
  misc_feature (29)..(29): n is a, c, g, or t
  misc_feature (143)..(143): n is a, c, g, or t
  misc_feature (234)..(234): n is a, c, g, or t
  misc_feature (454)..(454): n is a, c, g, or t
  misc_feature (508)..(508): n is a, c, g, or t
ggaagcggctcgaggctggaagaggatcntgggcgccgccaggttctgtggacaatcacaatgggaatccaaggagggtctgtcctgttcgggctgctgctcgtcctggctgtcttctgccattcaggtcatagcctgcagtngctacaactgttcctaacccaactgctgactgcaaaacaggccgtcaattgttcatctgattttgatgcgtgtctcattaccaaagctggngttacaagtgtataacaagtgttggaagtttgagcattgcaatttcaacgaacgtcacaacccgcttgagggaaaatgagctaacgtactactgctgcaagaaggacctgtgtaactttaacgaacagcttgaaaatggtgggacatccttatcagagaaaacagttcttctgcgtggtgaccccgattctgcgcacgcacgcgcgtggagcgcgttcantcgccctaagtcaacaccaagggacggagcttctccccaaactcccgcgttgcntggcgtagttccggcttttctctttgcttgccacaattct

SEQ ID NO: 699920 - DNA, 342 bp, Homo sapiens
atacgtactggtggtcaactagagagtttaacagatctaccctattcttcttgtcgttatccaaggttcttgaagagttctgttgttctaaaatatcgtgttgagcttcccagttagctttctcatcctcgaactgaggacgtttttcctccaattcttagtgctgtgttccgaattctttatcattggctcatggcgcacgttgagctcagcttcagagtccttcagtatttgaacttttactttgaccttcatctgaaacatgtgctccatctcgatctccatcttcttcattaaagctacattttcccttctttcttctgccatttggccaggggggga

SEQ ID NO: 699921 - DNA, 158 bp, Homo sapiens
ttttggttcttgcagaacagacacagaggatagggctgtgggaaggagagtgtcaggacgaagaggagttttccagacaactttgtactccaccagccccaatcaagaagctggtcccacggaaagtggtatctcgggaatcagctcctatttaggaa

SEQ ID NO: 699922 - DNA, 310 bp, Homo sapiens
gtggcctgtgcctgtgttcccaactacttgggaggctgaggtgggaggatcacttgagctggggaggtggagatagcaatgagctgagattgcaccactgcactccaacctgggttaaacagaccctgtctcaaaacaaaacaaaacaaacaaacaaaaaaaaaaacagcaaaaaccattgcagactgtaaagagtaagtaaataggtgagcaatacctacttttgtttaccttttttaaaatgaacaatttgtagatattcacagaatgcaaatacttgttaataaatgaaaagcttgggagacatgaa

SEQ ID NO: 699923 - DNA, 421 bp, Homo sapiens
  misc_feature (246)..(246): n is a, c, g, or t
ggccccccaggctgggaggaaacccttttgccttttggtgggggttttggaaattgctttcccccccccctcccttccttttaaaaggaggttcctggctggaaccaaaaaaagcatgtttgtccccttggtgggtgctggggggggccgggaacaagggccccttaccctgtgtgttggccggggcctgcccccagccccccagcctggttttttcccttaaggtttgtggccctggaagggganacattcccttttgtttggccctgggctggcccttaaatgaggaaatgggtttttaaaaaaaattccccttttttttggccaaaaatcccggttatatattaatgtggaaaaaaccccgtttgcccccccatttgttttctgaaaatgtgaaaaagtaaaaattaaaaaactggga

SEQ ID NO: 699924 - DNA, 321 bp, Homo sapiens
aacatatcttaggaattaacttcatttaatatactgagcgttattgcaatacttcgaagcagaacaggcaatgtgcagccctcatttatagataaccctcaggatactcccagggtgtatgcttggagaagctgtgagttgacgctgaagctggagtaacttcctccagagcaagagggcttaagacagaaggaagaactcttagctgtgtctgttattttcactccagtttaagatggatcttggcagagagacatgctagttcctctggattggaaagatgatttactctcgggaatcttcgccaagccccagctgcgg

SEQ ID NO: 699925 - DNA, 737 bp, Homo sapiens
gccccaactctccgcgcttactcctgttggacgcgctgtcctcgccccatcctttgcttccttccttccttccttcttccttcctcccctgtgctccctgccctccctctccagtgtctgccctcccggggcccgattgtctctgtgtgccccagctccctggccctgcagccctgcacaccagatctcatcaccttgcagcttccatagatatcatgccctagcctgccagccagtctgcagacatctgcctgctgtggatgccaccgatgccacagaaccgcaggacgccctgacatgccactagacccctggatccaagcatacacaagcacgccagcaaagcccagcaaggcagcaccagcacacagacgggagatagccccagagacaagcacacgggggagacacagagactcgcgaggatagaggcgtacagcaagcaggcgccacacagaaccaaataacacgcacagaaagaccagcacaaaggaacagtgacactctggtgttctcgggaggacagtgatgaagtgtcacccgagagacacagcagtggcacaccacgacaatggagctggcgcacaaaaagaccaagaaccaaaagtcgaatcgaacggacgcccgaggacgatccgtgagagacccagaacctatcgagagacaggagaagggacagaagacacatgtgaacccctggaattagaggatcgagcaggaccaaaacacaatcaaaa

SEQ ID NO: 699926 - DNA, 811 bp, Homo sapiens
  misc_feature (8)..(8): n is a, c, g, or t
  misc_feature (108)..(108): n is a, c, g, or t
  misc_feature (136)..(136): n is a, c, g, or t
  misc_feature (147)..(147): n is a, c, g, or t
  misc_feature (241)..(241): n is a, c, g, or t
  misc_feature (254)..(254): n is a, c, g, or t
  misc_feature (317)..(317): n is a, c, g, or t
  misc_feature (330)..(330): n is a, c, g, or t
  misc_feature (393)..(393): n is a, c, g, or t
  misc_feature (447)..(447): n is a, c, g, or t
  misc_feature (545)..(545): n is a, c, g, or t
  misc_feature (549)..(549): n is a, c, g, or t
  misc_feature (552)..(552): n is a, c, g, or t
  misc_feature (580)..(580): n is a, c, g, or t
  misc_feature (660)..(660): n is a, c, g, or t
  misc_feature (664)..(664): n is a, c, g, or t
  misc_feature (687)..(687): n is a, c, g, or t
  misc_feature (695)..(695): n is a, c, g, or t
  misc_feature (702)..(702): n is a, c, g, or t
  misc_feature (738)..(738): n is a, c, g, or t
  misc_feature (740)..(740): n is a, c, g, or t
  misc_feature (749)..(749): n is a, c, g, or t
  misc_feature (773)..(773): n is a, c, g, or t
aaagtaantggcattgtgtgctctgacaattcagaaaaacccttctaagttcagcctaagggccaagacgtggccaggtggtgagagaacaaaagaggtgtgacagantaagcctgttgggcagccgtgagcctantgatgggcctngcggaagttgttgggacattcgtgagccaccaaatgccaggcttgatttaaggcatccacgacagccggctccaggggcccttcctctgtggcngccaagtcctgcnccagccgccccaggctggacaggcccaggatgaccgcgtccccgtgggccccctgcagccgtnagtggtggtacanccaccggagggcagccgaggtcacactgggggcgctggcgccaaaagcggcctgcagggcttnctccaccaacgcaatggcctcgaagtggtgctcctcccagaagcgattcctgtnggtctcagcccagccatccccaaagaagcggcccacaggctgtttcccgtccttgtcctcatacttgtccttgccagtcagcaggcccccagccaganggtngtnggcatagaacctcagtccaaagtgcctnaggcaggggaagagctccgtttccacctgccgggtggtggcgttgtacatgccctggtacacagtgggcaggatccagcnattnctcttgcagagggtacagatctnggccactncccagcnagcatagttggagaggccaagctccacgaacttgcncncctggtgcngcgctggcaggcatgcagcgtctnttccaccggggtgccgtggtcaggtgtgtttgggtaga

SEQ ID NO: 699927 - DNA, 478 bp, Homo sapiens
tgtttcacacccagcggaaaccacttcaagggcattaacgatctctcaaaactgatcagtttagtgcgagtaaaccatgtagcgttttaaaaagacttgtgcacttgcccaggctcaaggatattaaaatctagcacataaagcccattactagaggtagaaatacaggcgatatactattacggcaacaaccatcaattacagttaagaatttttctgtaacaaccaaatggataatcaaatattgcaacaactcaagtattactgagcagaagtgcatttctacagtattcagtgttgctattcagtttgctaacttaaaacagcctatgataactggcagcaaagaaggtccttgcaatagactgcctctgcttgagaacttatgatgtaattattgcatgctgctaatatactatctaaacattaaagatactcctaaaatatttgatggtagactatgattaagacattacac

SEQ ID NO: 699928 - DNA, 903 bp, Homo sapiens
  misc_feature (235)..(235): n is a, c, g, or t
  misc_feature (513)..(513): n is a, c, g, or t
  misc_feature (558)..(558): n is a, c, g, or t
tgaccttctctcacagtggtattctgtgaaagctgtagggctgccaccctccaatcattaggtttaagtcagttgcttattttataagagacttggtccctacccacttcgtttagtcccttcagcttctttctcctcaccccatggagcctgcacccctcctcctactcccttccacaactccctttcaattttttttctttctaagaattagagccgattagccacgtcattnattcttcaatttgacggctgatatagcaggacctgaaacacattgctgaccccggagaatggagaccccattccttagcatattgacgatgagagaagttaattaaaattccacagagcagaggtgtcggctaacctataaacctgtcgctgttcaaaacaaatcattctagcaatcgtaggaaagagggaaggaaagaccagcagggagtggagaggctaagtgtgtgggagcggagagtggaaaatggagccattgagctttgtctcctcctcagnttcttcctaatgctgcccttttaaaagccagttagccagacctgngatccgtgggctgaatagaaggaaagtgctatggccagtgagaaatgacaagtgtgctggtgactttgccttaatgcgtgcttgtggacttctgctggctttgggagactggagtggaggtggtggtagagagaagctctcagggccggagatggtctgtgcgcttccttcatatggattgaagccaaagaacacaaacaggctcttccctgcatccctacccaacacttctctattccagcctcctcctccggaatgtgttaggctacctcttaacaaaatagggcacaacaactaatggcttaagaatccggtaaatgattttgggctctttggcccaaactt

SEQ ID NO: 699929 - DNA, 305 bp, Homo sapiens
  misc_feature (276)..(276): n is a, c, g, or t
ctttctaaaacataccgttggcagcgcgggcccagtatgctagagattaacaatgctcactagctcgttttcctcagagaggattcctgggtctatgaagctagatgcgtctaggaatttctacactcaacatgttatcattatacctcgtgaggcgcgaaacctgtaagcggctactcgaaatctacaaatcacacgtactggtaagttactcgagcgttacaatttacccttgcgacttctagtctaaactcgcgtaggttccacaggctgagnctgcgtagtactcgatggttgactccctg

SEQ ID NO: 699930 - DNA, 567 bp, Homo sapiens
aataaatataccctccaaagttaccgactgtcccaactgagaagagtaagcccaatcgagtactgtcactctttgatggaatctcaacagggctccttgtgctgaaagacttggggatacaggtggaccgctacattgcctcggaggtttgtgatgaacccatcagggtgggtcatggtgcggcaccaagggaagatcatgtacgtcggagacgtccgcagcgtcacacagaatcatatcctggaattgggcccattcgatctgctgattgagggccatcccttgtatgacctgtcaatcgtcaaccctgctcgcaagggcctctactagggcactggccgactcttccaagagttctaccgcctcctgcatgatgcgcggcccaaggagggagatgatcgccccttcttctggctctttgagaatgtggtggccatgggcgtaagtgacaagagggacatctcgcgatttctcgagtccaaccgtgtgatgattgatgcccaagatgtgtcagctgcacacagggcccgatacttctggggtaaccttcccggtttggacaggccg

SEQ ID NO: 699931 - DNA, 497 bp, Homo sapiens
cagatcgaatcgagctcggtaccatgagatattaggtctcaaatgttataattataacccacttacttaaagacaaaatatttacaaaacaaagcttgatctaaagccatagctccgtctaggattcaatcacagaagaattaatggtgttttttaggatacacggtcctttatgacctttatcatagttagaagatgaggaattgggcgcaggggctcacgcctgtaatcccagcactttgggatgctgaggcgggcagatgacgaggtcaggagttcgagaacagcctgaccaacatggtgaaaccctgtctctactaaaaatacaaaaagtagccagacgtggtggcacatgcctgtgcatgtgctgggattacccagctactcaggaggctgaggcaggaggattgcttgaacctgggaggcagaggttgcagtgagtcgagatcacgccactgtactccagcctgggtgacagagcgagactccgtctcaaa

SEQ ID NO: 699932 - DNA, 528 bp, Homo sapiens
  misc_feature (62)..(62): n is a, c, g, or t
  misc_feature (137)..(137): n is a, c, g, or t
  misc_feature (159)..(159): n is a, c, g, or t
  misc_feature (242)..(242): n is a, c, g, or t
  misc_feature (316)..(316): n is a, c, g, or t
agcaggcttgtgggccccgagatagatgtcatcctcaaattccgggacaagattgagaaaanggagaaagatgtgtatgcagttctgcagctagaggcggaggaaaaagagatgcagcagtcagaagcccagatcantacagcaaagcggctcctgganaaggggaaggaggcagtggtccaagagcccgagaggagctggttccagaccaaagaagagaggaagaaggagaaaattgccanagctctgcaggaatttgacttggccttaagaggaaagaagaaaaggaagaagtttatgaaggatgccaaaaaanagggggacgatgacagcagcaggaacaggtctcagtcttgaaactcctcaaggcgcacggatgctttcgctgacacggctacgcgaacgcagcgaatcgccagcagccaagcgggcccgagccaatgcccgaggcagcgaagccagtgagcaggtcctgccaagcaagccaaaacgcaggggaacgcaaatctggtatttgcactgacagaa

SEQ ID NO: 699933 - DNA, 207 bp, Homo sapiens
  misc_feature (1)..(1): n is a, c, g, or t
ntttccggccagcctcgactatttatttttacaataacaatatttgtttataaaaatgaataatgaaggcggggaggccctggatgtccggtgtctctgtttccccaaacatccccctctaggccccagcaggcaccacccccttcctgccttgtggtgtggtggggattgacaggcatgaaaatggtgtgattttgtgtgtgtgtg

SEQ ID NO: 699934 - DNA, 264 bp, Homo sapiens
ttttttttaaaagcccttctaaaagccccttcaggaaggggttggggcccccccccccccccccccctttttggaggccccccccccccttttttccccctttttcccccggcttttaacaaaaaaccccccttcccctttgccaggttcctccccccccccccccccaagatttgttttttttccctggcccccagcctttttttttttgggctttttaagggccctttttttttttttaaaaaatttccctttttttttcca

SEQ ID NO: 699935 - DNA, 1342 bp, Homo sapiens
  misc_feature (657)..(657): n is a, c, g, or t
ttctggcgtgagctcgcgttgttagctgtgtggtgtcatgactagcggatcactagcacaataagcgacacgtgagcaacaaaagaacgcaagagcaagagactaaagtacactgttcttgatctgtgacgtacgtgggagtgtaggtgtcgatcactagctcgcatgaatgtcgcgcttgcgtctatgtattgcgtcggtggagctactcgagctccgcgccgtggtatctacttatcggcctccctgcgggtgtatcatttccatagtgtgtgcgccgctattacgcgtgcgtgctctctttcttgagcgcctgatttgcattggtggtgcgccagtcaatacaactcctttcttcctttggcggcgcgcctcttgtgttatgtgatggcgcccccgcgggggtgtattatgacagcttgttcttttctcggcggccctccggtgaacatgtgtagaccaccgtcttttctgtggtacggaagcgctctttttttttgcggggggcgtcgcccagtaagatgggggccgacgcgggtgttataccagctgtgctgcaatttcggtcgccgcctctataggcgcagcggcccacaagttgggtggccggtggttagcgcccggctttttaatggcgcgcacactataattgggggncgcacctattcgacgtgctattagctccccacggccacgttggtttgggtctcctccggtgcttttgttgatcggcacggcctgtgtcgcccagtgtttaagcacacaggccaccctctcctgcctttggactcccccctcgtccgggtgtgccaaatagaaccctggcgccctcctcgctaacgacgcctattggttcctttgcctctcccgttcacaccgcaccaaactcgattatcttttccatcgtcttttctcaagaaatagaataatacaaaagctttcgttctatcttttcgaggatagcgaataaatctctcgatacgttttctcgtactctcctggagaccacttttggagctatgtacaagacacaggtgatgccgagtcctctatgccacacggtggagacaaacctcgacacaagcgtttgtgtaaatcgagtgtggctacacagcacccgccctacacggaagccctctcacgcggagtggtggtgcacacgccaagagcagagccacgcttctcacagcgaggggaaacagaccaccactcctccactcaacttacttcaccccctctcatatccattcccgtgataaaatctatttttcttcctcccttattcttccgaacaaaaatataatcttcctccccctctttatcagacccatcaataatcaca

SEQ ID NO: 699936 - DNA, 407 bp, Homo sapiens
aagcgcacgaaggcgcgtcctttcttcttgtcttccttttagtaaaggtgattttctctggtggtatgatttaatttctcgctttttacttttgtgtctatttgttgtatgtttgtgatttgggttaccatgagattttccagcactattttataagccattattttaagcttatcactgttatcataacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctggacgcgccatcgtgcgctt

SEQ ID NO: 699937 - DNA, 708 bp, Homo sapiens
agtcgggcatcgggatccatgctcgaagtcacaatcatctaccagtactttgagatcttcgtagaggagcaaagcgaggttggcagcatggagggccctgctcttactagagacccgtctcccggacaggtatgaggaagctgctccagaagcgcctcggaaggggagctctcatcatggcgcgtgctgctgcggcatatggacttttaataatgtttattgaattatcgatattcttatcattccactgtgtaaagtgctagacatttaccaatttaaaattatagctttatatcctggcactggcaaacagaactgctgaaagtgaaattattattcagccgacatgccagagaagctgggaactggtactagcgattagtccccaagatgatccactgtaactttagattaataacctttgcaccttctcagctgctgtatgcggcaagacagccgacatcacctgtaaccccacaaagggaataaactcactctgagcttggcagcacaaacacttgaaatgtctacgtcacactttggcagccagggtgtgaagctgggagcagcatcatgtatttcccgcgagacgtggagaccttgcagccatgtctccttccaaccaggcgtggcacatatctgcttaggattgtactctctaagaaccatgtccctcttacacgcgaccccaggacagactcttccaca

SEQ ID NO: 699938 - DNA, 1055 bp, Homo sapiens
gcctgcacttggctgtattggcgcaagatgtcttcagcattgagggtagatcctggcactgcacctgatcctcgatactgccagagcctcttacacagacacagagtagacacagacacactacatcaatgacaaggcatgatgcaactaaagaatctaggatataggaaatgctattctgccagaggatgctgatagggctatccggagacttcgtgcggggctgtatcccaaacggtgtcgtaggcagctgcctgagaagaagaccacgactataggaccatgtagtgctgtgtcgcgcgttgctattgggtcggggggccttgccagtggccagggaacctgtgccgcaatggtgagtctcagcgctcagcctcgtgtgctacccgtcatcgttcgccgggaggacaggctcgcttcacgtagcgacggtgacgcatccctggagagcataggtcgcccacaaagaggccagaagagggaccacatcaacctgctgcgcgggagggagctgtccccacctctggtggaaagtatgacctacgcctgggctacaggcatagatgggccgtcctttatgtttcccttgttaaacggatgcctggtggcccttctgagcctaagtacctttcttccttccctggcccctcagtttcttcaaggaactgggtgctccttccgttcaaatatcaggaatggaaagaactgagcctggtcggctgaggcaggttctgtcctgtcagggtcgagattgcacgcgggtcatcattcccactcaaggtccgggtcctgggaggacctcgtcaattattggtctgcctaaagccgttactaggaaggtccatatctggcgcttcccaggactctgcagtccatggaatgttggggccctcacccagagagttactgggtggtcgtaccatttctaatctagatcaacaggcacaactacaaacggacacacagacactcttacctcacacaagacacatacaagcacacagcaaaaccacagaagttcacaatgacggaaaggacactctccgagacacaga

SEQ ID NO: 699939 - DNA, 838 bp, Homo sapiens
  misc_feature (26)..(26): n is a, c, g, or t
  misc_feature (28)..(28): n is a, c, g, or t
  misc_feature (100)..(100): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (231)..(231): n is a, c, g, or t
  misc_feature (256)..(256): n is a, c, g, or t
  misc_feature (261)..(261): n is a, c, g, or t
  misc_feature (263)..(263): n is a, c, g, or t
  misc_feature (353)..(353): n is a, c, g, or t
  misc_feature (369)..(369): n is a, c, g, or t
  misc_feature (371)..(371): n is a, c, g, or t
  misc_feature (373)..(373): n is a, c, g, or t
  misc_feature (377)..(377): n is a, c, g, or t
  misc_feature (389)..(389): n is a, c, g, or t
  misc_feature (391)..(391): n is a, c, g, or t
  misc_feature (393)..(393): n is a, c, g, or t
  misc_feature (420)..(420): n is a, c, g, or t
  misc_feature (425)..(425): n is a, c, g, or t
  misc_feature (440)..(440): n is a, c, g, or t
  misc_feature (449)..(449): n is a, c, g, or t
  misc_feature (461)..(461): n is a, c, g, or t
  misc_feature (487)..(487): n is a, c, g, or t
  misc_feature (492)..(492): n is a, c, g, or t
  misc_feature (503)..(503): n is a, c, g, or t
  misc_feature (521)..(521): n is a, c, g, or t
  misc_feature (548)..(548): n is a, c, g, or t
  misc_feature (550)..(550): n is a, c, g, or t
  misc_feature (580)..(580): n is a, c, g, or t
  misc_feature (591)..(591): n is a, c, g, or t
  misc_feature (608)..(608): n is a, c, g, or t
  misc_feature (616)..(616): n is a, c, g, or t
  misc_feature (620)..(620): n is a, c, g, or t
  misc_feature (630)..(630): n is a, c, g, or t
  misc_feature (665)..(665): n is a, c, g, or t
  misc_feature (670)..(670): n is a, c, g, or t
  misc_feature (686)..(686): n is a, c, g, or t
  misc_feature (722)..(722): n is a, c, g, or t
  misc_feature (724)..(724): n is a, c, g, or t
  misc_feature (730)..(730): n is a, c, g, or t
  misc_feature (741)..(741): n is a, c, g, or t
  misc_feature (749)..(749): n is a, c, g, or t
  misc_feature (756)..(756): n is a, c, g, or t
  misc_feature (760)..(760): n is a, c, g, or t
  misc_feature (765)..(765): n is a, c, g, or t
  misc_feature (835)..(835): n is a, c, g, or t
taagccatcaaaataacttttatttntnttttctacataaacacacagtggcaattcatggcatttggtaattcgtccagacgtgaaaggtttatgaaancagcaaatgccattttgaaaagagttttctgtcaaaaataatttaccaaagttcaagaaaggcctntncagcaaaatccaatatcattctctcagttctttataaatggaattttcttctacttgtntccntttcccggggcttatggacccattnatacncnccatatttagaatcaaaggttcctttctgaagagaccttaattttaaggtaaaacgtggtccaagtccctgaattccccctttcttttcnctcctgaatatgtttntntnaaanctgaagaatatntnancccgttgattgtggaatgtggcaaccngcctnccgataaattgaggnttatgaggnaagagagaggcnaacatacgtccaattgaattacccanccgtnttgtaaaattnttcagaattatttcaggnatgttttctgtggggtccttgcctctncncttaatttctttacgaagacgaacactgcncaatttaaaangagcagtggggccattnggcaagtnactnaaaaaaagtncatttggggttttacgatcttcattaataacaatnaggtnttttaaatctcttgcnaagcactttggaataatttttttcagaaccagtccncncctgtnaaaaacatgtnagtttggnataactntggngagcngttcacagagttgtactgttctcccatgagggctattttatgttgttatgagaattttgggagaagtttnttt

SEQ ID NO: 699940 - DNA, 253 bp, Homo sapiens
cccccccttggttttggggcccccttttttttgggcccccgcgggggggtccccccccgtgggagcctctagccccgcttttctcttgggggggggggggcccccccagaatttcttttccccccccctttttttgggggggggggccccccccccccccctttccccgggggttgggcgtttttttttgggggggggggccgggggcctttttttttttttgggggcctttttttttttcccccttttttta

SEQ ID NO: 699941 - DNA, 152 bp, Homo sapiens
  misc_feature (137)..(137): n is a, c, g, or t
tgggaagatgaagaagaggatgatgaggacgaggatgacgacgacgacgaagatgatgaagatgatgatgatgaagatgatgaggaggaggaagaagaggaggaggaaaaacctgtcaaagaagcacctgggaaacnccagaaagggaaggg

SEQ ID NO: 699942 - DNA, 350 bp, Homo sapiens
tcccatttgcagctcaatgtacatttctcagtctaagtatagtccttttgccaagttacaaaatataagcttttaactactctaaaacgttagaatgacgtcatattaaattccccccttgaggaattttgtagagtatagccgaatcagagcacacatttttctgaaagagcaagtttttagaaggataatgtttatgctaaagaaagtgattagctttcaagtgacgccgttatctatgggatttatatcgcatgtttccacattcaatcaatttgggtaaggtagtcacatagtctcgtaatcaccctctcgagctcgccctatatgactctagctttctgtctccg

SEQ ID NO: 699943 - DNA, 100 bp, Homo sapiens
cattcttcctactgactggaacatagcaaatgatggcatgggctaaggactttgaaagctaggcagactttgcgctgctgatgcctcgagtagcaacggg

SEQ ID NO: 699944 - DNA, 550 bp, Homo sapiens
  misc_feature (1)..(1): n is a, c, g, or t
  misc_feature (86)..(86): n is a, c, g, or t
  misc_feature (146)..(146): n is a, c, g, or t
  misc_feature (180)..(180): n is a, c, g, or t
  misc_feature (246)..(246): n is a, c, g, or t
  misc_feature (280)..(280): n is a, c, g, or t
  misc_feature (363)..(363): n is a, c, g, or t
  misc_feature (371)..(371): n is a, c, g, or t
  misc_feature (382)..(382): n is a, c, g, or t
  misc_feature (426)..(426): n is a, c, g, or t
  misc_feature (433)..(433): n is a, c, g, or t
  misc_feature (435)..(436): n is a, c, g, or t
  misc_feature (441)..(441): n is a, c, g, or t
  misc_feature (482)..(482): n is a, c, g, or t
  misc_feature (495)..(495): n is a, c, g, or t
ngggaggagaggggacacagcgagtgtgtggccccactttggccccccaccgcctcccaacaggaggtggacctggagctggaagnacaggaaatgcttattctcttagaggacagtttcaaagtgcagaaatttctcttataaanatcctcttccctccacgctctgccccttgctgangcccagccccctgcgcaggctgtccgtgaggctggggcaggacaaggtcaatgtgggaagggcgtnaggccaaagcactggaagggcccagaccacatgngcctaggcatagtggctgccgggcgtcagggggtggtcccctctgtggtcccgctggtcctgtaagcgggccaactccgcccnctcgttgngctcctgggantgtcggtcggttttatggctcaaccgtgggcggtggaaagtggnacggcgnannagatnaaagaaccaggccggaaggcaacccatagataggtcggtcngaggccgatggcnagccgcctgagccccggcggtgtatgccgcctggtgcctgaccgtttggcatgcc

SEQ ID NO: 699945 - DNA, 363 bp, Homo sapiens
caggctgatctaccaggatctttgaacacaaaagcggggaacacaaaagcggtgccggcctacgccacagccatagcaacatgggatctgagccatgtctgcgacctacaccacagctcacggcaacgccggatccttaatgcactgagcaagtccagggatcgaactcgcaatctcatggattctactcggattcattaacctctgggccacgatgggaactctgctaagggttcttaagaagtaatggtgacaccatcattcaatattttattctttctgccattcatgtacaaaggagtcttttcactcttcctcaggcctgatgataaaccaggttaaaccccagggtccgcttttgtg

SEQ ID NO: 699946 - DNA, 184 bp, Homo sapiens
gtcgacctggaatggggcagaaccaactacacccaattggaaactgtgagagcaccaagtttgcctacattctcttctagctgcatagcagcattagaaatgtacacccaaggagcctgctggccccaaaatgacacataactaaagacagcccacagcttataccaaacccaggcaaccccag

SEQ ID NO: 699947 - DNA, 337 bp, Homo sapiens
  misc_feature (9)..(9): n is a, c, g, or t
  misc_feature (187)..(187): n is a, c, g, or t
  misc_feature (195)..(195): n is a, c, g, or t
  misc_feature (220)..(220): n is a, c, g, or t
  misc_feature (224)..(224): n is a, c, g, or t
  misc_feature (289)..(289): n is a, c, g, or t
  misc_feature (337)..(337): n is a, c, g, or t
gaattcggnacgagtaagaactagtctcgagatttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaantacaaaanttagctgggcatggtagcgcatgcntgangtcccagctacttgagaggctgaggcaggagaatcacttgaacccaggaggcggaggttgtggtnagccgagatcatgccactgcactcccggcttggcaacagagcaggctn

SEQ ID NO: 699948 - DNA, 368 bp, Homo sapiens
cctagttttagaagtttcaagtagcacctagtttttagaagctttcaagagcacattgttgactgggcaagacagacatgctacttgtatggtagtggcgactcataaacagaatgggatatgtgatcagtatctggtgggcgtcctccttacgaggtcatggctgtggatcagattacttctgcttggccttctgctgggttgctgctggagtgactattgaagggcagggctcaggcaccttggggtggcatggctctggaaccttgggctgtcagggctcaggcactttggcgtggcagggctcaggccccttggggtggcagggctccttggttttggggatgcatggttcctgaggtggaggc

SEQ ID NO: 699949 - DNA, 192 bp, Homo sapiens
ggggcccccaaaaaaaaattgggaccccgggggggggcccccccccggcccccccgggggggggggggaccccccccggcccccaaaggaaggaaaaaaggggttttttggggttggggccccccccaaaaaagaggggggggggggccccaaaaaaggggggccccccttttgggaaaaaaaaaaggggga

SEQ ID NO: 699950 - DNA, 178 bp, Homo sapiens
gactgtacttcctctctttcttcttcccactcagtcctaaccctactccgtaatcacataacctatgcccccgagcaagctcaattacgatatatacaccaacgaagaatgttcaactcagtaactactactaatcaacgcctattttacaccaacccctggttcggttgagcggaga

SEQ ID NO: 699951 - DNA, 169 bp, Homo sapiens
ctatatcggcgatcctgaatctcacgagtggagattattgacgtggacgcctaactatggatgcaaaatggatgctatcaaggtattctgtaactatggaccactggggaaacatgcataagtgccactcctttgaatgttccacgagaaacacgtggtggacagattc

SEQ ID NO: 699952 - DNA, 349 bp, Homo sapiens
ctagactcgagttttttttttttcaattactaatgcaaggttgggcttactaggcttcatattcagttgacagctaaatattacagggattatttctttcaccaatcagacatgacattctaggaaacttttccggtccaaggactttatgactactgcgaacagagcagttgactctgcagataacatgtatggttagagctacacgagtaactacgggacccctaggtgcaacagtaccttcgcacttaattcatatccggaccaagtccttccatggtcaccgagtcgacttcggctcccattcctggcgcactgctattgctcacacctactgtcggtttcttcg

SEQ ID NO: 699953 - DNA, 184 bp, Homo sapiens
attcgcggccgcgtcgacaaaaaaaaaaaaaggttggggggaggataggactggccaggcacggtggctcactcctgtaatctcagcactttgggaggcagaggtgggcggatcacttgatggcaggagtttgagaccagcctggccaacggggtgaaagcccgggtgtgctgaagggacataa

SEQ ID NO: 699954 - DNA, 561 bp, Homo sapiens
  misc_feature (74)..(74): n is a, c, g, or t
  misc_feature (115)..(115): n is a, c, g, or t
  misc_feature (154)..(154): n is a, c, g, or t
  misc_feature (163)..(164): n is a, c, g, or t
  misc_feature (166)..(166): n is a, c, g, or t
  misc_feature (170)..(173): n is a, c, g, or t
  misc_feature (175)..(176): n is a, c, g, or t
  misc_feature (181)..(181): n is a, c, g, or t
  misc_feature (254)..(254): n is a, c, g, or t
  misc_feature (264)..(264): n is a, c, g, or t
  misc_feature (277)..(277): n is a, c, g, or t
  misc_feature (288)..(288): n is a, c, g, or t
  misc_feature (298)..(298): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (310)..(310): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (338)..(340): n is a, c, g, or t
  misc_feature (356)..(356): n is a, c, g, or t
  misc_feature (359)..(359): n is a, c, g, or t
  misc_feature (369)..(369): n is a, c, g, or t
  misc_feature (379)..(379): n is a, c, g, or t
  misc_feature (384)..(384): n is a, c, g, or t
  misc_feature (386)..(387): n is a, c, g, or t
  misc_feature (398)..(398): n is a, c, g, or t
  misc_feature (414)..(414): n is a, c, g, or t
  misc_feature (426)..(426): n is a, c, g, or t
  misc_feature (428)..(428): n is a, c, g, or t
  misc_feature (432)..(432): n is a, c, g, or t
  misc_feature (435)..(435): n is a, c, g, or t
tgaggttatcaataagctcctagtccagacgccatgggtcatttcacagaggaggacaaggctactatcacaancctgtggggcaaggtgaatgtggaagatgctggaggagaanccctgggaaggctcctggttgtctacccatggacccagnggttctttnncngctnnnncnncctgncctctgcctctgccatcatgggcaaccccaaagtccaggcaaatggcgagaaggtgatgacttccttgggagntgccataaancacctggatgatntcaagggcacntttccccagntgantgnantgnactgtcanaagctncangtggatcctgnnnacttcaagctcctggnaantgtgctggtnaccgttttgncaatncnnttcggcaaagnattcacccctgaggtncaggcttcctgncngaanatngtgactggagtggccagtgccctgtcctccagataccactgagctcactgcccatgatgcagagctttcaaggataggccttattctgcaagcaatacaaataataaatctattctgccaagagac

SEQ ID NO: 699955 - DNA, 310 bp, Homo sapiens
aaaaaaggaatttgggcaaaggcaaaccgtttaatgtaattaaccaacgaaaaagctttccgggcttttaaatggaaactgtttttccccttcctgtctaggaaaaagctataaagctcaaattagttaggaatgacttaaacgttttgttttgaaaacctaaaaaaaactttttggatatttatattgccaaatttttacttgaaagctttgaaagaatacatccagttttgcccctaaaccctttgggggtggtttttaaccttcctggaatcccttttttaaaaaaaaaagacattttcagatttga

SEQ ID NO: 699956 - DNA, 670 bp, Homo sapiens
cgttattaatatattgcgtattggcttcatttatcactatcttgttatttaaatttttttctttgcttgaaagcaaaccccagttattatgctgtttcccccaagtatttcagtatgtatttctaaaaagtggatattttctcaccaaaccttacaacctgttactatacataacaaaactaacaataatttgataattctttatataattccaagtccataatcaaatttcctaaattgtcaaaccatgaaaaggtgtttttatattagatttgttttaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaattcctattgcttctcatcagaggggttgaagttcggtgtgcttctactatagtgacgta

SEQ ID NO: 699957 - DNA, 438 bp, Homo sapiens
ttggaacatctctctcttcacttcgacaccaatagatactcctatctacctaagctcaccaactataatcgtctcttatactgttttcctgtgtcaaaccttatgtgcatcctatcgcttaccagattaaacatatctatcccgcgttttatgtcattcctgaattaaaaaaaaaaacgtttaatgtgctatattaacagtgcccaaaacttcatttcagcattcaccaatgtctataatctagttttccccaactaccattaaacccatccaggcaagtttcatttgtcctgcctagcacttgatttgtgctattacttattccttgaatactctccctacttcccctcaagtactaccaatcttcaaacatctactgaacttttcacctcctgtatgaaggtctccttgactattctagcccacatggaactcttc

SEQ ID NO: 699958 - DNA, 1394 bp, Homo sapiens
  misc_feature (567)..(567): n is a, c, g, or t
ggtgtgttgtgctgagccgcgctcttctttttgttgtcgagtgttgaccgcccctctccgttgttagttggctgccccctcgccgcggcggtcggggcgtgcgccgctcaatgattgcactagcccccggcggccttcactttatgcgctccgtccttgttgtgtgatgacggcgcgtcgctgctgtgtctaccgcgccgcgtcggtttggtgttccccccccgccgggcgtttttctggaagagtccctcgtctttgtcgggggccgcaggcagtggtataggcccttctcccttaccccgtgcgctggcgctgaggatgtgttgggtgtgtttgcgcccgccgcgccgcgttgtgcagcggtgtgagtgcgctcttggctcgacggcgtatgaggttgtgggggcgcggccctccttgttgtatggaggacacgcatctctcgcgccgcgtgtcgtgtcatccaacagagcagtgtgtggggtggttcactcatctgctcccccgtccccacgtcatgttggcgcctgttgtcgtttcgtggccccccctggcgtggtcttcatncggcagcggcagatcttttcgtaacagagagactcttcctcccgcgccgctcttctttttataagaggtgctctgtctctcatccgagagataggcacgcacagcataaatatgcaactcgctcatacgtctctctctctctcactcgacacactacttgggcgaccgcctctcctctccccacacacgtcgcgtggagagcaacactcgcgcgtgagcgcacttcttttgatgacactcctctcgctgcgctggagagacacaacactctcctcttcccacacaaagcggctggttctttcgtaccagagccgtggtgagtgggcgcggccgccccttcttgctcccccccgctgcgagtgagtggtcgaggcacaacacgtctggtctgttgtgtgacaggctccagcattcgttgagtagagggtcgctcgtttgccacacagcagtgacacacagcacgctctggcggttcgctcagcggcggcacgcgtcgcatattttctttcttgcgtgcgcactctctttttcccacgagagtgccaccaacacaacaacagctgttgtggtttattcatagccaccgccgccgtctcgccacgcgagtcttgttccccgcgcggggggttataaacctgcttgcaccacccgccgtggggtgatctgatggctagttaaacaatagtggattttttgcgggagccacccgcggggggataacatgtggggggaaatctcataaaaattccctttttttaagaggggggggaattttttttttttatttttataagaatgagggggaaaaaacgttaatatataataca

SEQ ID NO: 699959 - DNA, 1111 bp, Homo sapiens
gctctcgcatctctgttcttccgccgttccgcgcgtcgcgtatctcgtgtccggttcgcaatggtagagaacgagatcgccgcgctggtcattcgatcgaagtggctccagagcagtgatgcacatagcgtggttatcgcatggggacgagcggctcccctgagccgctgttctccgttccactcgtgcgggcgcttccagtacaacctaggtgcgtcatggttgaggcagtgcggccatacaggagctccataacgatagggcagagctagtgccaagaggcaaagcgatgggaatcactgaacccatgacagtacctccattgtgaggcatggcgagtcgtctaccaagctgggcacgacagatggacgacacgatactgtgcaccagcactcgttcttacgaatcggaggctagctgcagtggctccccgtgcaggaagcagccgctagctgtctgactgactctgagggtcaccctctgaaacacacgcaaagggcctaatcaacgagcagacagatgacgtcagtagttatgtattgaggaccgttcaaacacgcccggtcgcatgataacggatggccaatccaggtccagtgcttgttcctcgtctacgccatctggtgctgcattcgactgggacacttgtcattggacttcttggacgactggggtcacccacaacggtgacccagtctacagaagggctaccggcacctggcaccccaacgcgcagtcctgacgtcttggacccttggcttggcctgggaacctgaccagactaccctcatgaaggatcctcacttgatcgaggcctacaggcttcagcaccacggccgagcgggaacatcgtggcgcgacattcacaggagaaagctgtgctacgttgggcccctggaacttcgagcaggagaatggcccacccgccggaatccttcctcttcttctgcgagaagaagctacaaggctgtccgaatgggcaggtccatcaccattgggcaatgacgcggtaccaggtggtccaggaggccgcggttcaaagcattacataccatgggttatggacattttgcgggagtccacggagagccacgttcaagttccattattg

SEQ ID NO: 699960 - DNA, 179 bp, Homo sapiens
gggattttttccttcaaaaaaacaatgaagactttatttttggccataattggatcaagggggaaaaaaccccctgaattttgggcctgttcccttggagttggacccttttttaattcaggatgaaaacgaaatggttgggattgtgccggggccccataaagttcgagaaatttgta

SEQ ID NO: 699961 - DNA, 923 bp, Homo sapiens
cacgtactcaggtatcgtcaagtagtaatcctgtgtttaaacgatggtcaataaaaacaacatgaaaacaacgacgacgatgaatgcttggcgtggcacattcagtgggttccgtgtggcaaaacacagaagctgaaatcgaagcacatgggtactgctcgcgtcgtagatacatggagcgtcatatacgtgatgaaattgatcacgggggccaacaggcaccagcggaatccatttggaaaagcttccgtgaagacggatcccttagggcacacaacactcatggtcgagagaaaatgtatgatttactcagtgcgagaacacctccagaaataactcaattcacgccatgcagattgcagttgtataccgcagagacaaacaagaaggatgtgtcaaactggggcaacctctgccaacgctccaaattccggttcacacaagagtcattgcactggagagaaaacccataaatgccccgaatgtgggagagcctttttttatcagtcattccttatgagacatatgaaacttcacactggagagaaacccgtatgaatgtggcaaatgtgggcaagcctttagataattcctttacacccttaattaaccattacgaaaaggcctgtgtgccggaagaagccctacgaatgtgaagaagctgggacagtcattcggggagtcccccaaatataccattatagagccccactgggagaaaccccatatgttgccctttgccacagacctggcagccgccgacttaaaacccttagactccaaattaacccgtgataaaaagggacactctaatttgcggacccctgtgcgcaccttcggccacggccggaacacccccgtctaaaaaaacgggggaaacaccacttgagtccgcaacacaaacaccctgcaccccaccaaaa

SEQ ID NO: 699962 - DNA, 226 bp, Homo sapiens
ggaccgggattttggctgtctggatgctgcgtgctctgtgatgtttgctacatgatcaggcgcgtgcgtatgggcacatgagcagaccctgaaacgctatgagcattgccgtaagggccagaatgatgccatgatgcacagcatgtctgcgattggttggatggaaaccacattattcttcccgatggtttgggcacgcaattttggcctgaaacaggtagaaaat

SEQ ID NO: 699963 - DNA, 213 bp, Homo sapiens
atcacctcaaccccggaaggcatagtgggctttacttcctctcttgcttcttcccactcatcctaaccctactcctaatcacataacctattccaccgagcaatctcacttacaatatatacaccaacaaccaatgttcaaccagctcactactactcactcaaagcccataatcatacacagcccccgcgacaataggatacagtagggaga

SEQ ID NO: 699964 - DNA, 278 bp, Homo sapiens
gaagccctgcttcttcttttgaaccgagcaccagaaacaggtgcacacacatgagcacaccaggaaggccaggtgcggtggctcatgcctgtaatcccagcacttcgggaggctgagccgggtggatcacttgaggtcaggagtttgcgaccagcctggccaatgtggtgaaacgctgtctctactaaaaatacaaaaattagccgggcatggtggccggcgcctataatcccagctactcggagactgaggcacgagaatcacttgaacctgggagg

SEQ ID NO: 699965 - DNA, 83 bp, Homo sapiens
attttccttttctgacattcaatttcaatctcagttcaaatactaataaacaattagaaatcttactttaaaaataaaaaaaa

SEQ ID NO: 699966 - DNA, 178 bp, Homo sapiens
ataacatagaggatagacccctatactatactatgatagaacacaccctaccggaaacgggggctagtatggtacgcagctgtgctagtacatcacaggcatacatacatacctacaccagtgagcaagtagcaggcaagctagtcccgtgttatgcctggaatcatatgcaggtaga

SEQ ID NO: 699967 - DNA, 670 bp, Homo sapiens
ccgaccccgacggtattcaggcagatgcagacaacattccctcatgaccagctcacaacgctcaggagcgccgttctggtcggggcccaaacgctgtccacacccgctcaccttatgatgtcaacaatcaccctgacatctggactatgtgatggctgctgccaacctgtatgcccagacctacgggctgacaggcatctcaggaccgagctgatgtggccacataccggcagtctgtttggtccccgaattcacccccaagatctggcgatcaagatccatgtatctgaccaggagctgcagagcgccaatgcctctgatgatgacagtcgtctagaggagctcaaagccactctgacaccagaccacagacaagctccctggaattcaagatgtaccccatatgactttgagaaggatgatgacagcaactattcatatggattctcatcgtggctgcatccaaacctccgggcagaaaactatgacataccttcagcagaccggacacaagagcaagctgattgcagggaagatcatcccagccatatgccaacgaccacaagcagaccgtaggtggactttgtgtgtctggagctgtacacggttgtgcaggggcaccgacagcttgacatcctaccagaatggtttcctcaacttggccctgcca

SEQ ID NO: 699968 - DNA, 1021 bp, Homo sapiens
agcgaggagtcagacagtgacagagaggcactggcagccatgaatgcagctcaggtgaagcccttgtgggaaaatgcccccagtgtgaaacctgacctctaccatggcgcatggaggccacttgcgggaacaggcgcctggacctagtgccaccctgggaaggtggggccatgcaacccccgtcagcccaggctgcgggaagctgggacggaggactcagcagagcaggtagtgcaggacgtcctcagagcagcagctgatcggacgaggtgcccacatgctgctggcccccgagctcagcgaacaacgtccttgcgggaagcatcgctccatggccaagacccacgctccaagtcactgccaagcgggccaccctcagaacggcacgggccatgtagccggtccagcgtcacacggctgacaacagcccgatgcgacaagctcgcgacgacgcagccgagagagctcactcgcgacacgtgccgcgacagctgcaggacggccaccgagcgagccactgagctgcacgcctcacggcaagaaccaggctcgtgacaacacttcctcaggagccaaggccatgccccaaagcaagaaccaactaccactggcatctgcccaagggctcgcccgctgttgcgacgctgggcgaccgcgaagccgccccgagaaacgccacggacacctgcggaagcttcctcacagccagggcctccaatccccaaggcctgtgggccttggggggcaacccaggagaccacgccgcacggacttcgtccgaacggcacgcgagaggacatccggactagtgaagcgaacccagacaccacacggccctcgcgcgcacaacaggggcgaacaagcggcaaagccccacgccgggcaaaagggccccccccgcctcagaccccaggcgccccacgtcgcccgtctacagcaggcgcgccaaggcggccaaccagcaccagccccacagaacccccccgcgggcgcaaccgcgcggcccaaagcagcgcacaca

SEQ ID NO: 699969 - DNA, 125 bp, Homo sapiens
gcagccagcacctggccccacgtgtttaggcacctcccgccccccagtgccctgcagttgccaggcttttcagggcaggtcccaaaggtttcccccaaaaaacaaataaagactcccctggagga

SEQ ID NO: 699970 - DNA, 627 bp, Homo sapiens
agcggggaggccacaggacgggcgtcttcccggctagtggagcccggcgcggggcccgctgcggccgcaccgtgaggggaggaggccgaggaggacgcggcgccggctgccggcgtggaggaagctgctccacccagggcccccgacggtcactcgtttatcctcatccgcgcctctgctggaccacgcttgctggcgcctgtcaccggttccctccattttgaccagggaaactaggctctcccggaccattcccctgaccctatgagctggagccggaggaaccggtgctcatggcagttcaggcgccagtgggcagatcctgtcgcgcgccgtgcacgtagggcgaaagaggacgttgcgtctgcggctacagcgagcgggagcacgacgggagaggacggagcgctggtgggcccgaaggggcgacccccgtaggaaggcaggcattcagacagtgccgacgactcatggtcgctggcatgtttccagcgtcggatgtcctgaagagttaactctaggaagacgtcatgacagctcgggaccgcagatccggatcagactttcacggagatctgtgatcgcatcaatcggattggcatgacctggggccaacagcccggaatc

SEQ ID NO: 699971 - DNA, 175 bp, Homo sapiens
tggtcaccgtttcaccatcaagctttgatgttcccctgtctttccctcttttgctctcaagagcaaaggttaatttaagggcaaagatgaagtccctgtaaactaatctgtcattgtttttaccttccttttttttttcagtgcagaaattaaaagtaagtataaagccccgtga

SEQ ID NO: 699972 - DNA, 385 bp, Homo sapiens
tggacccccctgcgacagagtgtgcctcgcgaagacagcgcgccgacaagtctcttttactcggcgcggaggggagctctgggatcactcaaggcacctgccgcagcccagtcccggacctcttcgacgccgagagccgtctcgacacccccaaccagcgaagcgtctcgctacgcacataccagccccgggaacgctctagatctcggcctctccaccactcaccgcgatccaggccagacccccctgaaagccgacgaggccagatctcgactcaccagcagccgagacggcaaggccagactcagtgactcgacgaagacccgtcaagagctccccaggagcagaagcgaccagaccagacgccccagaacccgccgcgtca

SEQ ID NO: 699973 - DNA, 544 bp, Homo sapiens
  misc_feature (15)..(15): n is a, c, g, or t
  misc_feature (308)..(308): n is a, c, g, or t
aatacacactgattntagattccacagggaaatgggcagactgaccagtccacggtggtgaattttccaagaacatagtttaagttgattaaaaatgcttttagaacgcgggagcctacttctagctggattttttgtatgcttaaataaaaataaaaattcatacccaaagagaatccccccttagcttgttagtaatgctctggccaacccgaaatgccccttctcttagtgatggcggcgttagggtttgagaaaagggaatttggctcaccttcagttgagagggggcagtccagccagcttgnctgcttttaaatgaccaaaaatgacctgtggtaaccaacctgggctttttaggaagcagtccctggagaaggcatgttcccaaaaaggtctctggagggacaaccccccccagttaaccataatgtttcatgaagaaaactgtttttttatgccatgaaatgaaaattttaatgccttgttttaattactaatggtcgctgctgcgggcccttaataaagttgctttttttggcta

SEQ ID NO: 699974 - DNA, 950 bp, Homo sapiens
  misc_feature (452)..(452): n is a, c, g, or t
  misc_feature (469)..(469): n is a, c, g, or t
  misc_feature (658)..(658): n is a, c, g, or t
  misc_feature (699)..(699): n is a, c, g, or t
  misc_feature (707)..(707): n is a, c, g, or t
  misc_feature (709)..(709): n is a, c, g, or t
  misc_feature (711)..(711): n is a, c, g, or t
  misc_feature (713)..(713): n is a, c, g, or t
  misc_feature (716)..(716): n is a, c, g, or t
  misc_feature (721)..(721): n is a, c, g, or t
  misc_feature (728)..(728): n is a, c, g, or t
  misc_feature (732)..(732): n is a, c, g, or t
  misc_feature (735)..(735): n is a, c, g, or t
  misc_feature (742)..(742): n is a, c, g, or t
cttgtgaggggacacaaagaaaaattgaataaactgtatgatttaaaagattatcgggagagttacctcccgatataaaaggaaggatttacagaatgtgacctaaggtctggcgtaaatgtgcaccggaaccgagaaggcccggattgtcatggacgatgagatacaccggaatatcatggacatattctttaaagcgccctttatcttcaaatgcggcacggaaaccggaggctttgaagaactcaaggaagcgcggcacgataccgcccgcaataaacacgccgccaaatgtcccgagattgagcgccagattgccgccaaaacggcccataatgacgcaaaacagcgacaatgcgcggcggcaatcggtgcagctgtcagccagcgcgcgtcggtaatatcttttggcttgagattttctgggcaggcggttgtcagctttcacaatngcgcgatacaaattcancagcccagggccagaaagcacgcgctccgcccgaaacatgaccaatttccgcacgcaatatttcgaggataatggcctcttcttcactattcggcgcaaaatcaacgtgaccgcttcgcctggcaagcttacccaacgcttatcgacatggaccagatgcgcaacccaagcccgttccggcacgtaaancggaataggcttaccttcgaccggtctggggcacaaatggntagatgcncntntncancatcnggatcgncatnganacagggntaaacacgggaataattccagaatggtaaaacgagaatccttttcacttcgcgaatggaaacgcaggttggtgggctcgcaccaggcggaactgggaccacggaaaacgggcttaccgcttgtttcaaaaacgcacagcgtgcgggggaaacgcaatcacggcgtaccgggccaaaaggtggccccacacgtcttatgcggcaaatac

SEQ ID NO: 699975 - DNA, 354 bp, Homo sapiens
cgtctccaaaaaaaaaaaaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaa

SEQ ID NO: 699976 - DNA, 1609 bp, Homo sapiens
  misc_feature (409)..(409): n is a, c, g, or t
ggtctcgtacgggccttctcgcgtgagcgtctctcatctctgtcgtttgctctcaggttcgtgttcgtcgccttctctccgcgtccttggcgtccagctggtgggcgtccttcatgctcagtgctgccttctatctctagctgttgttatcctcatgctttgctatctctctgctcactcatcggctctcatgctgtccgtctcgtctctactgctgtttcttctcttggtgctctaccgatcaacctgctgactctacggtggtctatgtcatgtattgttgcttacgatgtcgtttctgctctgacctcgtgtgtgttctgcgtactcagttactctggtctctatcatctccgcactcaatgcttcttgatgttatcgatgtaatattgttggctgagctgcgcgntgctgcaatgtgatgttactgtggcgtgttctgtggtcgcaggactgcgatactgtgttgtcgtgcgcgcgtctcgctcgctcaagtgctcttctgtggtgaggttcgttgtgtcgttgcgctggcaggccgggctagctgagctatccctttagcgtgttcgtctgctggtcttgcgtttggtggttggtggtgtgggtcggtgtctggtggtgtagtgccagcccccgttcgtgtcgggagggctctcttatattaattttttatatcgcatcggaggagcggcttttcgggctcttgttataggtgggtggaagctccgccgctgtgctgaccgagtgtgtcgcgcccccttcggtggtgatgatgtgcgcgcttatgcttttgttcacaccgcgctcgtgtgtttgttgtatggagcccctctcctcatcatcgtgtgtgagggtagcccacctcccggcgggggggcgccggatggtttcgccacggtgcccttctcgccgcggagatctttcgtttttatcccacatattgtggacccccctcgcgggtgttaccgcgggaatatatacaccgcagcgtggttgtttgacatcacacaacggggggagatactcacgcggcttattgtggtggaccccacatcttattgggcgcccctcatattctgtatagggtgtgacacacaacgtcgtattatggtggaacacaaaagcgtgtttggttggaccacaacaaagaaatgatcaagggatgctggtgttataccgcgttgctcgcgaagaattttccccgccgggaggttgtaactgtttgtgtcacatttctgtataagagcgctgtgtttttgtgtgtggggggaaccacagaaaaagagcgcgcgggtgtcgttcaccccatcctcgcgcaaagagttccgcttgttttgtgggtgtcaagagtcgcataacggcgccgcggctctgggagagaaagattgagcccttagtgtctacttgaacaccaccgcgtcaacaagtgtggcgcactggccccgttccagagccacatggagaggaggaaagaaaagcacttcacatggggccacctgtgaagaaaagagcccggattgtcaaaaggaaagaaaggaggcttaaatgcccgggaccagattttgcaattgggggggtttccaaaaaaagagttttttcccctgga

SEQ ID NO: 699977 - DNA, 1033 bp, Homo sapiens
gggctacaaaccctgaccatgaccccccacatggctgctgccacctgatgctgctgctgctagctctgctgctcgctgccagcccagtgaggcgccttgagcgcggtgcccaggctgcgtggcaaggggtgcaggcgggttgtccagggggctgcgtggaggaggaggcttggggggtcgccagccgagggcttgcagcggaagctgagggctgtctcagagagggaggggcaggagtgcggggtctacacccctaactgcagccccaggactgcaagtgccatccgcccaaggacgaccgaggcgacctttgctgaggcagctgctgctcggccgaggccgctgacttccggcccggagcgcctgctgttgcaagaggagaatcctaaggagagtaaaacccaagcaggacactgcccgaccacaggcatgttgaaccgaagagaccaacaagaggaatccaggcacctcataccaagccctcccagaccaattcttgcgggttgtccaagacacttgagatgggcccaatgacgtagaacatctgagactcagatgctgcagaaattccagaatgaggtctaccgaggaggttcaaaatctaagttgcccaattgtgaccatcgaaggttctaaccgggaagcggaagttgcgatcttcccaaggacaaagccagaatccctgatgatttagttgatcggatgggcaaagtccttacaagagtaacagatgggaatagaagtaatcatgaacaatggaatcaggaaagatggagaaaaaggaatgaaggaaataaaagcactggggttgcataaaaaaaaaaacgagggcttaaaaaattaggccgccaatggccacacgcgtgtgcaaaaattaagaaggcagggtaaaacatgagcggggcaaaaacaaacaagaaaaaaaacaaggagataaaaaagagaaagaccacataaacgagagagaaaaaacgagagaacgagaaaaaatgagagacgacaaaaacaagaaaaacggaataaaaaaagaaga

SEQ ID NO: 699978 - DNA, 1585 bp, Homo sapiens
aatctggattctgcatagatgtacggtatccttcattgtgactgcatgaaaacttgagcgtatactactcccaggcagtctgatcatgcgtatggcatttttggagtgaatatggggaactctaagtgttggtttgtcgtcgtgacgtcgtgcctcgagcaattgtgtgcatagtgcttgtgttcttctaccataggcatatttgacatccaagtagaattgcggaacatcgactaatgaatagtagataacacttggacaggatgtagcataagatggtaggttagacaaagtggccttatagaaggattcattccaatgcctcaaagccaggattattacctatacctgggcgagcttatggttggtatgtacatagtagtagcgttaagttgccttagtacagccatacgcaaatatgtgccgtacataaagtcatatattcccagggatttacgattccgcacggttgattcacatccatagtagaggtaactaggggggcgagacactcgctaaattgcggaccagtcttgagaagtataattcgtacatggttacctatcccacctggaagggcacatattccgcggattgataatttcgcataccaggaataggcgccccgtgggagaacagtgtaagaacgcaaggaagcgggatattaatacaacaacgccaagacaggggaccttgacacaaggaggaagtgggacatggaacgaagttatagacgttcctaaagtcaattacaacacagcacaaaagaaggatagtcaaagtcatttaccacacacttggatagagagtcactatttccctcaggcacactgggaacgccattaaattaggatggcaatccttgggttgggaaccgtcaagggttggcacgcgagcttccgtgtaggtggctttggctcagaaaacacagttcttcactaaattagaaggcattaccccatatgtgtggttaggaaattgtcaccatactattccgaacatgacccttataactaagcatgcattgacgagtacgccgaattggttcgcaacgtagtggaaattcacacagagttacatccgcggattggatgacatacctattacattatcccctaaataaattagttgggacgatattaggtgggacatacacaacacaaaagaaagaatgcagaagaatggctctaattaggcatattggagtgtgaacgagacatctaggcatgtggaagaagaactatccggggagacaattccacttgtgaagagcacaaaaagctgaaccgaagatataacagcgacagtgactgaacaacgtcgagatgatgaaaaaatagacacaaaacgaaaagagtacaaggagcggagagaggccgacgacgccaagaacgaacggagagcaccacagcagagaagacggaaggaacacaacgacgagcaactacacacgcaaagccaccacaggcaacaactaaagagagcaccgaacaaggagacagacaccaaaaacacagaaagaggaaagagaaaaacaaagaggaggaagcaacacgccacggacacgaccatacaagacacgaag

SEQ ID NO: 699979 - DNA, 228 bp, Homo sapiens
  misc_feature (174)..(174): n is a, c, g, or t
  misc_feature (210)..(210): n is a, c, g, or t
tgctacactgcagtcacacacactggcagactccatccccagcagccctgcctcttcacagttctctgtctgtagtgaggatcaggaagctattcaggcacagtttggaaggccatcatgcttgtatggagagctgcagctaatcataggtatgcctgtcttcctgcagcctgntacagatgacatagcacctggctaccacagcattgngcagaggcctatggtttg

SEQ ID NO: 699980 - DNA, 497 bp, Homo sapiens
  misc_feature (131)..(131): n is a, c, g, or t
  misc_feature (378)..(378): n is a, c, g, or t
  misc_feature (447)..(447): n is a, c, g, or t
aagccgtaccagtgcagtcagtgcagtaaaagctacagtcggcgttcatttcccagtgaacaccagaaaagcccacccaggggaacaacttcaccagtgcattgaaggtgggaaaagctttaataaacacngcaacctcattggccaacagaagatccacacagtggctgagatggtctagggcttggctatgagcaagttttccagatcaccacccaagttgtgtggggcaggttgagactagaaaatgcctctttcttcctttcaccatgaaatgtgtttgaaacaaatcctgacttaaggcccagggacttccttaaaggaaagttgggtgtttgaagccactgttttctcttttgatcgaataacctctttctnactcaaaccagctgtgtccctcttataaaaaaaaaaataaattttttgagagggcggctaaacccttcnaagaatataataaaaggcaccgccacagccaacaggcctgaaaaaaaaaa

SEQ ID NO: 699981 - DNA, 713 bp, Homo sapiens
  misc_feature (500)..(500): n is a, c, g, or t
  misc_feature (513)..(513): n is a, c, g, or t
  misc_feature (560)..(560): n is a, c, g, or t
  misc_feature (621)..(621): n is a, c, g, or t
  misc_feature (694)..(694): n is a, c, g, or t
  misc_feature (705)..(705): n is a, c, g, or t
aagattaatagtagaaaaacaatccagcaaacaattagggaaacatgttattttacatatgaagggataaaattttctcttaaaaaagaacagtaagaaaaaagtgatgtttaagagttaataggatctaacaacttaaataaattccctctgtcaaaaaaccagttactttcttaattagaagacatttcacatgacttgattaaaaagtgagttatgttctcttattaaattaatttacactttctggggattcaatgaagggagaagaaacaattataaaatgagtaaagtttagaatgtcttcagtaaacactgttaagtaatttttacattttgtctacagaaaaccagtctatccaagaccaggcacctatgttggaaggtgaattggttgtaaaatatacctttggaaatctttgaataattgaatacaattaatgaatggacattaacaataatgcatgtgaacttcaaagatgatgatatcccaaatctgntcaggatcatttnttttatttggcttcttaattgaatcagattttacaactgattgaatntacgtgattacacaagtagcttggttataaaggctgtctgttttatatagacataaagganaacaactatggccaaggactgtccttgagctacggggtaaggactaggaaagttgattggcggaggtttggantgatttaatcnattgtagg

SEQ ID NO: 699982 - DNA, 720 bp, Homo sapiens
cgcaggcgcggagcccagggaccactccccactgcacagatcatgagaccataggggagctgtctggtgtggcctcagggaataggctgctccccaagggtgtgaatgaggcaggatgacacatggacagagttagtagcaccttgactcagtagcgatgaaccggaattctactgccattggccgagtatggcatctcgagtcatcttcatcttcagaatcgatggtgctggttggtggactgtagagagtgtgtggggtgatgagaagatcttccttcatctgcagacacactccagccgtggctgcaagcagcgattggtctatgagccacattcgttcccgcattctcgccagtggtgcgtgactgttgtgtcgcctgcaggctcagtcactagtttccagcccagtctctcctcgtggtcatgcacgtggttcagcagcaacacattagagaagaaatctgctacggctttgagggccatggggaccccctacacctggaggaaggtgaagaggcacaagggtccatatctcagggacactgtggtggacctatgtcatcagcgtgctgtcccggctgtcggtcgaggccgtcttcatgtatgtcttttatctgatctaccctggcgtactgccatggtgcggctggtcaagtgcgacgtctagccctgacccaacagcatgtggactgcttcgtgtcccgagccaccgagacca

SEQ ID NO: 699983 - DNA, 372 bp, Homo sapiens
tgagcggataaaaacatcacaatatcagcggcattgattgggggctggatacgatgctcaacatcctaggaaatcctggccattaccacctaatcacattcaggaagtcaatgtcaggactggcagggagtgtggcaaatgccggaggggtccagctagaccacaggggagaaatctgtccaatgtcaggcttattacattctcagcctgaccccctgaagaatctcctcactttaaaaaaagaaagaaaaagatatccatacggtaatatgcccactgcagccaggttcagacttgggctgcagttccggtggatgtaagagaattggagatccgtgtccctggttagaagtagagcggtgggcaggcact

SEQ ID NO: 699984 - DNA, 381 bp, Homo sapiens
ttcatatctgatgatgaccgaaaaatggtgagatgtatgtttgggtctgcttcaaattttataaatcctgtgacctctctctctgggagttggtaaccccaactcaaatgtgaagtagttgaatgaggtctcaaatttaggcattgaacctaaattaatcatctaagtcagtacccactaccttcttcttcttacatatccctgccagatggtcatcaagactcagagctctctctacagagaggaaattctccactgtgcacacccaccttaggaaagctctgaccacttgaggcctgatctgcccatcgtgaagaagcctgtaacactcctctgcgtctatcctgtgtagcatactggctacaccatcaatcctgattc

SEQ ID NO: 699985 - DNA, 654 bp, Homo sapiens
tggggttaaaagagggtggtagcatttaaaagggaaaatttcctcctgggttggctagtatctggggtgtattctcgggtaagtgtagctcaaataggtcatcatgaagggttaaaaaagcgagggggccaggttatgcggggggttagggccgagggccctctccaaccactgtgtgccacgtgactggcgtggtgtgacccgtgggcaagtcacttaactataggggtgccctcagttttcccttcgtggttaaaagtggggataataatacgtgacctacctcaaggggcagtttggaggcatgtgactaagtgctttttaaaaagctttgggggactccttcagcacgggaatttctcaagaaccgtgagttatttttatataattaggaatgtgtccaccagtgaactggatacgtccggtggtgtcccagagtgcggtcataagctctatagtggtctctccaagaaacgtgaagtgaatctccagtgggagaagcgggtggataactagccagacaaaattggagaatacttaaacaacgcatggccagggaaacatacagaggaggcctttcgggatggggggggatttttcccctttttaggggggatatagaagttactgtggtgacaagaataattgggggaa

SEQ ID NO: 699986 - DNA, 352 bp, Homo sapiens
agcttcggttacccgaaatacagaggctatggctgggaggtgagaatgtacatgattacaatggtctacagaccattaagacacagaaacagactggaagagggtgtccagtcttctggtggttggctttcatcaagggctgtctgtgtcaccaaattacttctgcttggtcttctgctgagctgggcctgtagtgaccgttgaagtgacaaggctctggtacctgttgtgaaatcggtgtccaggtactttggtgtatccttgctcaggaactttgatggcacctggctcaggaaacttgatgaagccttggtcagggaccttgatgctgcctggctcagggaccttggtg

SEQ ID NO: 699987 - DNA, 114 bp, Homo sapiens
ttgactctagaggaccccgagagtgaacagcagaaagaggctttggaaacataaccaggaattgcgaaaagccttgcagcagctacaagaagaattgcagaataagagtcaact

SEQ ID NO: 699988 - DNA, 261 bp, Homo sapiens
ggcgggaggctgaatgcaggagactcaggccgaacctgggaggcaaaggttgcagcaagccgagatcgccccatagcactccagaccagggcaacaacgagcgacactccatctcgacaaaaaataataataataaagtacacaataaatgctatgtgcttgaaccatcacgaaaccatccttactccaggggaaaaattatcttccatgaaacaagtccctggtgccaaaaaggttgaggacagtacaacctgccggtgg

SEQ ID NO: 699989 - DNA, 888 bp, Homo sapiens
ggccttcagattataccagcttagctagcattactaaccaactgttggaagctctgaaaataaaagatcttgcaaccacataaaaaaaaaaaaaagagaaagaaacagaaacaaaaaaataataaaatacaaaaaaaacacaaagagaggggacggcggtacccagttttctttgtaaagagaggtgcgaccctatagtgagtcgaatttattaagctgtagagaaagggggccgcctcgtttgtgagaaccgttctgttatactgggaaaaacgtggctacgcctggggaatacaaaggtgaagggacagcgcttaccttctggtggccgtggagcataattgggaacaaggcatacctaacaggaggaggggagagagacatcataaggggtgaaaaataatcaaaaacttttagaaagaatttattaaagggctggtataagggtgtaaacttgcaataatgtcttgacatgggatagaaggagggttttggactaaacatggaggaaattaaattctacgtgcaaacccattaattaagtatctgcgaggggagccctgcgtgatataaaactttgaggaaccacacactttctttatatcaacagcggggagccattggaattcacaaaaacaccaacccctaccaaaaaccagacgctgcactaacaacacatagcacgacccggaggagagcgagacagaaacggagacgaaagtgatgcaagaataagaggagtgatgtcggaaagaccatgacgaagaccgagggagccggcgaaaaaatcagacaccgtcacatgagaggtgacgaacacaacgtcgcagatgatactagaaggaactaccgaacccaagacacagcgagaaccaacacgggagaacc

SEQ ID NO: 699990 - DNA, 835 bp, Homo sapiens
  misc_feature (137)..(137): n is a, c, g, or t
  misc_feature (139)..(139): n is a, c, g, or t
  misc_feature (141)..(141): n is a, c, g, or t
  misc_feature (214)..(214): n is a, c, g, or t
  misc_feature (218)..(218): n is a, c, g, or t
  misc_feature (224)..(224): n is a, c, g, or t
  misc_feature (244)..(244): n is a, c, g, or t
  misc_feature (248)..(248): n is a, c, g, or t
  misc_feature (251)..(251): n is a, c, g, or t
  misc_feature (253)..(253): n is a, c, g, or t
  misc_feature (257)..(258): n is a, c, g, or t
  misc_feature (262)..(262): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (286)..(286): n is a, c, g, or t
  misc_feature (292)..(292): n is a, c, g, or t
  misc_feature (294)..(294): n is a, c, g, or t
  misc_feature (300)..(300): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (335)..(335): n is a, c, g, or t
  misc_feature (342)..(342): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (360)..(360): n is a, c, g, or t
  misc_feature (362)..(362): n is a, c, g, or t
  misc_feature (370)..(370): n is a, c, g, or t
  misc_feature (383)..(383): n is a, c, g, or t
  misc_feature (385)..(386): n is a, c, g, or t
  misc_feature (391)..(391): n is a, c, g, or t
  misc_feature (410)..(411): n is a, c, g, or t
  misc_feature (444)..(444): n is a, c, g, or t
  misc_feature (512)..(512): n is a, c, g, or t
  misc_feature (530)..(530): n is a, c, g, or t
  misc_feature (654)..(654): n is a, c, g, or t
  misc_feature (832)..(832): n is a, c, g, or t
cccggccgctgcccccgcccgcgccggagctggagcccaggccgagccctgccctggtcgccggccgggccgaggccgcgccgccgcgcctccccgcctccgcgccgtgacgctgccgccgggcgcggggaccgcgnangncccaggcccccgccgccgggctctccgctcggccgaggggcgcccgagccgccgcggcggtcgcctggaaaantttncccgcnagggctccccaggggtcggnactnttnancctnncganccctgcncgtntnggccccatgcncccaananttagcnccgggacaaagggagtgagnaggnanctgggagcngaggccntgtnancaggcnaagganangggcgctncagggttccagcnanntgttncccccatggagctgaggcnntggttgctatgggtggtagcagcaacaggaacnttggtcctgttagcagctgatgctcagggacagaaggtctttactaacacgtgggctgtgcgcattcntggaggccagcggtggcnaacagtgtggcacggaagcatgggttcctcaacctgggccagatcttcggggactattaccacttctggcatcgaggagtgacgaagcggtccctgtcgcctcaccgcccgcggcacagccggntgcagagggagcctcaagtacagtggctggaacacagggtggcaaagcgacggactaaacgggacgtgtaccaggagcccacagaccccaagtttcctcagcagtggtacctgtctggtgtcactcagcgggacctgaatgtgaaggcggctgggcgcagggctacacagggcacggnatt

SEQ ID NO: 699991 - DNA, 157 bp, Homo sapiens
gatctctccttttcttcctgaagacaggagataaaaacgctcaggtgaaagatgccttccctgtagaggaatctttcttcgcccggtacagggaagcacgtcatagccaacagaattctgtacagacattaaagtaattaaagtaattcctgtcgtt

SEQ ID NO: 699992 - DNA, 184 bp, Homo sapiens
cttattgaggtcagggtggggacagccctccagtaattcggaggtccgtctgatcgcatcagtgtgctcaaagacactgctgataaagcattcttttgatgacagatatgcttccaagggagccatcaggcaagggataagccacctctaactgactctgtttcggtctagctgatttgaaaac

SEQ ID NO: 699993 - DNA, 223 bp, Homo sapiens
tcagctcggaccgaatgtttgagggactgtcagcatgtgaccttttttaatgatgataaaatacacgttacataaaatgggccattttaaccagttttaagtgtgcagttcattgagtgcgttcacattgttgcacaaccatcacccccatccatctccagaactttctcatcttctcaaactgaaactgtccccattaaatgttaactcctttcgtcccccg

SEQ ID NO: 699994 - DNA, 495 bp, Homo sapiens
acgtaaacacagcacacaccacaaaacaccacacatcccatacatacacaacacacatcatatatacacaccacacacaaacaccacacaccacaaaacaccacacacacaacacacaccatacacacacacacacacacacacatatatatatatgtatttattttagagataggctgtagcccaggctggagagcagtggctcgattgtagctcactgcaccctcaaactcctgggctcctgtctcaccctgtggagtagctaggactagaggcactcaccaccatgcccagctgatttataaattttttttttttttatatggaattgtggtagcaaacaggctggtgaaagtatgccccagggtggtcaaacttctggcctcaaatgatcctcctgatatccacctcccagagtatagggataacatacgtgaaccccgtgcatggccatacatgtaagtaaaataagtataatatttcccccaaataaag

SEQ ID NO: 699995 - DNA, 131 bp, Homo sapiens
gtagaactgaaggaaactctaatgatatttcaacattataatttgtctccatttcccaaattctttgttttataaataaaatgtttgaatgatttaagagggaagaacataccaagtaaagctttgtggca

SEQ ID NO: 699996 - DNA, 787 bp, Homo sapiens
  misc_feature (234)..(234): n is a, c, g, or t
ggtgtgtgttggatcgttcagatgtctctgtcgctaccgccgagccccctggtcagtgaagctttatcctggatagactcgtggttttaccttacactgcacggatctccgctcggtggatgagccaggcaaagattgaagccggagagccttgtgagaggtggatggctatcctttgcatcttgcgatcgctcacagatcatatatgagagactgaatgtgctctggatgaantgtgtcatgctgttagcgagatgccagaaacaaatggttcgagttcccaatcaacgagtagcggacagaatctctctcttggtgccatctcgaaggtggatgcgtatcgaagaggtgtattcactgcgcgctagcgaattacccagtgtagtgctcgtgtatcgtggctatcctcgagttggtccggcgcatgcgcagacatgcacaccacacaacgcaatcggtgcgtaagtaaaacgtcgacgtggtcacgttcaagtgattccccgagtggagaagacttgggtggagagtcttgggccgtcgattttcaatcccgatggagggagtgtacccttgccattttggtaggcccccaagggtgtcagcgaagtgccttggaactcgtgtccgcgatggtctattggggctacccttcagacacctgacaacttgtgttctccccgcaaggcttctggggtgtggccgcgagttctgggccccctcaaacctttgtcaggaaatgtgtcccttgggaggaggtgcccacacaaggggcaaccccagaggtcaa

SEQ ID NO: 699997 - DNA, 161 bp, Homo sapiens
tgatgagctggccccgtttcaccctgtggtgcacgccgtccctgtgacaagttctggcttctgtgagcactgtgctgagctccaaatacctgttaagctggagcctcgtgtggccatgcttcttgccccttgtggcctccccgccagggcctcctcccgct

SEQ ID NO: 699998 - DNA, 329 bp, Homo sapiens
  misc_feature (96)..(96): n is a, c, g, or t
  misc_feature (157)..(157): n is a, c, g, or t
cctcctcggtaatttttcagcagtggcagtggtcacacttgtaatcccagaacactttgggagggcgagacaggcggatcacctgaggtcgggagntctgagacagcttatcaacatgtagaaaacccatctctactaaaaatacaaaattacctgngcgtggtggtgcatgctgtaatcccatcatctactcaggaggctgaggcaggagaatagcttgaacccaggaggcggaggttgcagtgagccaggattgtgccattgcactccagcctgggcgacaagaacaaaactccatctcataaaataaaaatcccaatcccacgtcg

SEQ ID NO: 699999 - DNA, 384 bp, Homo sapiens
aggattcagcacgagattgctcgcaattgtgccaatcagagatcaactttccgaactgctcttgagccactggctgattgactgatcaacatcgtctgtgccatctcgacctatgcagatcttattgcagttgcagtgactgacatgatcattaagcgagatagtaatagtgatagctgctgaatcatatgtcatataccgtactctatcaacaccacgaacacttgccaagtatgataatcctagctatgccactgctaggttagcttcttcgacaggtccagtgagcaactatgctgacagcatcaatcttcagatactatgcgtggctacagttatcaccacagctgcgtcagctcatagatactatcatcatgggcgggc

SEQ ID NO: 700000 - DNA, 95 bp, Homo sapiens
accccccccaaagggaacaaaaaagggagcccccccccggggggggccgcccaaaaaaaaggggaccccccgggcggcaggaaaccggcccgaga

SEQ ID NO: 700001 - DNA, 197 bp, Homo sapiens
aacgtcaggctggacgatagagcgagcctccgtctcaaaacaaaacaaaaaccacgaaaacttcccaaggaccccttttcctataacattatgccctgtggagatgcacactaactgttacggggtttcgggcgatgactctttctggctacttcctgctgaaaaggggcgtgcaatgcgacacagcagctagggct

SEQ ID NO: 700002 - DNA, 126 bp, Homo sapiens
ccaagctgcacggccagcaagtgttcctgcgcaccgacacccattggaccccggacggcgctgaacgtggcggccaaagaattggccaagacaattgccaacaaaacgcccctgagcggcgagcct

SEQ ID NO: 700003 - DNA, 685 bp, Homo sapiens
cccgcccgtacactgtctcggcccgagagacctcctttttccaggctgtaggtatcacccctaaatctcccggggcacccttggaatcctgagtgatgtgcagctgatccagactggagaccaagtgggagcccgcgaagccacgctgctgacatgctcacatctcccccttctcctttgggctggtcatcccgccggtgttcgaccatggccagccatctaccaaccctgaagtgcttgatatcacagaggaaactctgcattctcgcttcctggagggtgtcccccaatgttgcccagtgtctgtctgccagattggctaccccactgttgcatccagtgacccccattctatcatccaccgggtaccaaacgagtcctggcccttgtcctgtggaggaccggagtttaccacgctgtctcccacttgcgtgaaaagggtcaaggcccttctttggctgatcccatctgccctttgtggcgtgctgccccctgtggcgtgctgcccacccaccagcatgctcctgctgctgtctgccagcccccagctaaggttgaagcccaggaagagtcggaggagtcggacgaggatatgggatttggtctctttgactaatcacccaaaagccacccacttagcccgttttatttgccaaaaccaggaaataaaggcttacttccttta

SEQ ID NO: 700004 - DNA, 630 bp, Homo sapiens
gtatagctatctagaggttccgcaagcgcatagtcacttagcagtatattttcaaggagtctttttctgagcagtacgtctcaacagagggcttaagagattcagtaatccaggctataaatagatatactatcatcccggctctgttgttccatttatagaacataggcagagaagatttagcatcattcttaaggaccctaaaattttctgaatatcaaatgatcattggcttcaactgaaagtcaccatctgcattaacaagacaatcagcctgtcctttgaagctttgaaggcaggtgttgacatctcctctctagctacagaagtcctagatggcatcttcttcccaagagaaggctagtcatctacatggaaaatctgtagtttacgtagccaccttcacggaagatctgagcttgatcttctggataacttgcagcttctccatcagcatatgctgcttcaccatgcacttttatgttatggagatgacttctttccttaaacctcatgaacaactgctagcttcagacctttcttctgtagcttcctcacctctctcaggcttaacagaactgaaaagcggtatggacttccttcggattaggcttaagacaatgttgtagc

SEQ ID NO: 700005 - DNA, 359 bp, Homo sapiens
tgaactacacagaagatgaatacttaggagaacataattcaaaatttgaaattcagccaaagtaaacatctgaagaagctccgagaaaaggtggacaaagatgtttgttaagtggagcagctgtagtcaatgcattctactcttcaggaagaaatcagatagtcttcccagccggcattctgcagccccccttatttagtgcccagcagtccaactcattgaactatggaggcatcggcatgggcataggacacgaaatcacccatggcttcgatgacaatggcagaaactttaacaaagatggagacctcgatgactggcggactcaacagtctgcacgtaactttaaggagcaatcc

SEQ ID NO: 700006 - DNA, 349 bp, Homo sapiens
ccggacaagcgcgcgcggcggttgatccgcgcacacggcaatatcgacgctttgtaagctgcagggcgccagaccgggtccggcgccccccatggctcagcgcgtaccgcccagcaggctaccgccgatattcagcagatcgcccacaccgaactgaccgtcaccgtcatggtccagcacgctgccaagcaggccgccggcgataccgccatgctgctgcacctgctgcttttcctgcccgagcgcctggctgagcgagccggcatcggcctggccgccaccgaggcgctgggcaaggaaggccatcacgatcggggcgaggatatgcagcagatggctggtgcggccg

SEQ ID NO: 700007 - DNA, 109 bp, Homo sapiens
acttccaagctggctacgaagaaataaagagaatctggaccactacccgggcaccagtgaccacagtcactggtttggaccgttactctgcacatagttcagcgtctga

SEQ ID NO: 700008 - DNA, 197 bp, Homo sapiens
ggggcccccaaaaaaagggggtttttttggccaaaagctttttggggttttttccccccccaaaaaaagccccggggggcctttttttaaaatttttttttgcttttagggcccccctttaacccccccttttgccctttgggtttttttttttaagggggggggaacggtttttggaaaaaccccccccggggcca

SEQ ID NO: 700009 - DNA, 1125 bp, Homo sapiens
ggctcagacgccgcgcggggcggtggattggtctgtgtgtcctctctcgtgctcctcgctggctcgctgggtgtgcctgacggttcctggtgacacctgcttgcttgggccctgtcctggcggctacagtggcttctctgctgctgctccctgtgttctgctggactgggaagaagtgggctgtgtgccgtccctgtcccgtccccatctggaaccccaagtcgcgcctgctgaccctgtctgcagttgcgagatgagctgcggacgcagctgtgcctgggtgcgccccgtgcccctggctctgctgcctggagaacgggtcctgaacggctactgtgcttccacctgcaccggtggactgaagtggcaacgtttgggccagtacatcctggcttggttggacgccctggcctctgccgtgcctgatgaatgtgctgtgggcttgcttggactgtggtggaacctgggctgcgatgcggacggttggagccggggcgaagaaccggtgccacgaacgggcagagctgagccagagggcgcagggcggagacgaggcacggcaagatcccaggacagccgagaacatcaacgcacgcgccgaaggcggccactggcatggagatgagacgagccacctgaagaccggaccggaagccagggggtggcagcagcggcctccggggggggtcgcgaggggggtccggaaggaaggggacgccatgggctggacaggacggcacacagggggaagaagccagccctgggccgggcgagagacctgaaggagccgagccgcgggagcggtacgccgcacagaaggggctgcaaggggcgcggcccgggcgagacagcggcaacgcaacgagtccggccgcgatcagcacgcagcgggaaccgacaggcgagcgggaaggggcccagcacgtggggcgaggccaagggccgcagggagggagtagcggagccgcttcgcagggggactccagtgaacaacacgaggcggaagaagcgaacgtgggagcccccaggagcgagggactaaactgggcgctaccagagagccaggcgaagcaggcgaggaaacaaacgagatcaccaagcgcccagaaggtcgcggcgcccacc

SEQ ID NO: 700010 - DNA, 207 bp, Homo sapiens
acccatcagccccctgccccggccggcccaaataggtttgcctttgccttccagctcccacagcctggtccctgaaaatgggttttgtcctgcaaacccctttttcaaaaacgcccaagcccagcccctaggagggggtggggcatccctggtcaaccctcaaacattccggactcccctcataacaataaacacatgtgcccagca

SEQ ID NO: 700011 - DNA, 612 bp, Homo sapiens
accatattgctgttcttcagggatggatcatgtgctgcaagtatattatagtccacggcgattctttacttccttataatactctatatagtcgttcccggtaatgtaacttccataagtccatagcttattgtcatttctcttagacacatcaaaaaggtaatggcgcttctgaaccagtgcctgttgtgacttctccgtatcaattgcattctggatgtgttagatggaagcctgcttcgcctcttctagttgggcaagtttttgctcattgagtttatcagcaaagtctgcaacaaagggaccatattttttaattccatagaccattacacctagtactgatagggcagtgaaggtctctgcgctaatcacatatatttctttggataaagcgtacaagataagcccagttccgagtacatagggtcctgttacaccagttttaggataaagaaactgggagaattcctcagggatcagtccataacgaacttttcctccgtattcaggaagaggtggtacaggcacaaggtgtggctgccctgtatgaagggtccttgttgcctgcaatacccctggacctaggaaggctgcattctacagagaggg

SEQ ID NO: 700012 - DNA, 175 bp, Homo sapiens
attcgcggacatgtcgacaaacattaacggacaatgatcatgttttttcttacataaaaattaaaaactatgcattcacacacacacaaacacactcgcacacacacactattcaagaatatgactaatcaggcatggtggctcatgcctgtattcccatctatttaagaagctg

SEQ ID NO: 700013 - DNA, 191 bp, Homo sapiens
cccgcgtaaatttggtaaaaaagctattttttaaccaaaggggcgaatggggaaacccttttaaaaaaaaaaaaacccggatggggtggggtggggtccttttgggaaaggagccccttttaagaaggggcgtccacccacaaggggaaaaactcttttgggggagggcccccccgaaccctagttggggg

SEQ ID NO: 700014 - DNA, 129 bp, Homo sapiens
atctgtctcgtgatactgctctttcttgtagctggatacaggcacgcgcacatgcccagctaattattgtatttttagtagagacggggtatcaccatgttggccaggatggtctcgatctcctgacct

SEQ ID NO: 700015 - DNA, 1391 bp, Homo sapiens
gaccgcgagagggaggaaacagggcgtgctgcgcacatgggtcctgagagatcgttatggaagttggcaaattgtcaacacgggagcgactgcgctgcttcgttaggacctagaggagggcagcagattctgttgtcggcttcagtatagagcaggtaggtaggtctggtgatatgggattgaactttcccggcgaccacatctagtctagaggacgtgcattctcctgtctagttgaccacctcggcacgtagttctcttggcgtagcaaattgcgagtaagtgacggagcatgtgatcttctcgggagatactcgtagatctatattgattacccctgcaatgaatgtcggtcgagacgctatgcaacttacacacatgctagagtgcgtgcagtttaggtgggaaaagtgttgtctcggaacgcatgtgacacgacaggtctgaggaggataggaaaaatgcacttctcccgcaactggtttggctccatcactcttgtgcggtacattgcacagaagcactaagacactccgcgccagttgtgctgggatggtcttggtgtcattgccgtagcggtcaaggcaagtccgttgccagttttttcgttgttgcagaatccgaggaaattgggtggagaggttggcgcactgtactggaagtgttcacctaacaatcatgtgggcgaagagtgaacgtgtgaatacgcgatgggagcgagtccggtatgggcaggaggctccaggattgccattgtgtttggcaattaaagcttaagttttttcacccttggaggcaattgcgtgtggaacattttccccatggagtggtcgtgggacaatcgaccttatcgaaacggagcgctgagatgcatcctttccctttgcttgagaaccctcttgcttttgcccaggtacatgcttaaggcgtgcgccaattggttagacacgtgggccccttgatcaacggttccacccaatggggggggttccacattgacaagatgtggatgaaggtagaaaccctttcgacaagaggttgacacctagggcccgcgggcagacacttggttggcgtccaattggtttccccaggaattcgttttgggccgctgtagacacaatcgagaggggacgtgccgtatgggtgtgttcccgaaattgtgccacaaaccagagagattgttcaacaagttcctggggcccttgggtgccttcaggcaagatcggtggggggacatcattcgtaccgcgaaatctttggggagcacagaggacacaccagccccaattgaaagcacaccatacatttggcgcgcgcttaatattccgtgaggataaatgcacgtgagatgaatatagcggcccgtgaggggtacacgcgcgctgaac

SEQ ID NO: 700016 - DNA, 316 bp, Homo sapiens
  misc_feature (47)..(47): n is a, c, g, or t
  misc_feature (224)..(224): n is a, c, g, or t
  misc_feature (293)..(293): n is a, c, g, or t
aaaactttattaattcacttggtgatttgttctgcttccttactgancatctcctgtacactaggcattttgcttgatgcttcatgattaaggtagtattcctatactgtgtaatttacagctgctggaggaaaggaagaagtaacaagaagacattttaaaaattattaaataaacttgagcattaattttattagtttcccctctataattaacaagtttancaaaaatactgtttaatgcttagttatatcttttctaggtgattaaatagggtctttgtagtaattttntttttaagggctttaatcaggaa

SEQ ID NO: 700017 - DNA, 260 bp, Homo sapiens
cgtaggatccagcaggggatgcgagcaactcaggacactgagcttgtggtgacagaccagcaggagatagaaccttccagaagtgggcagctgtggtggtgcttctggagaagagcagagatacacatgccatgtacagcatgaggggctggccgaagcccctcaacctgagatgggagccgtcttcccagtccaccgtccccatcgcgggcattgttgctggccttgctgtcctagcagttgtggtcatcggagctgtg

SEQ ID NO: 700018 - DNA, 136 bp, Homo sapiens
tgtcatctgtattgctgctttgggccgcctacctgtcaacctgccaggtgggccaggtgttcctttatttccagtgcctcactaccactacgagcaccagtgcctgcccacgcccgccgcctggttcgcacaccac

SEQ ID NO: 700019 - DNA, 122 bp, Homo sapiens
caggtcgaggactgtggagttgtactaattgcttagatagcccaagtttggtggtcgcaagtatacacgaagcagtgctgcgagatgagacaatgtcagtaatctacaaatggatgccttcc

SEQ ID NO: 700020 - DNA, 294 bp, Homo sapiens
agggggaaaaccattttttttaaatttttaaatggagggtgagatgaaatgggggggttttaaaagggtaaaattttagaccccctgtggaaccctgggccggtataggcccccttttaggggaggttttgaaaactttttcccccttgccatttggggctttggccccctaatcctttaaatttaaggcccccggaccttgaaagaaaaatgtttttgatccctttttaaaaaggggggtttagccttatttgggaagggactgggccggtttctatgcccggttttctttga

SEQ ID NO: 700021 - DNA, 190 bp, Homo sapiens
cttccagaactgtgtttgagaggaaacttcgagtcaaatccagctttgttgcccctctggagaagtcctatgggaccaggccccggatcctcacgggcaaccctcgagtagaccttcaggagattaacaactgggtgcagtaacagaggcaaggagctccttgtaggtgctgtggatgtcagggcgctga

SEQ ID NO: 700022 - DNA, 445 bp, Homo sapiens
  misc_feature (23)..(23): n is a, c, g, or t
ccggtccaaatatatattgaacngtttttccaatttgaaatactctccttagattgcggcatggcaggagggcatactgttcctagtagtcctctccaaactcctttaaaccatgacttcaatttgtgatatacattaagggcaattactcctgttagagattgcagactaggttaggctgccttaacacatacctgtttggctctggcattagcaaggacgtcttccttaagctaccaccgggcccccaggtccccctccgcccccctcgcacctcccccgttcccccccgatcctgccctccccccctctacccccccaccccttccaccacacccacgtccctccgccgcccttcccccctcccactactccccgtccggctccctctcccccctccccccacccctcctcccccccccctccccccgcccccctgcccccc

SEQ ID NO: 700023 - DNA, 771 bp, Homo sapiens
ctccaacattggagattacatgttaacatgagatttgggtggggacaaatacccaaactatatcactgtgtgattagtaatctctctcacttttagctgttcctctcttggaactatatcttaccccttgataccaaagccactgtattctttagggagatgacattgtcacaaaaggtataggacaaagatggtggattctggatcctgacattgctagacttaaatcccacttctgatagtaatcagccatgtctccccaccattatgatcctcagatttctcattcctaaggcagtgtagtaacatatactgttaaagattgttctgaaaattaaagataatatatattatgtgtataaacatatgtatatgtgtattcagtctttccaaagcttatctaatatcattgtaacttatgattccttttaattttaatcatgattctttttgggtttctaatttcatattttctcttttgctacttattttgataccacctggttttgtatatacttgaatcctttttgtatttatttagtgataaccattgtcttagtactattgagatatcatgtgaaatttttattcacttttgtcaaaaaatcactagcctaaaagtgtaaatcccaatcatgatgtgggatagtgtagcagtttctttcttaatattgttattatatcttgcctaagttctgaattatgtggactgtataaggtgtagcattctatattatgagctgtgtttctcttctggtaatacaaatcaga

SEQ ID NO: 700024 - DNA, 197 bp, Homo sapiens
gcacataattgtcaccgctctggctattttgtattctttgtagagacggggtttgccatgctggccagactggtctcgaactcctgatctcaagtgatctgcccgcctcatcctcccaaagtgctgggatctacattgggccttcttttggtttttgcttttatcttgagacagagtctcactctgtcgcccaggtt

SEQ ID NO: 700025 - DNA, 488 bp, Homo sapiens
tctgaactaagcatgtacagactttcccccttttcattattgcctatacaatacagtgtaataaccatttacatagcattcaccttgtattagatattataaataacctagagatgatttaaagtacacaggaggatgtgcataggttgtatacaagtatgatgcaattttatgccagagacttgagcatctgcagattttggtatctgagggaggtcctggaaccaatcccgcacagataccaagagacaactgtttatgttttattcaggattgaattaccacggataaaattatgtcagtaatttcagggtattaatattgtttacttggacatattggtagaatgtgagaatatatatagtatgagggagcccggatagttcagttggtagagcatcagacttaatcagagggtccagggttcaagtccctgtttgggtgtgttcttcggcttttagcacctaattctgattccacctttgaaa

SEQ ID NO: 700026 - DNA, 491 bp, Homo sapiens
  misc_feature (51)..(51): n is a, c, g, or t
tgcactccaacctgggcaacagagcaagaccttttctctaaataataatanaatgctgtaagtgttcaaaagaagaataactaggggtgacttcactaagtcctgaggagggaggaatagatattaccaaagataggagatactgatgtatacaaggtaattgcagttgacaaagagtaggtgtggctaattggagcagattatgtccatggtgtagtggattttatgcgttttttaacagaagaaaccacctcaatttttttttttgaggttaaacttcagtatatgaaagagggggcaacccagcagttgttttgattgaagcagagttctaggtctccaggaatagtttaaaaactgtaactaggctgggcacgatggctcatgcctgtaatccccaacactttgggaggctgaggtcgaaacatctcttgaactcaggagtttgagaccagcctgggcaacatagtgagaccctgtctctaccaaaa

SEQ ID NO: 700027 - DNA, 124 bp, Homo sapiens
ccggtcattttctacacagcatacaatttcttccagttaagagttcttgacttgcagccgagtcacagcagtggttgaacgggtactggaccagtcttgtaagtttttcaaaatgctgtcgtag

SEQ ID NO: 700028 - DNA, 1602 bp, Homo sapiens
  misc_feature (599)..(599): n is a, c, g, or t
gtgtacgtgaaaactacccctagaagccaataagtgggaactacggaaacatgacgtcagtagtcaacattgtgcgtcattggacacgtagattcgggcaagctccaccactactggccatctgcatctataaatgctggtgtgacatcgatcaacaagcaacgcattcgatagaacactttgagcaagggagcgtcgtgctggagcattggtgacaagggtctcctgtcagagtagtggcctggggtcttggcataacacttgagatagtctggactcgctggaagccgttggtatcgtaccatttggatagtctccctctgtagtcacaaatactcgagtagccacgacgaagtcacatattgtagactaaatcgatctcgattgcccccgagggaacacgagtacgaactctatattccacagagaaacagtgtaatataccaagggaaaccactcatacatggcgtggaacgtgatggacgtgctcccctgaacttgcaatgtgacgtggcgtgggaatggctcatcgagggtgcacacatgtgtggacactgccctggcggcgtaaatgcgattccacatgcgaaactgcgagncgacagtaagccctccgggagtgaacggctcacgttggcaccccgtttttacgttgggcgcctgtatgaaaccaggctaaacctggaggaggatggttggaacatagtgaataggccttaaaacattcttgcatcacgggggtggctcttaaagctagcacaatacgtcggcgcacgtctccgctaggcgttggagagacacaaacccccgattatgaagggtggccaacggaaaatgcaaagggcagctaacacttgccacgggccatagagcacttggggcgcaccgaccgcggccacaagagcgtccacaagaccgaaccctgttaaggcaaaagttcctcagaaggcaacacatgacacctgtggcggcagttaaatcgagaaagcgcaccgccggaaacccacccgaggcagtaaaagccaaagtctgctggagtgggccccaaagactatgcccccttgggcgtaagcgcgcgacacaactgtgcgtgttcggcaaaccaccaacgccgcagatttgggcccattgggcgtaggcccccacaatacgtattcgttgtaaaccacctgttgtccgcgtgtgtggagatatcacaacggggcgggacaatggggcgaacaaagggtaacaccacccccgctgcatacggcggcacttagtggcccacacactggtgcccacgcgacgtcggaatgccgccctgaaccgccctggtgccgtctttcgcagcgggcgcttcctcgcggtcgcgcccgttcgacgtatgtccgtatttaggcccacagcacgacaggcatctatggctgctctctatcatgtgggtctgctcaacgtgctgcgcctcattgtgttgacgcaccccgtgtgacccctccttctactcccagggaagctgtgttctcccaacgaccccacctcgtgcggcgcgcgcgccatctctgccgccacactgggttgtgccccatgcgttcggtctccctatcgactcgtgtcacctgg

SEQ ID NO: 700029 - DNA, 324 bp, Homo sapiens
  misc_feature (114)..(114): n is a, c, g, or t
  misc_feature (264)..(264): n is a, c, g, or t
  misc_feature (266)..(266): n is a, c, g, or t
ctcacgcctgcaatcccaacactttgggagggcgaggcgggcagattacgaggtcaagatcaagaccatcctggccaacacggtgtaacctggtctctaccaaaaacacaaaanttagctgggcgtggtggcaggcgcctgtagtcccagctacttgggaggctgaggcaggagaatcacttgaacccaggatgcagaggttgcagtgaaccgagattgcgccactgcactccagcccggcacaagcgatccctccaccttcantntcccaaacagctgggacttacaggcgtgggccaccacacatttttgagccggaccatt

SEQ ID NO: 700030 - DNA, 226 bp, Homo sapiens
gctcgctacccggccactctagtcaagagatgagagataacctctcgatccaccccttgatatacgcacccttcagacctgaccctgcatcctggcaccaatctagtgaccatctctacagttctgtcattttgaaaatattacataaatagaatcagtatagtatatagactattgtccactcagcatatgactatggagaactgtccaagctgtactagagcgg

SEQ ID NO: 700031 - DNA, 736 bp, Homo sapiens
taggtatcgttcgaccagcgttcgccacgcgtcaggcgagaagatgacccagatcagtgtgtgagaacttcaacaccccagccatgtacggttgctatccaggactgtgctatccctgtacgcctctgggcgtaccactggcatcgtgaatggactccggtgacggggtcacccacaactgtgcccatctacgaggggtatgccctcccgcatgccatcctgcgtctggacctgactggccgggagcctgactgactacctcatgaagatcctcaccgagcgcggctacaggttcaccaccacggccgagacgggaaatgccgtgcgtgtaacatataaggagaagcctgtgctacgtgcgtccctggtagcgtttcgagaccagagatgatggccacggctgcatatcgcagctccgtcctctgcgagaagagactacgaggctgtactgcacggccagggtacatcatccattggcaagtggagtcggttccgttgccctgaggcactcttcgcagtccttccttcctgggcatggagtcctgtgggatccactgaaagctagcttcaactccgtcatgaagctgtgacgtggacatccgtcaacagacctagtacgcgcacacacaagatggcttgtgctggcggacgaccgatgcatgtacccgtgggcattgccgagggggcatgcagcaaggagatcacgtgtccctgtgcacaccatgtctcaatgtag

SEQ ID NO: 700032 - DNA, 342 bp, Homo sapiens
atcctctacacggatccccccctcgaaacccagtctcgtcatctatctgataatcaggataggatatccatagatcctctgctaatgttgccatttccggatttgccctacccaatatgtagatggaattcttaaaatagttttgatgtgttttaattatttccagttgttgttcttatcatgtggaacctattgctaacagtgtcaactttaatggaatccgctactgggttttacgaggtgctcctcgcaaaccccatgttctgatagctcacattatatataatatttaactaaaaatatattattaactgcgaaccattgaatgaacatgtactcagt

SEQ ID NO: 700033 - DNA, 343 bp, Homo sapiens
  misc_feature (113)..(113): n is a, c, g, or t
  misc_feature (166)..(166): n is a, c, g, or t
gctcgaccgggccggccttgagcacaatcgacgacagggtcagtgaggacggggaatcaggtgaacggcgagacgtgggaccccagcgacgtgcgaacgcatgattgcgtgantggacaagctgacaccccgggaaggctacaaccttacggtgttgccgcagtgncgtttcctgcgttccaatcggccgctgagcctgaccccggtgttttaccagcccggtatcgtcattgtctgccagggcagcaagcgcgggcttcttcggcgatcaggtctacctctacgatgaacagcactacctggccgtttcagtgccggtgccgttcaccatgcaaacccaggc

SEQ ID NO: 700034 - DNA, 1208 bp, Homo sapiens
  misc_feature (807)..(807): n is a, c, g, or t
ggtgtctgccgatcacacagacgatcggcagttcattcgatgcgccttcatgcatgacaagtcgccgcggcgctaagtcgcatgcaggcctgtgaccgggccaattgcgtgcagtacctaatgtcgccccttgcacaggcttgcaccagagtcagcataacactatcgtgcgataaatgcgagatcacgtaagaagcctcacgacgagtaacttgttcattgccacttatgccaattcttcgtggtcgtcaccgcacctctgctccgtgcgaacgagatgccgactatacgaatagaatacgcctcgtcctacgaatggcatcttcacgatcaaagtcttaccttcacgcaagttaacttaacctaaaggttggactcagccatgcagaggtgcggagagcacatcagctgttatctgctcgcgccttaagaaccaccggcaacgtttattttgaaccgcattacttggggcgaagaaaagctgcgtactagatgggccccccagtaaatcgcaacgagtactacacattgaattccagaacattaaatgccgacatgctaacgacgtaacatatacagccatgtggaccgtccgacagctaatggaaccgaagcttccgaacaaagacacccctttgtatatacgtaccgcagcattacagtacgggagttaaattggtgaactccggagcagagacgccaaccacaagaatagggtagcgaaacactcagacacttcccgaagcgtcggcgtgagcgccaaagcaagattgtgaagaggcgtacagacccattaaggagagaaancaccaccatcccggagttgtgaccaaccgaagcggtcaagacaaagaagagcgcagacgcgcacgatgccgaaatgcctaccccagcttagacgataaacacgttaaattccgcgccccgcgaaggtgtatcgtatcccattacaccttaagttcggcacattactgataagacacacacaagaaaacaatttacaaatttttacacccccggggtagaacttgatactacacgcccgataccttctttaaaacaaatagccggcacacagaactacatctaaccatcagcacacagaacacgaagacaatcattaaccacacacaaaacaagcaaagcacacatcacacaacgatctaacataccattcacagactaaatgatcaacagcacacgaaaca

SEQ ID NO: 700035 - DNA, 443 bp, Homo sapiens
  misc_feature (4)..(4): n is a, c, g, or t
  misc_feature (125)..(125): n is a, c, g, or t
  misc_feature (146)..(146): n is a, c, g, or t
  misc_feature (177)..(177): n is a, c, g, or t
  misc_feature (227)..(227): n is a, c, g, or t
  misc_feature (242)..(242): n is a, c, g, or t
  misc_feature (248)..(248): n is a, c, g, or t
  misc_feature (304)..(304): n is a, c, g, or t
  misc_feature (353)..(353): n is a, c, g, or t
  misc_feature (380)..(380): n is a, c, g, or t
aggnagcggtgatggggcgacgacgccacacagccagcgccgtcctctcccagaccctggggggagcccctgtggctgggggtggggagtgggggacccaccccaggccctccctctccctgccncagacagcctcctttcgggcncaacccattccttccggcaggagactaaggnacaaagagaggaggaagcgggagaggaggacgagggaggggcagggtggnagcgcaaatgaaggnagaggngagaggggtgggcaaggccactccacccccacacccaccccagaaaggggcgaggnagcgacaacagcacgcagcaggggggggggacaagggggggttaaaggntgaggggcccggggcagggggggcctngggcctgagtgaaagccgtgccagtggctgtgccctgagtggtatgccagcacggcgcccaca

SEQ ID NO: 700036 - DNA, 1207 bp, Homo sapiens
  misc_feature (636)..(636): n is a, c, g, or t
  misc_feature (1207)..(1207): n is a, c, g, or t
cttaaaaacaaaaccaaaccacacaacaacttggaatgtggaaagaagttcattatgtgtttccattttatgatgaactatttctttaatttttactctttttagttacgtgtttcttttgtttttttggggagggaatatggctcggtcgcccaggccgggagctggcagtgagccgagctggcagggagccgagattggcgaccattgggattccagcatggagcggagagagtggagatccgggctcaaagtaaataaatacttaagtaaataataaatataaaataaaactaatggataactggatggagctaaaataaataaataagaggtccgggtataattttggggatatctgggcaaccacagataagccaaaaagtcctcttattcaaagggtgggacatggctggtttcagtaacttcattacgggcttggtggaacattatctcaggtgaatcctaaaacaaaacaaaacagaacaaaatggactttcccggtgctcgatttcctggagggatcttggtaaacatcagctattacagggtggctctttggggtagatttcaggtgtatgtgactctggtaagcattcaggttaccagtggtttatggagtgatacattatgtgncagatacagtctggacacaggtgtggataaaaaaagacccatggccctcaaggcggcaaataatacgggagaggggggaaggaaggacacctgtacaaccaagcagtggacatattaccgaaatttgcaataaaggtcagggaagaccccaaaatataggcagggaaacatgggaaacgacaacatggggtggagaaactgggaggaggacaaaccccgttgaaagcgcaacgacgtagacagacaccgagagtaacaccggagacacaagcagtgcgaacaataggaggaaacaggaccataggagtgggcgagaacaaggaggccacaccacagacgactaccaaatgagccaacagcgcacagcagagcacgaggaagcaaacaatacaggacagcaggaagaaaacaaaaaaagaaggaagacggcagcagacacatcagaatgaacgagacggcgaaaagaaaaaggacaaagcaggaaaaaacagagcagagcgcaagagaagaacagacagaaaaagcagacaacagacgatcgaaccctcgccgcaccacccctcgtgctgan

SEQ ID NO: 700037 - DNA, 750 bp, Homo sapiens
  misc_feature (183)..(183): n is a, c, g, or t
  misc_feature (225)..(225): n is a, c, g, or t
  misc_feature (326)..(326): n is a, c, g, or t
  misc_feature (331)..(331): n is a, c, g, or t
  misc_feature (333)..(333): n is a, c, g, or t
  misc_feature (349)..(349): n is a, c, g, or t
  misc_feature (363)..(363): n is a, c, g, or t
  misc_feature (416)..(416): n is a, c, g, or t
  misc_feature (425)..(425): n is a, c, g, or t
  misc_feature (457)..(457): n is a, c, g, or t
  misc_feature (608)..(608): n is a, c, g, or t
  misc_feature (610)..(610): n is a, c, g, or t
  misc_feature (613)..(614): n is a, c, g, or t
aatttgctaactgggtaaatatttgctaactggttaaacattaatatttaccaaagtaggatttgagggtgggggtgctctctctgagggggtgggggtgccgctgtctctgaggggtgggggtgccgctgtctctgaggggtgggggtgccgtctctctgagggggtgggggtgccgcttanctctgagggggtgggggtgccgctctctctgagggggtgggnttgctgctctctccgaggggtggaatgccgctgtctctgaggggtgggggtgccgctctaaattggatccatatcatttgacgctccggggttctggtgtnctggntntcttcattctttactngcactcagattaangccttacaaagggaaagcctctggccgtcacacgtaggacgcatgaaggtcanctcgtggtngaggtgacatgctcggcacaattacaacagtnagagagggagaaatcctaagacagaggagctccagagatgagtgtctggagcgctgtcagttcagctcttaaaggccaggagggccaagcgtggttggcggctcgttccagtggcggcacgtccttgggcgtctctaatgtctgaggtcangngcnngcactttgcccccctatttcaccctggcgtgtcctcggactccccccccccgccagcgtgatcccggggcctctggtcgacattcggcggtgccccttgtcctggcgccgtgtccccgtgccccgcgtgcgctccc

SEQ ID NO: 700038 - DNA, 503 bp, Homo sapiens
gcctaggtaacagagtgagaccctgtctcaaaaaaaaaaaaaaaggaaaaaaggaaaaaaaaaggacttaagaattttataaagggaggaggtaatctcgggccaggatttcaaaggttctgggaggtggtaaaagcgctccggaggttcctttttttatttacagggttacccaaccttttcgtggttctgggagaaccccttcaagagaagaacattttaagaaggggtgcatgacgtgggcaaaggaaacactttgggactttttccttccgagaaagtttcccaatcttcgtggagaaagagcccagagggactctatagatttgtggggggagggggttactaccctggggtgggcgcggtgtggtgaaactgtgggggaacaccatctgagacacatgttgggggggaggcctccgcggggagttgggaggaaaaataaaaggttaactcttttttggaaagggcgtgagtgggggaacttttagaagaagaagacc

SEQ ID NO: 700039 - DNA, 286 bp, Homo sapiens
attcaatatctcatcaccccttccaaattcatttctccttccaacatctcatggctccttccaacatctcatagctccttccaacatctccttccaacatctcatctcgccttcaaacatctcattgcgccatgagatgtccttccaacatctcatacccccttccaactctcctggctcttctccttagcctccttcattcgcctgggccccaaaagagctagcagaatccgcaaacttttcaatctctctaaagaagatgatgtctgccatgagatgttggaag

SEQ ID NO: 700040 - DNA, 1129 bp, Homo sapiens
agcggggcgccggccaagacagtcacagagagattgactctattggggtgtttcgcagagtgtgagagggaaggcgccgcggactgtatgtgctagaccgtgcccttcgtgctggcttcgatggccgccgttgtgcccccgtgggcccctgtgcgcctgacaacgttcggatacatttgcgcgtgtgctccatgtgtctacgagccctgatggcatggatctgccatgacgtggctgtcccaattgtgcgctggactccgactggaaacgctcttccacttgcgctgggcacagcgggatgcctgcttgcgtggcagtcacgcctgccgggtcgaccgtggggcaccttgaattcgcaatgggtgtaaaggggaacccaaatagggaaaaacgtggaaggtggaaccaggctggggcgtccaaccggggttggatccagtgtcaactccagaaagcattggcgagggaagcacgaatgcattagcgtctcgtgactgatctgggccgtgtgcattccaaaggaactgggcgcggcctggtgggaaggactccagtcggcgccaaacttgaattccgacggggcaaaacgcgacaattcaagccgccgggttccctaattttcaggccatttccaactttccccgtgcaaaagggcgggaaaaccagggtcgtcgactttggaggcggaagtcgccccggcgcgaaagggaaagccccacagccactccagctcatttcgcgaagatcgcgcccaggcaagagaaaaccggacgtgagagtgccattgtgtggcaacaggtctccaaaagggccgggcacgtatccagatcagtagggcacatgacgaggcggaatggggaacagttggaaccccacggtgtcactgatggaaccaggcccagagggcaacgtatttgccaaacgtattgccttctgggccccggctttacgataggggttgggcctccggaaacaacacgctcaacagacgcttaaaacagccctaattaaccgatttgtccacagaggtttggcaaatcacttcggggacaaggtgcctggggggaccacaaaagccaaaggaggtcaaccgccttttgatggactctccctttgtgatacggtcacc

SEQ ID NO: 700041 - DNA, 81 bp, Homo sapiens
  misc_feature (14)..(14): n is a, c, g, or t
  misc_feature (66)..(66): n is a, c, g, or t
ttttccttgttccntcccatgcctagctggattgcagagttcagtttctcattcttacataaaaantaaataacaattaaa

SEQ ID NO: 700042 - DNA, 134 bp, Homo sapiens
gtccttatttctaagagggtaatgatgctactatgtgcctcccaagacttaggggagttcaattcatatacgtgtaaaatttacaagtgcccaacacacagtaagcactcaataaatgttaactttggtggtta

SEQ ID NO: 700043 - DNA, 169 bp, Homo sapiens
caaccccacacatcacacaccacacacacataacacacataacacacacctgcacatatcacacccacacatgcatcacacctgagcctcagcttcctcagctgagagagaccacatgctccctgaccacctgtcgggtttgttaatagaatcaaatgtcgcgcggccg

SEQ ID NO: 700044 - DNA, 523 bp, Homo sapiens
  misc_feature (355)..(355): n is a, c, g, or t
gaacgggtgatgcggttgctatgagcacgatgcggactgcactgcagctgggtgacagagcgagactccatctccaaaaaaaaaaaaaagagagagagaaaataggggaaaacaaagcaggagggcggtgtctcccttccccacatggtttcccaaccaaacagctcctttctatttaatatgtggggctagtatgaaaaacatttctgctaggaaaaaaaaatttttttgagaagtttagaaggcttagtgtgatttggaccaaagttccttcatttcacagtgggggaacctagggccttagagagaggcaggtgatatgggctccagggcagggcggggaggagatcgggcntaccggggctcgtgctttgggctcttgggggttggatgatttctaagccaaaagagtaaaattctgggggcttggggccgtcagttggtcgcccaagtttattcagtgacctctggcaagtctgggccctctcggggtctcagttcctccatctggacccagggttcc

SEQ ID NO: 700045 - DNA, 391 bp, Homo sapiens
taacagctcactacagcctaggcatcttggtccaatagttatcctcctgccccagcctcctgagtagcataaacgacagatgtgtgctaccacctctggctgatttttaaatatattgtagagaccagggtctccctatgtagcccagattggtcttaaactcctaggctcaagcagtcctcctgcctcagcttccccaagggataacaggtataaacgatcgcacccagccctatcttctttaccaacatcattacaaattcaattattgtcactctataagacaccacatctatcaagacaaatcttccctcctgtatacttgtctccattacaccttcaaacttttatagaaaccaggtttctctcatgttccccaggttgttcgcac

SEQ ID NO: 700046 - DNA, 440 bp, Homo sapiens
  misc_feature (295)..(295): n is a, c, g, or t
  misc_feature (396)..(396): n is a, c, g, or t
  misc_feature (418)..(418): n is a, c, g, or t
cgatctggctgggtcactacgtcggccagcagtattataatagcagtaagtataatatagtgctattataatagcactatgattaaaatagtggaaacaaattttatttgattgaatggatcaacaaaatgcgatctatccatacaatggcaatattattcatggctatagaaaaggaattcagtacagcatggttgaagcttgtaaagtatgctaagtgcatcataagctcaacataaagagcttcatatcatatgaattccactttacttgtaaatgtccagatattggcaanctccatatgagacagaaacgtggattagtggctgcctaggaactgggaaggaggcaggacatgggaacgtgactacatgctagatagacggtttcttttgnggggtgataacaaatgttctgngaattaggcggtgatggttgca

SEQ ID NO: 700047 - DNA, 467 bp, Homo sapiens
tagtacatagaaggctctatgcttgaaatatccttccagctggcaatcaccatcaaactgcaatgatagattcttgtcaaaagtcttttacattcaggtagaagagagaggtaagatatatcttatgatatatctggtgaacctagccctactttgataaagagtgttctagttatctattgctcatattcaaattatttttaaactcagtgacttaaaaagtaaccatttcaagatatctctattgtgtgcataaacattttaagatggatctaagcattcattcctttatccttttcaccttaactgcagtggacacagatgctctactgtgtgcctctagaatttaggcagagcatggctgctttcttcttgtgttccacggcaccatcaagcaaggtaactcggtggtactcagctagcatacaagaggtactcagctggcaggtgggctgatctgagggttc

SEQ ID NO: 700048 - DNA, 1155 bp, Homo sapiens
ccacgcgtacgatccggatgccgcccggatagccggtgccagagatcccactgtcgccccgtgtgcccccgatcatgtccttcctgcaaagtggtccgggcatgagtcaaattccggcatgtgttcgggcatccggatcaagaactaacccattgctatgcaggacaatctcagcgtgtcccgttgattcagctgtgtgacatcacctttctgcagcctgtctcaccccaaagtttccttgagtcgcgtgattcgtgcgcaggctcaacctgcgaggcgggtgcggcgttctctcgatgcatccctccttaatcgacatcacttggctcagcaaattgacgaaggacgcgtacccactgaatcgagctgtgttcgagtgcactacctgagcggaccactagattccctttggaacaactactgagctgggttagatcccttcacctagacctgtagcgaaaagttactattacggacaccaaggccgcgtcattcagtgaagcggcatcattggctacccgtgctccagttgggattggtgccacaaagaattccccctatgcatggaaagcggtgggccttagaaccgctacactctcaggcatagaactatgaacgtcacctgcgctgtgctaagtgtcacctttgagcaagtgtggggcgaacaaaccaaacacgtcagactgtcgagaggcagatctattcagcaccgttagtgtgcattcacctccaacggggacccagaaagaatccgtagctagtttacacaagttgaaaagtgttttgcaggcactatatccagatatgtctaactagtctatatctattcggtaaagcatggttttgtggagcgacacaacgcacggagaacgagaaagggctggttaccccaggcccttgcgtaagctaggcctccgtggaccacccccccttgccgagccttaactacttcataaaccaaaacgtgcctcccaatgaacgtggagaaataccccactaacaactcgagagatcacagctgccttgcgtataaattggcactccccatgatccacttaggccccgttgtgcacactcaacagaacagagccgttttgaacgacaaattcacttccatgaaagacccctctgatatgtggtggcctaacccccttg

SEQ ID NO: 700049 - DNA, 416 bp, Homo sapiens
  misc_feature (243)..(243): n is a, c, g, or t
cgacggctcacggaacttttaagcttagtgaggaagcatgtgaaagccaagaaaggcaaaagcgagcgctctcctgccaaacagttggccaagttatgaacacaaagaaaagttcctggaaggaatttaaacatgcaattccaggaaacacatgaatgataagcaagtgaaacagcctcatattgctgatatggagaaagttttagtgggctgtctaaagtgatcttctaagatcaaaccagncacaacattccctaaagccaaaacctaattcagagcaaggccctaactcaactctatctgggttgagagaggtgagaaagctgcagaagaaaagtttgaagctagcagaggttggttcatgaggtttagggaaagaagccatctctgcaacattaaagttccgttgaagccgt

SEQ ID NO: 700050 - DNA, 181 bp, Homo sapiens
actgtctctaagattatgtcacattattcaggttatgtagagttactcaccagtatgaattttctatatgtctagtaaggtgtgaggacgggttaaaagcttagccacattcttcaaatttgtagaatttctctccagcatgagctctcatatattcattcagatttcgtggattgtataa

SEQ ID NO: 700051 - DNA, 223 bp, Homo sapiens
cacctcctcgactctattcaaatgtcacagagaaatgacacagcaagctacaaatgtgagacccagaacccagtgagtgccaggcgcagtgattcactcatcctgaatgtctctctatggcccggatgcccccatcattttccccgtcataaacacatcttacaagatcgatggagaaaatctgaaccctctcctgcccacgtctccctcttaacccacacta

SEQ ID NO: 700052 - DNA, 101 bp, Homo sapiens
tataagatccccgtccattactaggagttgtataccagatacccttctgttgagaaatttcagggtgtctcaaattgctactcttcattatgaagtatcga

SEQ ID NO: 700053 - DNA, 152 bp, Homo sapiens
  misc_feature (51)..(51): n is a, c, g, or t
  misc_feature (114)..(114): n is a, c, g, or t
  misc_feature (137)..(137): n is a, c, g, or t
gactgcgataggaatcatgtctggtcgcggcaaaggcggggcttggggaanggtggtgctaagcgccatcgtaaggtgctcccggggattaacatccagggcattacccccggntttccgccgtttggcctccggcngccgttggccttccc

SEQ ID NO: 700054 - DNA, 219 bp, Homo sapiens
tccaaccttagacggtcctgacttggaaaacccctgcgagcatcgccaccccaccgacgtcacaaaccgcttgaggcaaaatgagctaacgtactactgctgcaagaaggacctgctgttcactttaacgaacccgcttgaacaatggtgggacatccttatcacagaaaacagttcttctgctggcgactccatttctggcaacagcctggagccttc

SEQ ID NO: 700055 - DNA, 1064 bp, Homo sapiens
gagccgcgggaagacatgagaggctgctacgaaggacttcccgcggccagcgccatcatcctgcccactgcctgcacgggacgtgttctgtccatgctccaactgcccacaccaactgtgcctgctgtgtcaaatctcctgctggtcccaacatgaaacctgcatggtgtgccctgtcttggaggacgacgaatgcggacggccagactggccctaaagcgacacgcgaactgcctggcgcagcggccaaaccgctgtgacgctggccccaacatcatcgacgcccagccacacgactgccacttctactggcttccaccgactaacaccttaccttctgctgcgggctcctacgcaaaccccactgccttggttaagcccacgaaccgtatctctaaactctgtctccccacacgcgccagcacacagggttggcgacaaggggttcccagttggcctggccttcccataaatctctggccagggcaacccaatcccacggacttctggacacaccaacgcggttggcccccacatatggtgttccgtattcgcccgttggcccgggtgtggctcccacacacacgcggcctttcccactggggcctgtgcaagctccggaattgccaccaatgccaacttcccttgagccccaggacacgcccacggccctttctctctgggcacaccccctttaacctgggttagcttaccttctgctacgcaatgttccacacgtggttacgaaagcgcctcccaataggaaccacccatgaaaacacgcgtggtcccccattgcggcccctttggcctattgggccctccgatcaatcgtcaccaagtgcccgtttattatgggcctcggaaccgaaaacaacttccgctctatcacatgggccacctcacatcgcaagtgattctcccacctggaccccttgggccacggttatacgtttccctaaagggcaactatctctggggctcgtcatactattccactgcgcaagttctcacacgtttaacctcttgggccccgtgtgttctactacaccgcctcatactaa

SEQ ID NO: 700056 - DNA, 694 bp, Homo sapiens
atcccaaggagggggtcacacgtttggcaaaagtcctcaggggattctggaactaagtctgatgaaatgattccaggtgaagccctggttctgagacacgagtcatgactgctagggtgatggtccatgggtattcgcccagggcaggtggtctgtggctgataccttcaagggtctgcagggtatgcaggtggtctgggctgctcggcagatagtttgctgattcccagctgaggggagcatggtggcgattgtcagccattttctgacagacacacagagctgccatttatctcccccaaggtataccgtaccctcctgtgagacagtgtgtgcagggaccaccaccttaatcctgctgttgcctgacatgctgattctcatttattatgctggcatcaacacattagaggtacaggagcgggtcagatcatgaaaaaacgaaggtcttttggcccatttctttatttcagagatgtgggctttcagtgggaatttgctgactcctactttataggctgagtcaatgagggaacgatgactggcgtttcctctgtctaaatgggaggttgccagagcgctggctgggactaggatgtgtaactaagatttcacgtttgacatcttagatttcagttcacggcgataaagaagtagtgctggcccccaatatgttacagcacttgtcgcaacc

SEQ ID NO: 700057 - DNA, 625 bp, Homo sapiens
atcatgtggtctagtcatttgcacaaatttagaggatcagtagtaataggtggaaacacaaggattattgatccagttgaagtgctctcatgagtagaaggctcctttggaacaggtgccatggatgtcccagcaaaacgggtagaggagggagatcggtcatgcttactgggttgctttagaaaaagggaagttttactagcgcttatggctgagacagcaaaggaagagaaagagatattttgccatatacatattgcacatttcagagacataaaggtttgggagaagacagggagacagggctgactggggagaacaaaatttttcaaattaaaaaaatcaatcttgaagtcccagtgaacatctaaaaatttccatttaacttcctgcaaggccagcctccaagatgactcccagtgatgtccccagtgattacatctttatgtatttaggtaggtctatgtgactaatataatatagcaggagtgatggttactcctgaggtttacttcttgaggtagggtcagaaaacaaaagtgtggtttctgctctctctcagatcattcacctatggagaatctagtttccatgctgtgagcaggcctattgagaggcccccttg

SEQ ID NO: 700058 - DNA, 305 bp, Homo sapiens
ggttcaaaaccccgcccatggaatccttaatttcctccttgggttgtttctagaggtcaaaccaccccccattcaattggttttttcctccggggcaacctccgggggtcaaaaccccccctttttaattctttttttcccccgggccctcctcccggggtcaaaacccccccttttcaatttttttttttcccgggggcaatcccccggggtcaaaaccttttctttttcttttgttttttccccaggggaaacccccctgggtcaaaattccttttttttttgtggggttttctccgcggaac

SEQ ID NO: 700059 - DNA, 777 bp, Homo sapiens
cagccctgcggccttggccgcctacaaactggtgctgatccggacacggtagacgagcgcatggaaccatggagaccccgcttcagcggatggtacgacgccgacctgagacccggcgggccacgaggaggcgaagcgcggagggcaggcgctacgagatgctggctatgagatttgacatctgcattcaccatcaagtgcagacagagagcgatccggaccctctggacagatgactagatgccatatgatcagatgtggcatgccagtctatggatgaggactttggcagccatcaactgagcaggcacatatgggggtctaacacggatactcacataaagcagaaacatgcatgcaaaatggcatgtgtgaggaccagtgtgcaagatcatggtacggcagcgtccatatgaatgtaccacgcacactccgaatggagacccggaacaatccattctcataacaagcaacacaatcaagctcaaggatcagcaggttcatgcaggacacatcaccagacacgacttcaagcataaccctcactgatgagacgtctctggcaaacgtgcactactatcatggccaagaggctacatgccacgtacctagggcacattgcaacggaccattcagtatcacccaaagcaatcaaacgggacttggtgccaaccgttgcttactgatctcggcagacccaatagagcaaaccaggcctccctggtggcattatggacacggccatcttgcgcacgtgtcatctctgccaagagagca

SEQ ID NO: 700060 - DNA, 321 bp, Homo sapiens
ggaacaaaaagcatcaaggtacataaattttgggggtctaatttaaaatatgagcatgagttttaaaagctggaaaacttgactatgaattccagctctaccacaaactggtcacttgtcttctcacctctttgcaactcacgttcccatctgtaaggtgaagatactcacatctgctctagcagtttcacaggttgctatgaggtgctaatgagatcatttaaaaatccaactatcattggtatctcagtaagaatctggcattgggagctcaaaacactgcaagattcatgcggggatcataattcttggctaaaaatt

SEQ ID NO: 700061 - DNA, 903 bp, Homo sapiens
ggagctacagtaccagaagttatcgtatgcacggcactggggggggtgcgagtctttggcttctcactcatcactaacaaggtcatcatggattatgaacagcctggcagaaggccaaccatgacagaagtctctacgcagctggcaaacaagctgcacagaaacttggaacagctttgtctcccattcttatggcggggggttccactccctgacaaagccagcttgacctgccttggagtcgtctggcatctcccacacaagacccaagctagctgctaccttcttctggcacccttgctggagtcatgctgcctctgtccttaggttgtagccagaacggaaaagaccccctgtccttcacctttcccacttctcttctaccagacccttctggtgccagatcctcttctcaaagctgggatcacaggtgtgagcactagtgagaccctctggcgccaccaaacactacacgctgctcctcattcctgttctctcccttacacaacgagctggacgcccggtgcccctaccacacatctgctgcgacgaatgccccagcgattcgacctcgggcccccagcaacttttgccatagcacgcctgctactaggctctctggcagataataccattccgcaggcggctccagtcgtgcccttcatctaacatcacccagagaaccaagaacaagggcctaactccaaagtaccctcctgggactccaccccacacgctgccaccggccgcccgcacataaagcagcaaagactgaaccccacaacacgccaccacaccacccaacgaaaagacagcgccgccccgccccacacccccccccgcggcccacccacgccggccccacccgcacacacacccgcgcccccacccgcggcgccaacc

SEQ ID NO: 700062 - DNA, 101 bp, Homo sapiens
tgggcccacgctaccgggagctggtcaagaactgtggtacgacggcctacacttggggcgctgtgggcccgtggggctggtgtgggccaccgattggcggc

SEQ ID NO: 700063 - DNA, 282 bp, Homo sapiens
gcagttctgacgcttgcgctcattagtggcggcgacgggctcgatctacccgggctaaggtgtaggccgagtatccgccctgataagcctcgatggtggtgatcgtcaacgtggccctccgcgtccaccagtacggcccgtacttggaatacgagcggaaggttttggtcctgcatgaacggacctacgaggtgcccgaatgattcggaccatcaatttcgaccataacgagaagcgcgccgtcatccgggagatgttcgacctattcaacgagcgcgtcca

SEQ ID NO: 700064 - DNA, 182 bp, Homo sapiens
ataccgtcatttatggctaataccccgtctttttacagccatagagaacaataccgacagcatttgaaggggaaatttaataaatactgccggttaaatgatcccaaggggcccctttgtagtggctggttgacaacggctggagccaattaaataaatcaaatagctctgtctttcattga

SEQ ID NO: 700065 - DNA, 311 bp, Homo sapiens
gtagctgtccttgagttaaaacgtgactgagaaggaaattgagtagtgcatatgtaaaatgggtattatccttcactcttcaaacaggcagacctgttatcctaaactaggagagtcagcttttggtacatgtgaggattttcagtgtaaccaatgatgtaacgattctgccaaatgaaatataatgatatcacgtgaaaaccggtccattttgattctgaggctactctactaacaagcatcacacatctcgatttagccctgattaatatgttggcttcgcttacagggtttttaatgaccacaacaag

SEQ ID NO: 700066 - DNA, 1693 bp, Homo sapiens
gcgctggattcggcgcgggtgctggcgccattggaggcctgagcgggggtccctagcgccgggctgcggagcgtagcagctgcgggccagacgccggaggagggcgcgcaggccttgtgtcgagttcgttggggcatgctgcggaccgtgcggcgtgcgcgcgtgtcgggggtccccagaaatcgtgactaggaggccggccttccttgccacaagctcggagctacagcatgtttatcagaacggacttgtgggaaggtgttctgggatcatgcaagtggagagaggtagacagagtgagatggtacgatggtcaaacctcggtgggaggttgatggaaggctgagcatagcccaaagaccggtatcggaaactgtagactgataggcgttacccaaagagccaatcagccgtatgcgaagaggaagtatccaggggaacgatagcgtatgactgctgcacactcatacaattggagtcattcctttcaaattcgtagaaaaccggccatttggaattgtgtgtggcgtggatgaaatgagcgacgcacaggcagaactgaagagcagaagaatgacaggagtgaagaggttgtccaccagaggtatgagttgaggattggaaatccgcagttcagatggaacttgaaaccaagttgtgaatgggggatgaatcagttatggtaacgggaggtggataggaatgttgtgtgacaacaaaggttgaccaagtaagagtctttgtatgtgtcccacaatgggtgtggggtagagaataagtatggaggtgaatgtgacacaggcttttgggccgccatatgtcagccatacaaaggcgaaagtccatggaggcactcaccgcgaaggtaacaacgagtactttcgcgtgggtgattgacacatggcaatgccactattggatgtacctcaggacaaagctaactaccgatttgtggcgacaacagccatccagtcgtagacatgcaagcacaaagcccaatcacacaagaagcaaactatggataggcatagccacagcagaattatactatcatgagacagcaaggacacaaccagtatgaaccccattaggcaccacagtaacagcccaaggaacaaagtagggtgggatcgacaaccccacagtcgtagattagcacgatcaagtatgcagtccgaacacatagcaggaagtacacaacgggagagaagtacaaagtcgaggaagagacaagccgcaccgaggatgagcactgtacaaacaatagagacacagaagaagccacaactcacagagagcgcactgagcaagtgaggagagacccagagtacaacagagacagttgagacgaggcacaaatgtgcaacagtggctcgaagacaacaaggcacaagcacagcgacaaaagcagagaaacagacggtgcagacacatggagcgacagaacgctatataactccacggtcaggagatgacgcaaagcatccgtgagcaaaaacttgtgagtacaggcaagggacacctcagcagcgcagcgacgatgaggagcagagcggtgacgaatagagcgaaagacgtaggcaccatcgtggaagacgacccaacaacagatggacgactccacacgagccacacccacagcgcaagcagacacagcacgtagaccaacacgagagcgagcggctgaaagcac

SEQ ID NO: 700067 - DNA, 165 bp, Homo sapiens
cggtgctggccaaatctgtaaaataccagaaaataccacacacatggtatcaacagagctcttgaacacaaagtcaccttggggcactgataagatgattaaacgacaggactgcacaaaattttggttctgggtatgctaccattgtgactcgaaactagccca

SEQ ID NO: 700068 - DNA, 457 bp, Homo sapiens
tcatatgaatcagccgacaaggtcgcagaggggacggaggtgcttctacagtgtccacaactcgtgccccagacatctttgcgggctacagctggtacacgaggtgaaacgagtggatggcaaccgtcaaattatcggatatgtactaggaactcaacaagctaccccagggcccgcatacagtggtcgagagataatataccccaatgcatccctgctgatccagaacatcatccagaatgacacaggattctacaccctacacgtcataacgtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctaactgtggtgggtcaacaatcagagcctcccggtc

SEQ ID NO: 700069 - DNA, 893 bp, Homo sapiens
  misc_feature (5)..(5): n is a, c, g, or t
  misc_feature (119)..(119): n is a, c, g, or t
  misc_feature (122)..(122): n is a, c, g, or t
  misc_feature (172)..(172): n is a, c, g, or t
  misc_feature (266)..(266): n is a, c, g, or t
  misc_feature (272)..(272): n is a, c, g, or t
  misc_feature (287)..(287): n is a, c, g, or t
  misc_feature (308)..(308): n is a, c, g, or t
  misc_feature (311)..(311): n is a, c, g, or t
  misc_feature (340)..(340): n is a, c, g, or t
  misc_feature (370)..(370): n is a, c, g, or t
  misc_feature (405)..(405): n is a, c, g, or t
  misc_feature (474)..(474): n is a, c, g, or t
  misc_feature (477)..(477): n is a, c, g, or t
  misc_feature (668)..(668): n is a, c, g, or t
  misc_feature (670)..(670): n is a, c, g, or t
  misc_feature (677)..(677): n is a, c, g, or t
  misc_feature (689)..(689): n is a, c, g, or t
  misc_feature (692)..(692): n is a, c, g, or t
  misc_feature (717)..(717): n is a, c, g, or t
  misc_feature (719)..(719): n is a, c, g, or t
  misc_feature (762)..(762): n is a, c, g, or t
  misc_feature (766)..(766): n is a, c, g, or t
  misc_feature (776)..(776): n is a, c, g, or t
  misc_feature (784)..(784): n is a, c, g, or t
  misc_feature (786)..(786): n is a, c, g, or t
  misc_feature (853)..(853): n is a, c, g, or t
gttgntgttcatgttttgttaggtacttgcttgtctttctgggtactccttgtttacccgcaagtctgtatctctggcggtgtcggtgtagctcttgtaacctggtatgtgtagcttgngtnagtatagctgtttatgggatcgtagtattctcttgtctcgttgcctgttntattgggagggctagtatgccaattctttcggacgttgtgttgattgtctcctcttaagtacaaacagcgcttattgagtgtcgcctgccagcnggagcnaatcacttccagcgngaaagggaggaggaaacaccngcntaccaagggcctgggaaccctgagtagtngagcccaaagagagaagcacccagaaagcngaagacaaaggactgggggacaaaagaaaaccgtnaaggacgccacaaccagcaaaaccacaaggaagaaacagagaacaaaggggaagacccccaacacggcnacnaccaaacagccttcgaccgggatgaagaaacagccaaggcctccaagcagcatcgtcctaaacgccaccacagccagacccatggcaaagggtccaagtgcgaccttaatgggaggccccgggaggccgaggttcggttcctctgttacgagggtgcaggtatctctggggactacatcgatcgcgtggantntcccttntcctgctcttangtnctgaccattcgcactcctcggctcngnccccaccctctcctccggcccccacccagtgctgcaccgcagnccancctctgttanccttcccnanagcctgaggagtacatggcctacgttcagaggcaagccgtagactcaaagcagtatggagataaaancatagaggagctgcaagatctaggcccccaagtgtggagt

SEQ ID NO: 700070 - DNA, 278 bp, Homo sapiens
gcggcgctgagggctttgtgcggcttcccgggcgtcgcggcccaaggtgcttgcggccttgggcttggagtccgatttccggattccaagccaagcaaggtgttcggccaattgccagccagaattgtggaatgggccacagacagtttggggggagcctgtttatgtacccaaggcaaggaaacacccccactggaaggcctcccaccttgggaatgatgtggcccctccaaaggcacaaaattgttgaggaccaatcccctgacttttgggcccag

SEQ ID NO: 700071 - DNA, 2669 bp, Homo sapiens
gctcctccaacctcccaccctaaaacatgcaacctttccttacccctatctgtagttaaccccgctgttagggatatttccacaccctcagttgcaaaacaccacacccctgtccacattacccttaaagaccccacactattgaagccaatctgctcctcccaggcaccacctcccaaaaagctgaactcatcaccctcactcgagctctcactctagcagccggacaacagttctctaatttaggaggatttaaaaccctggtagggacagtaatcttcatcactttttctcccctgtgttatcccactaataataaaagccactaaaactcttattgaaactacagttagccaccagacaattcagactatgctcctgctacaacgacacgatggataccaacacatctctcaagaataccctaaaaattaagtttttctttttccaaggagcccacaccacccctaagtcacgcctgaagtagttattgagaaagtcaccccttttccctttttactataaccaaatagacaggaatgaaagattctccccggggtctgaaagcttgaagagatgagtaactcctcccttctcaggcccagtcccaaggtgcaaggccagttgcgccagcagtgtgcatcagcaagacagcagaagcaggaagacagccggccagaagacacctaccctggctggaagacacgtaccccttgaagacagagagaggggccgtctgggtactgtgcagaagttacatcagactgagacacttcttgtttacaggaaactataaaacccctgcctcgtcctcacttggtgctgacgccattttaggcctcagcccacctgcacccaggcgctcgttaaaacagcacgttgccccacaccgcctcatgttgtctgttggcaggctctcggggttcgaaccaatacaagaacctttcataaactttaccttaaacattacagtctaaaggccataccattcctcaggcccaaagctgaatcttcccagcattgtttctccctcctcacttctcattgcatctaatcagtctagagactgtcccattccctagtcctctgtcctacagattctatctctccgaagtctccctacctgtccccacctcatcactctctcaggcccaaaataaggcctcatccctttgaccctggatcagcctcccggtttcctatccggcctcgccgcccccactgtctttttcccttggagtttgcttcccaccacactcccagaactttgccattgcagcagttgccttcgggtttgtcaacagaatcacctgggggaacttggtaaaaacatcccagactacttaatctgaacgttttacaaaactccccaggcgattatgaggcatagccaggtttgcaaactgctactctaaatccttgctacacatagggaaatgatcagcaagctcctgggaatctgttagaaacacagaatgtcaagtcccacccctgacctatggaatcataatttgcatttgaacaagatccccacaggattctcaactttgagaagctctgctctacagtgttgtcagaccatgcactccacaaatatttactggattttctctgtatcaggctaggaattgggagggtcaaggaccaaggtctttgactttgagaagttcacagaaccatcagtcagtcccctgctgtgccttcagaccaagtccagacttctgtactggacagctgggactattttccagccttgtcaccagctttcctgactagcacttgacataagagccaagctggaccactggccacttctcatggtgagtccatgcctgcctgcccacacagttgtcacagcccaggccacactctacccttctctgcctcaaaaaccccaggagggatcctttgaggtccatcacatcaccctttcttaaaattatcccagatttccctgctcagatgaaagacaggaattcccataactttgttcctaccgccttcatgtcattgatctcattccacttactcttttaaagtcaaagcgcatctcccttagctacccagtaaagaaggcatcatggtaagcagcttatctctccagtagcaataagctaacaactgtcacatcaccaaatcttaaaatagtattactaataattgaaatatgttaaataaaacatggataaatgcaatcagtgaaaacctcatcaatcatccccatctcccacttcaaatttatttagctatgaatttaagcaaagtacaaatgggttgcctctcttaagccaaagagaaataatttctaaattagataacacttacagctttccatacacctataataatgaaagactgaatatgctgaagatgaattatgtcgaaaaccaactacttttctgtagttgaccatttaacttcacataatacactacaaatttgaaaacacttcagatttgtattacaatcaattaaggaggggttgagaaaggagagagacgaagagaaagacaggaagtagaccaaaatatagaaaagggacacggatctataccaaatatctggctgctctaaaagtaaaaatataattagattcgttttttaagaagattaaacactggcaagaatgcctgtcttaatcctatccaaacgctggaagttctgttctc

SEQ ID NO: 700072 - DNA, 276 bp, Homo sapiens
agcggagggggagccgggccgccgtcgctgccaccgctgtccccgcgccctgcgcccggtggccgccactccgagacggaactgacggcggggctgcataggtgaatggacgcgcagcgtcggggcgaggctttgagagcgagccgtgagaacagaggcagcgagtgcgcggcggcctgtctgtcttcggctcgctcgaatgacgacatgagcgctgaaagaacgatcatgaccgtcgactactgatatcgctggctcgtagggctcagtctggtg

SEQ ID NO: 700073 - DNA, 535 bp, Homo sapiens
gatctggactgctctgaaaagccatcctttgacattgttcctcatccgacctccttgacccgccgacagatcgacctccgacgagcgcctcctccgccgccgcggactccggcagctttatcgccagagatccctgaactctcgacttatctttattaatcccctgcatcggatcaccggcgatgccccaccatgtcagacgcagaccgtagacaccagactccgaaatcaccaccaaggacttaaaggagaagaaggaagttgtggcaagaggcagaaaatggaagagacgcccctgctaacgggcaatgctcaatggaggaaacagggagaagcaggcaggctcgaccaatgcagagtcagacgaaagcaagcaggcaaacgcacgggtgcgcggaggcaagcaaggcagcgaggcacagaagcacaggccgcacgcgctgagcccacgagcgaaagggacgcatcgaagcatgcaggacgactagactcagcatccgaggcaagcggcgcagccgcaagcataagagatacg

SEQ ID NO: 700074 - DNA, 506 bp, Homo sapiens
  misc_feature (125)..(125): n is a, c, g, or t
cgaccggcagagcgcccaagttggatacactctggaaagctaactaagtgactgtctatggccccaattctatgaaatgctcaggacaggcaatctacagagaaggaagattagtggtagccagnggttgggggagatggaagttggggctgacagctaaagggtaccaggtgtctttttggggtataaaaaatgttctggccaggggttgtggcttatgcctgtaattccagcactttgggaggccaaggcaggaggattgcttaagcccaggagttcgagaccagcctgggcaacatggcaaaagcttgtctctacaaaaactacaaataaagtagccgtgctcattaggtggctcatgcctgtaatcccagcatcctgggaggcccaggtgggtatactgcttgagttcaggagttcaagacctgcctgggcaatgtggcaagaccccatctctactaaaaatacaaaaaacaaaacaaaacaaaacaacaacaacaacaagg

SEQ ID NO: 700075 - DNA, 207 bp, Homo sapiens
  misc_feature (98)..(98): n is a, c, g, or t
aactataattgtgtgtggggtgtgggataactagctaataagtgtgtgtgtgtatgtgtggcatgtggggtgacttttataaatgtgtggggtgactnaccatgtgtgtgtgtggtgtgtggggtaacaaagggtgtgcatgtgtgtgtggtgtgtgggtggctaaaaattgtgtgagtggtgtgtggggtgacggtgtacgcgtgt

SEQ ID NO: 700076 - DNA, 393 bp, Homo sapiens
  misc_feature (24)..(24): n is a, c, g, or t
  misc_feature (37)..(37): n is a, c, g, or t
  misc_feature (65)..(65): n is a, c, g, or t
  misc_feature (204)..(204): n is a, c, g, or t
  misc_feature (215)..(215): n is a, c, g, or t
  misc_feature (312)..(312): n is a, c, g, or t
  misc_feature (320)..(320): n is a, c, g, or t
  misc_feature (340)..(340): n is a, c, g, or t
  misc_feature (378)..(378): n is a, c, g, or t
gcacccggaaccaagagctggaancgagagccgcatngccagcacaccatccaggccctgcagancgagctggacagcctgcgcgctgacaacatcaaactctttgagaagatcaagttcctgcagagttaccctggcagaggtatcggcagtgacgacacggagctgcgatactcctcccaatacgaggaacgcctggacccntttctcctccnttcagcaagagggagcggcagaggaagtacctgggcctgagcccttgggacaaggccacacttggcattgggcgtctgattctcttccaacaagatnggccccgnaccatcagcttcttttacancttgttcctgcactgccttggtctttctggtgctgtanaagctggcatggagt

SEQ ID NO: 700077 - DNA, 755 bp, Homo sapiens
gggagagccatgcacgaggaatgaaaggaagcgccggctagaagtttcagtgagcgggagctggcagaggttgcagatgaatacattgttttccctagaagagaataagaagtccagagggacgcctgtcagcctttaagcaagttcccccggccatcacccacttgtgctgcaggagtgtgtcagtgatgatgagacatctgaacagcatgacccctgaggaagaggctgagggagacatgaggcctgggccataagtcctctgagccaactgtggcaagaaccgatctcgcaaacatttgaggctgagaaggaattcacatgagtaccatggtccaacaggcccctcactgcgctgtctgtatgatcttccagacttatcatcaggttgaatttggaggctttaatcagaaactgtggaaagtgcttcagatttaggcccccagaagcagaggaccaagccattgattccagaaagtgtgcgttcacttcgactggctgcaggagcggacatcaagctttcatactccttatcgttgagcgaggatggcaccaagacatacttcgtttctctgcaagaatgtgcagcagtccgggtccatgccagtcgctatggggtccccctgcgaaggattctgaagactggaatgtgttctcggtgttcagcacaatgcctagaggaggactgctgttaatgctcattacgaggaggggccctgcaacagcaatgatgactggtgggtcacgttcaagtg

SEQ ID NO: 700078 - DNA, 110 bp, Homo sapiens
agtcgaggcgtaccctcagaaagttgtttgtgatgtgtgcctctactgacagagttgaacctttccttgcaaagagcatgctttgacacactctttttgtagaatctgca

SEQ ID NO: 700079 - DNA, 147 bp, Homo sapiens
gggggggccaggtgtggtagctcacactttttttcccagctacttgggaagccaaagcaggaaggtggcttgtgtccacgagtttgaggatgcaccgccacatgattaggccactgtactctgttctgggtgacagagcaagaccct

SEQ ID NO: 700080 - DNA, 255 bp, Homo sapiens
cctgaggcaatgcctgtgcttgcagtggggacatcctggctccatccgaaaggctgagtgtgtcccacggctgaggtggccacaaacaattgctgcctgtccaggccatgctggggacggcggccccactccaacacacaaagggtgctgtgtagagcgctggcttgtccaccccggccagtggacacactcatcacagcccaacccggagccggggcagctgccaggtctcctcaaacagccttcctccccaca

SEQ ID NO: 700081 - DNA, 143 bp, Homo sapiens
cacagcataactcccttaggtctgatcctaggttaaataagaaaaaaaacaaacacctactcagcacggcaatcacttactatcgagaaaacagccaagacatgtgagagataaagtcagaggggagaggaacagcgtagtaa

SEQ ID NO: 700082 - DNA, 320 bp, Homo sapiens
  misc_feature (14)..(14): n is a, c, g, or t
  misc_feature (137)..(137): n is a, c, g, or t
aaaaggggttgggnccccccccccccagggttgggggaagaccccctccagggcaggggggccccctccgccctgtggttccccccctttttgttttttaaaggcatgtcccttttttgttcctccctaactccctncccctaaaaaccctggggcctgggggcggttttgcccccctttcccttttttgggtcgctccccggcccttggcccttgggggggcccgggtgtgtgtgtccttggggcctgggggggtgttgttcctccgctccctccctcggccctgcccttttgggccctttaaattgccctttttttta

SEQ ID NO: 700083 - DNA, 1022 bp, Homo sapiens
gcatctagcctgatctttatatattactgtgtacaacgatttttttacacaaagaaacttcatgctgtcttaataaattcagtgtgtagcttcaatgggatagttccaaaagtgaagatactgtgaggaataagtgcaaattatatatattcgcaaaaattcttagcaactcttaagtcttgtgtctgcaatgcaaattgtactccttgacagttgatagattatatattctatccatccctcaaacttgcattccaaatatatttattatttcaggccaacagatgagctgtatatgtcttgaaatctgagacactatgtacaataggatgtatctgtacaaataattcccacgtgacgtggaagatccttcgttggatgtcacaacacctacactttaaggatggtacggatgccttggaggtccatggtttacaatttaacaacataatacagattctgaaatgtcaataggagatctcaactgaaagagttcacccaaatgagtgacatgacctcccatcccctgatggagaagttgtacagttggagaacagacccaaggagtgctgaaagaatccagatgggaccagagtatctgacctgctttaccatcatgaagtcgtagggatagcgaagcagaatgtccataatacatagtcaatatagcaatctactctgacaaaactggaccaacagagcgtagcgaatcaataccgtattatcccacacgaagataaccaagttcagagctagaatccacgaacgagaccaaatacaatagggatggaacaagcatcacagctagcacaaaaggaaccaaataccatcgatacatcaaagagaggaggagaaaaacatcaaccgaggagaaacgaacacgaacgagagaacgacgagcgcctgatcacacaaacacataaacggacaggcaaacggaacaaaagagagaaaacaggacatagcaaagaacaaagacagagaaaacgaaaccagcgcgacatgtacagctcttctaatac

SEQ ID NO: 700084 - DNA, 888 bp, Homo sapiens
  misc_feature (2)..(2): n is a, c, g, or t
  misc_feature (290)..(290): n is a, c, g, or t
  misc_feature (294)..(294): n is a, c, g, or t
  misc_feature (298)..(298): n is a, c, g, or t
  misc_feature (312)..(312): n is a, c, g, or t
  misc_feature (319)..(319): n is a, c, g, or t
  misc_feature (327)..(327): n is a, c, g, or t
  misc_feature (334)..(334): n is a, c, g, or t
  misc_feature (418)..(418): n is a, c, g, or t
  misc_feature (494)..(495): n is a, c, g, or t
  misc_feature (504)..(504): n is a, c, g, or t
  misc_feature (534)..(534): n is a, c, g, or t
  misc_feature (552)..(552): n is a, c, g, or t
  misc_feature (570)..(570): n is a, c, g, or t
  misc_feature (608)..(608): n is a, c, g, or t
tncagctccctttgaaggcggatccatacaaacaggctgaccatcagggctggtcccaggccaccaggctgggtgcaatgcagaaatggagatctgccccggggaaggcaggtttctgcccaaacggagccacgtgaggacgtctttggggatgtgtctccaagaaaagtgtgggctgccttcctcaccctggatgcctgtgggctgccttcctcaccctggatgcctgtgggctgccttcctcaccctggatgcctgtgggcagcttcctcaccctggatgctgtgggntgcnttcntcaccctggatgcntgtgggntgccttcntcacccnggatgcctgtgggcagccttcctcaccctggatgcctgtgggctgccttcctcaccctggatgcctgtgggcagccttcctcancctggatgcctgtgggctgccttcctcaccctggatgcctgtgggcagcttcctcaccctggatgcctgtgggcanncttcctcancctggatgcctgtgacttggtttccatggnggcttcctaagctcaggnaccccaagcctccatcanatctaatgacccgacctgtctctgaacacacctgtgtngtccccgagcccctcacaagcccactctggaacccggccacgcatttcccatcctgaaaggtccagctcataggccggccatgtgttcccttaccctggttggtccctaactggtggggagctgtcccttcttggccctagtgtggcacttcacacgacaaatgtgtcctgtggggtggtaatctgggctcaccctgaatgaaggggatgaccaagtgcaaagtcactgggcggaatgggtccggggcaaaaaaagaaaatggccgcaaagagagtgaag

SEQ ID NO: 700085 - DNA, 1201 bp, Homo sapiens
ttttttttaggttggagcgataaaaatatgcagcatgcaatatatgcttatatttcattttaatttctgatatataagtgaactttttggggagaggtactgaattcttggatgttttttggtcatgtggttctcaagtgtgcaatataacaagtgttaaccaaactttagaataatttcaaagtgtgtcattaattatagataagccttatattattaaacaaattatttggctattatattttgtgtggttagcgaggaagagagtgtgattaaggtggagggttaaattaccccctattaaagtggctcccattcgtgcattgggtattttcgagggtgggaaaagtgaatttatctcttttaccaagtgttgtgtgcaaaaccacttgtgtgaaatatcctataagagggataacttgtggaaggcgtggtgttaggtattattcaacatttaatttttgggtgtaacactttatattacactatatagaaaagagtgaaccaattattcttttgggtggtgtgcaaccccaacatattgggggggtggcaggcaaccaggaaaaatgtgcaaatctggtgtctacaaaatatttgggggaattttggggtaacaacttggatttctggagtgttagtgagaaaacactggggtcaccaggggtgtctggcgttggaattctacaaacctatggtgacacttggtgcgaactggtgccaaataaaaactattaaagctttttggggtaaaaaaaaaaaaaccaacaggggggggcggggcacgtcctccagagaaagtatatccccctgcgaagaggggggcccccaacgtcttaaaggcgcgtaaaccccaaagacttctacttgggtgcaccaaacgggggggcgcccgctatacaagggaggaggtgcgcaaaatatcaaacaaacgccaaaggacctgcgggcccggtctctgtttttacacccaacccgctccgtcggcaccgcggcgacaacacccgccgctaaggcgtgggacaccttgggcgccgacgggaccctctacctcccgtggggggtgtagaacaaacgtgggcgcacaacaaacttccctcacagagaaacttaacagcccccacagcggaccacactataacacagtttaacgccgtcatactcagctgctgtctcacacacgccgcccacataatctcgg

SEQ ID NO: 700086 - DNA, 855 bp, Homo sapiens
  misc_feature (2)..(2): n is a, c, g, or t
  misc_feature (181)..(181): n is a, c, g, or t
  misc_feature (190)..(190): n is a, c, g, or t
  misc_feature (195)..(195): n is a, c, g, or t
  misc_feature (209)..(209): n is a, c, g, or t
  misc_feature (213)..(214): n is a, c, g, or t
  misc_feature (226)..(228): n is a, c, g, or t
  misc_feature (230)..(230): n is a, c, g, or t
  misc_feature (235)..(236): n is a, c, g, or t
  misc_feature (244)..(245): n is a, c, g, or t
  misc_feature (269)..(269): n is a, c, g, or t
tncagctccctttgaaggcggatccatacaaacaggctgaccatcagggctggtcccaggccaccaggctgggtgcaatgcagaaatggagatctgccccggggaaggcaggtgagtgtaggaaggagggagggctgcgagaagctgggggcagcctccatccccctgtggcctgggtggngctgtgcgncccangcgcccgacgcagnttcnncacactgggagnnncngttcnntccctccnngtgcccttcctctgcgtggtgtgngctcctccttgagggagagagctgaggaggtggcattacttgcttcccatgactcacccaaaggaagatttcacaagccccattggcaaatgggcttgccaggacaaaggctcaaccatgatacaccacccatagtcccacggggaccaagacatagaaacgggatatacactttgagacttggggtagacgggaagttaatagccataggggaaaagatcaaaacacaagagcaccacccatgggaggagattggagaacagacctggcatcacaaaatggagttccacacaggggaggaattagcgaaccggacgggacgacataaccacaggttataagctacaacatacgggaattgaggaaacttcccaagcgtgaagaggaaagaaaccagggaacgaaaacgagagcgacacacgtttgatagcgattacacccacggttccggctgccgaacaagttgggccgcgacgagaggcgggagaccagaagcaaaagtatcggacgtcggctcgaccaagaagcgcatgcacagaccacgccaccagccggccagagacatggaaaagggcagaaatccgaa

SEQ ID NO: 700087 - DNA, 1466 bp, Homo sapiens
ggctgagtgtttcatataagatgtgtgccttttgtcctggacctgaactatctggctgattgagaacgttctgtgacctggtgacttggtggacggaatgcactgcacacggacaacgtctactcactgagggcctgaactggctagcaattgtagtctcataggagcgttttctgggagtagacaagtcggaatctcgctctacatctgggtaggaattcatacattagccttggaagtataggctggtgtggacgtgccgatcaatcttccggcactacaagtagaagccattggcattctaggcacaactacacgaatggctgatgcaagagatgtgaccgcaaagttgagctcgtgggtgcatgaggatgcccgcatctgtcccgggaggaagcatgtggcagattgcagcagctgcatggaggtttcacttgtggagggctgtgtttagggaggagactggacgatcagtcacttacgatttggagtgggttggatagaccaggttctgagctggcggtatcttgacagacatggtgggggaaaggaaacgaactaacaattcctaattcgttccaggcacgaggagtaggtggttaatacctgtcgatggttacttgcgtgacaccagcgaccgattgcgaattccactggttgtggggaacggcgccattggtgtgccctcgcaatccatatggaatgtgaaccgcgtccttgctttggaagttcgccaacgaggggaacgcttttgatccccttgcgtttgggacccggaagcggtgcttaagaactagattcatatccggttagttagggcctgcttgctgtgccccatggggtccggcgcaccttcgagtagcaacagcagttctaacgcgaaacggggccccattggacatcatttgttggcaagccatcgagacacagtcacaaatcagacggaacttgatgtcaaggtagcgcgtgcggcaaaggggcgttaggaggaaattccaccgaacctcgagttttgggattgccattggtgtgccaagttggaagtctatctcacctaggaaacgattcgcttcgtggtaagggcggccacttttgggaggttggtgacgacaaaggacccccccgttgaagcagttccaggtcacacaacacacccgagctgcggcgttgaacatcgaagcgtctctctcggggaccgagtgccaagggatggtcccccacatccggagtgtcacacacagcggcggggggggacccagtgatgctctagtggcggggaaaccaggcgcgagccgtgccgacgcgaaatatcacgcatccgccaggacaacagcgggggcaacacacgatacaccacgcgaccccacagggaactgcaacatggcgctgcacaagcacgaagtcgcgcatacggccaaaagcacctcgatgggaaaccacagtgcaccatgatcaaaacagggccg

SEQ ID NO: 700088 - DNA, 1412 bp, Homo sapiens
gggcgaaacggcagcttggtttcagctggattgtactgtcctatgtgcatggctcgagtgcctccgtgctgatctgcttcatccccagctgagctgctgcctggtgaacgaggaagccatggtctgctccgagattaacatggaagcatcgaaaaattaatgctgatcagtacaggcgaagattcaatggatggtagtgcgcgaatgcgcgttccatagggcgccctgctggaagcctctgaagcctcggtagtgaagtgcccataatacagcatctttggggcgacagtctgggtgaatcataacggtccagtcgaactacatcgtgcaaggtctccaaaactggctctcattggacagaaacggcatagggcacaaaacctctcaggcgtcactgaactcatagtcattagacttagaaatactaccaatagatcgtcttgcaaagagagagtaccctatgcctgtgtgaccgatggtgcgcacttggtaccttgagtcgcatgtgtgcccagtaagcccagtagaacctaagagctcgatgataccctgggacgtcctttgtgttgacaatgcacacgcaataagacagcttttacagctttggtagacctatttgtacggtgtgtgataactaggggcttctccgagagtcgccaaaatgggaaaaaaccatcttgtgagtgtcgtcgcccttggcacggcatacgcaatagaacccctgctgtccaagggctctctctcctgcactgttagattgcgtttgccaaatccatacattgcagtgttgcgaattgcgaacgcaaaggcaattgcgaagccatgcattcgcaaagagggccttctcaggttcgagttgcaagtaatgcttgaaaaggcattataagactaggcttttcagtgctggcagcaaacgatatgctttttgaaccggcagaggaattgccccaacagaggcatggttcttaggcaaccaaagaacactttactgctacacatggaacagattccgacggcaaagagtcgtaggccttgagaaaccacctattcgtaacgaaagttccaactcaacttagactcagaaatcgtggagcgtaagtatacaggcggaatatcaaacagctcgcaatatggtccaaggcgatttgtgtatacgtaccagatagaacccagtgttaccaattttgaacgtttgacactcccccccttaaatgttgaaattcacggcattctacattgctgtaaaaataataaagtcagctatggatgcccacaagacatatgaaattgtctgtgtgcagacataggaaatatggcgcttagatacaggagtgcaccaaaagtgatatataactatgtggcaatagggctatcataatttgtacacgaacattctggtgatcacgcgttca

SEQ ID NO: 700089 - DNA, 462 bp, Homo sapiens
agatgggattgggattgttcataaataaaacataacgacatggcggtcttcttcatggaataatatctatatttttattaaataaagattaccagaaatagcactggacttccattctcagttcatgctgcactctagttcacccaagacaacctcacattgattgagcatcagtattgtatgccaggttactatgtgacatggtacacaaacacaatgtgagatgtgtttgtgagatggacaaacaaaaatgtgagacactaaaatgtgagatggacacaaacacaattcagaagtattgttgccattagaccacaggctctttgagggcaggggatttgttcttatttgccattgttttcccagaacccattcctgcctggcacatagtacgtgctcagtacataaggtacaactgatgaaatgaccagctcaagcagttcgtggtctcctgctagctga

SEQ ID NO: 700090 - DNA, 184 bp, Homo sapiens
ttttaaaaggggggcctgggggggttttccccctggggggggcccccccttgggggttggggccccccgggggggccggttttcccggttttttcccggggggccttaaggggtgtttgggttccccttttttttttttgccccccccccccccccctttgggggctggttgggcccctgggga

SEQ ID NO: 700091 - DNA, 148 bp, Homo sapiens
cgcgccgaagccagccgtcatcggttcccagacagctgaagttgatctcttagaagatgatggaagttccaatatttcaatatttaatgaacactagtacgaacatagaacaggctgttctaggacaatgttggatcagaacacatga

SEQ ID NO: 700092 - DNA, 346 bp, Homo sapiens
aagatattaaatattaatgtgtgtatttacttggattttacaagttctcatctatgaagattgaccaaattttaaaaaggctttctatttaaacaatcgataaatggtacagtaagataggcggtaccatgtacatgtgaatatcttgcattaattacaacatcaattctatatttcacaagtgacctaaatgtgcattgatatgcattaaaatatggacttaagagagctattcactcatggatttttgtctcatgcaaaactacatctaaatcatgggtctgatgcatgtgaaaaatggaaataatcacctaaaacctatctatttaagggaaacttgtgtgga

SEQ ID NO: 700093 - DNA, 116 bp, Homo sapiens
  misc_feature (8)..(8): n is a, c, g, or t
  misc_feature (10)..(10): n is a, c, g, or t
  misc_feature (83)..(83): n is a, c, g, or t
gcagtgcntnagaaattccttgtgtaaagcttgcaaaaaagacctaaagggaattgtaatttggttataattcaggatttggnaattctaataaaggattcaaacataaaaaaaaa

SEQ ID NO: 700094 - DNA, 117 bp, Homo sapiens
atgtaccttttgtgattgtgtattctgatacttccaatacatggtatgaggcgcaatcccaaatcacagaaaacctgcagctcagctatacctacaactgccctcacaaggacgggc

SEQ ID NO: 700095 - DNA, 438 bp, Homo sapiens
aatcttgatcataggtctgtcctgtgtagaaaaggatgtggtagattcactaagacaatccagggagaatgctgatgatcatcatgaagaagacatggatatgagtgactgaatatagcctctgagggagtccacactcgtaaaccatgcactcagtcgtcatatccttctgtagtgattatctataatgctgtatttgttcatctcaaacctagatgtaatacagctctgacttatatatggttataaagctccagatactcatattagttattcacatcaaagaagctttcagaaaatggtacgaggtaaccaattcttgtcatggtgaaatctgattgagtaaccaagcagtattactattctggtgctgcttcatcacaaacatgaagagctgcatgcatctacagcaggcatggattgtttatgtcgtatgat

SEQ ID NO: 700096 - DNA, 799 bp, Homo sapiens
gtactttgcttatctctaaccttcctcttccccataatttaacaggtgcgcaccaccatgccctgttaattttgtatttttagtagagtcggggtttcaccatgtggccaggatggtctcgatctcctgacctcgtgatccacccactttgggaggctgaggcaggcggatcagctgaggtcaggagttcaagaccaccctggtcaacatggtgaaaccccatctctactaaaaatacaaaaattatccagacatggtggcacatgcctctactcccagctacttgggaggctgaggcaggagaatcgcttgcaactctgccttcagggctcaagcgaacctcccacctcagcctcctgagtagctgggagtacaggcatgagtcaccacacccagctaattttcgtattcttcttcagagatggggtctcactatgttgctcaggctggtctcaaatcctgggctcaaacagtccagctgccttgacctcccaaagtgctaggattacacggcatccaccatggcaacccagacaacatatatacccttatttattaattgaattgagtgcagttatatatagactaatctgagacagagttcaccgtgtacccaggctgacgacagtggcgtgattctccagttcatgtgacctcggtctcatgagttcaagcgattctcggccaagcgcggaatactgggataccggcccgtcacacctcggctacttccgatcacaaagacagggtatctacgtggcagctgttaagggacacggtcaccgaagctcaatgcgct

SEQ ID NO: 700097 - DNA, 1091 bp, Homo sapiens
  misc_feature (347)..(347): n is a, c, g, or t
gtcgctcctagcgtctctgctctccctagcgcagcgccgccgtccggcccctccagcttcccggaccatggccaagcctggatgcgcaccgattcgatcgccaatcaaagcctggactggcagtgcatgctgcggtcctggatggagcgatgattcatcaaggcgcttcgatgcaggaacgggattccgcctcgttggcctagtgatagttcctccgtggccatcttgatatgagacacctttgaatccagcactacattgaccatgaacggaccggacccatatcttacctcctgtgagacatggttgacaggtacaagttgacacttctagtgggccggttgtgncatggtctgggaggggctgaacgtggtgaagacaggccgagtgatgcttggggagaccaatccagcagattcaaagtccagggcaccattcgtggggacgtatcatgcattcaggttggcaggaagcatcattcatggcatgtgcattcagtaaaaagtgctgacgccgaaatcagtctatggtttaagcctgaagaactggttgactacaagtcttgtgctcatgactagggtctatgaataagaggtggacacaacagcagtctccttcagcataggcgtggtgtagtcactggacacagctcttcattccattgacttagaggcaacaggattgatcattcttttcatacgacgcattaattggcacaactaacagcgtattggacagccgggaacaagacttaacacaaggggcgagccccttcaaaagatatcactatgagaggacaccccaacattatagggtaccacagagtctcgtgttaccagatgtgccataatagtacgccctattctaaagcgccacgaccatggccccggcgttaccacccagtttcggacttggtaacacagcgcatgcatgggaaaaactttgagtcaggaaccctaatctcttcggggcgcactatatgtgcacaaacgactccaaggaacatcaagcactataagaacacatacccttagacgcaggttatacgggttacacactcaccaccaacatctcgatcataacatcggact

SEQ ID NO: 700098 - DNA, 811 bp, Homo sapiens
  misc_feature (67)..(67): n is a, c, g, or t
gtgctgggtcttgtctggtgtggtctttgctgggctggtgaagtacatgaactcaggccggttgtgncatggtctgggaggggctgaacgtggtgaagacaggccgagtgatgcttggggagaccaatccagcagattcaaagtccagggcaccattcgtggggacgtatcatgcattcaggttggcaggaagcatcattcatggcatgtgcattcagtaaaaagtgctgacgccgaaatcagtctatggtttaagcctgaagaactggttgactacaagtcttgtgctcatgactagggtctatgaataagaggtggacacaacagcagtctccttcagcataggcgtggtgtagtcactggacacagctcttcattccattgacttagaggcaacaggattgatcattcttttcatacgacgcattaattggcacaactaacagcgtattggacagccgggaacaagacttaacacaaggggcgagccccttcaaaagatatcactatgagaggacaccccaacattatagggtaccacagagtctcgtgttaccagatgtgccataatagtacgccctattctaaagcgccacgaccatggccccggcgttaccacccagtttcggacttggtaacacagcgcatgcatgggaaaaactttgagtcaggaaccctaatctcttcggggcgcactatatgtgcacaaacgactccaaggaacatcaagcactataagaacacatacccttagacgcaggttatacgggttacacactcaccaccaacatctcgatcataacatcggact

SEQ ID NO: 700099 - DNA, 226 bp, Homo sapiens
gcttagttattatctaaagatctggaataaacagaaaggagtatctgggttcaatataaggggttgtggagcccaaggttcttactatgcagataaacctccaggtagcaggcttcagggagaatagatggtaaactgatttttaatcagaacttaaaaagtgtgtccacgactctcttcgcgacgagataatttctagtgccctattatcaaggagtacctgagc

SEQ ID NO: 700100 - DNA, 571 bp, Homo sapiens
atcaatagtagccaatcaaatttgtatttaaatgagccttagttccgaaaatgttataattctgttggcacctcgattgtgcctatataaacaatcctcatttttccccaccctgggagcgctaatcaccattctttggtgtagctcgcttacactctgtacttaaatgaattcttttaactgaatcaggagccttttgattattttaggtgacagcatctcaattacttcaaatatttccctaggaataagacaagcatctatcattacaaaaataaattcgattaaaaaaattaggccagacgtgatgctcacgcctgtaattccagcactttgggaggccgaggtaggcagaccacttgaggtcaggagttcaagaccagcctggccaacatggtgaaacccgatctctactaaaattactgattcagccaggcatggtggcgcttgaggtcaggagttcaagatcaggctgaccaacatggtgaatcctgtctctactaaaaatacgaaaaattagccggacgtggtaccgggcgcctgtaaaccaggtactcgggaggctgaggaa

SEQ ID NO: 700101 - DNA, 252 bp, Homo sapiens
tggtagtatacctggtccttatctgctgtatctcaagccactctcctcccgttactctctatattagcttctctactctggaaaactttctactgcccccaggccttcagaaacacccttttctgtatagatagataggcattttctcgcacgggcacggtggctcaagactgtaatccaagcacttaggaaggccgagattgtgccactacactccagcctgggtgacgaaagtgaaagaaactccgtctc

SEQ ID NO: 700102 - DNA, 329 bp, Homo sapiens
cacatagtctgtcccacaggactctgccggtgcctaagattccgtgaagcaggacaatgtcgaggtttgctcctgaacggtaataggtgaatgaagggaaaattctggggaggtctgaaccatagaggacatttaggatgactggttaactgcggatcgcaccatatcgggcccgtatttcacattgatagggtcctgttacatttctcgtgacactgggtagaatgagtatcctgtatacaagtgtcgtctgttttacccctgtgaattgacgggaaggctctgaccgtgtagccaccaaatgtaggtgatagtcccactcttatggt

SEQ ID NO: 700103 - DNA, 481 bp, Homo sapiens
  misc_feature (71)..(71): n is a, c, g, or t
ataacacacaggcaaggggcaagccccccactctttactaattcaactatatgcttaatcaactaataggngaagcacattgattccaaaactcccaccaatcagcctagcttccagggtcatcctattttctctatactcctgagtcttcaccggctccattctgttcatttatagaatcacattatccaaggctaatgagtcctcattgagcttagcacatcctgattcatttctaaactcaccagaatcattggttgggagactgggtgcagagacagagggctggggcacgggagaggggatcacccaggcgggggcaggggcgagccactaaggctaaaaaggcacctgggaatggagttcaggccgtttggtggggggcagaggtctatgagttttttaaaataactgggttaattcaggggaaggagttggtctttttcccgacccaaaaagagcgtaagaggtattatatgag

SEQ ID NO: 700104 - DNA, 218 bp, Homo sapiens
  misc_feature (28)..(29): n is a, c, g, or t
  misc_feature (36)..(37): n is a, c, g, or t
  misc_feature (40)..(41): n is a, c, g, or t
  misc_feature (44)..(44): n is a, c, g, or t
  misc_feature (52)..(52): n is a, c, g, or t
  misc_feature (59)..(59): n is a, c, g, or t
  misc_feature (64)..(64): n is a, c, g, or t
  misc_feature (82)..(82): n is a, c, g, or t
  misc_feature (87)..(87): n is a, c, g, or t
  misc_feature (93)..(93): n is a, c, g, or t
  misc_feature (100)..(100): n is a, c, g, or t
  misc_feature (104)..(104): n is a, c, g, or t
  misc_feature (116)..(116): n is a, c, g, or t
  misc_feature (146)..(146): n is a, c, g, or t
  misc_feature (171)..(171): n is a, c, g, or t
  misc_feature (173)..(173): n is a, c, g, or t
tatccagacttcagtatataatctgttnntgtgggnncgnntgntgaagggntgagaancgatncaaagtactagtagctgngcgancagctnctgatgntgcntctgagggcttngtcctgagcctccgctgctgcccttgcccnagctcagtcgccctccaggtgcagngntggttgtaagaatcgatggagccaggcttggtgatcttggtgagt

SEQ ID NO: 700105 - DNA, 653 bp, Homo sapiens
  misc_feature (44)..(44): n is a, c, g, or t
  misc_feature (76)..(76): n is a, c, g, or t
  misc_feature (93)..(93): n is a, c, g, or t
  misc_feature (169)..(169): n is a, c, g, or t
  misc_feature (237)..(238): n is a, c, g, or t
  misc_feature (246)..(246): n is a, c, g, or t
  misc_feature (256)..(256): n is a, c, g, or t
  misc_feature (262)..(262): n is a, c, g, or t
  misc_feature (264)..(265): n is a, c, g, or t
  misc_feature (275)..(275): n is a, c, g, or t
  misc_feature (289)..(289): n is a, c, g, or t
  misc_feature (292)..(292): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (336)..(337): n is a, c, g, or t
  misc_feature (361)..(361): n is a, c, g, or t
  misc_feature (421)..(421): n is a, c, g, or t
  misc_feature (444)..(444): n is a, c, g, or t
  misc_feature (551)..(551): n is a, c, g, or t
  misc_feature (554)..(554): n is a, c, g, or t
  misc_feature (571)..(571): n is a, c, g, or t
  misc_feature (581)..(581): n is a, c, g, or t
  misc_feature (651)..(651): n is a, c, g, or t
taattttctaaaacaactcagagggacccatatttacagtaggnagaatatttatgagaaagatcgggcatcaggnatatttatatatatgtntgtgtgtgtatacgtatgtgtgtgtatatatatgtgtgtgtgtgtgtgtgtatcccgagattatatgaactaaganacaagttgtgtatcttaacagcagtactagagcgcagagtttcagacttggatttataaatgctttcnncgtgtggngtttgggaanggggangnnatcatctgantttcaaaacctgangtntttctcaggnctgangtnaaaatcctacctgccacacccgggannggggagcttttccccttaattgtncatctgcgtcagagagtccagtatccctgagataggaaccactgtaattagaagattggnatgaacaggtttctcccaaaggnagattgtttgttgctgaattatgcctactgccctgatcatcagggataaactttgcatcttccaacctaatgcttgggagcaccaagacgtttcagtaatggttcancanaaacccagcattctccntccttcaagnaataaccttgtctcccactgaatttccttctccttcctttctcgggcttctgcactttgtctttcttcangc

SEQ ID NO: 700106 - DNA, 200 bp, Homo sapiens
cccccccccgggaaacccaggccctttttcaaggcctggaaaaacttctttcaaaaaagggggtcccttcagggaaatgggggccccctccaccctttttttttcccaaggaggcctttttaacggggttggcagttttttttcccttaaaacaggcaaaacttttttttcccctaatttgaaccttaagtttcaaggga

SEQ ID NO: 700107 - DNA, 387 bp, Homo sapiens
cagcgttccaccccatcccatgggttactctttggctgccattttcatcaaagactgatgtcacttggcatggtggtaggtttttttctggaggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttagacggagtctcattctgtcacccaggctgaagggcaggaaacaggactggccaccgtgccggattctttgaccgtggttttacctgtgggcaacggttatacccatgttccggga

SEQ ID NO: 700108 - DNA, 1207 bp, Homo sapiens
cgaccacgcgtccggcctgacgacctcggagcaccgccacatatatactgtgcgagacaggggtggcgcaatcttctggcatgcacttaatccctcctacgtatttcgatctctggggccgtggctccctggtcagtgtcccttcagtcatccccgagcagacccaagggtcttcccgctgagccgtctgcagcaccgcagccagatgggaacgtggtacatcgccgtgccatgggtccaggggcttcttacccccaggagccacatcagatgtgacctggagcgaaagcggacagggcgtgaccgccagaaacttcccacccagccaggatgcctccggggacctgtacagcaacgagcagccagctgaccctgccgggcacacagtgcctagaccggcaagtccgtgacatgcacaggtgaagcacatacacgaatcccagaccaggatgtgactgtagccctgaccagtaccctcaactaccaactaaacccatctccctacaagtccaggctaacaccatctccctcatgctgagcaccacccggactgtcactgcacacgaaccggccctcagaggacctgcgtcattaggatacagacagcgaaaactacaagtgacacaactgacacggcactgagagatgcctcaggaagtcacactaacacctggaacgacacctacaagtggggaagagacgacaggaacaagagaaacaacgctgcaccgttgcaacctcaggagaggctggctacaaggagcaagacaaaggaccatgccagcggctgagccgaagcacatgggacacaagggaacgacacaaacactagcaagagatgacatagaccagaaacaaagaccccgtaaacggacacacacttcaaacaccgggaaaaacacatacggcaccgaagaatcacccagtcagaccgcagacacgaagaagaacatggccacgacagacgtcaaaagcgacactgacaaaaaagatgacaagagaccagggaagatgaggacaaagatagagaacaacagaggcaccccgaaacaaccaatggagagcgaaaacccagaaacacaacaacaaaaaaagcgcacgacgaaagaagcaaaacagacacagcacgcacaacacgatcggaaccaccacaaacaaacaaacagaaccacccacaaagaccgaagaacacaagcaagcaagacac

SEQ ID NO: 700109 - DNA, 288 bp, Homo sapiens
tcctgcggagaggatgtggaggtaagtggagctggggcagcagaggcacgacagcaggactgcgctccagtgactcaagacacggatgaggagctgaggcgagctggcatggcaaacagtcttagctacgctgacaaggacgtccccaaggggaattcctcgccatgcggggcgagaaggtgctcaatgggcaacaaggagtgggtggtgcaggcggacctcccgctgaacgcaggcatccggcagagtcaacagactctctaccattcaaaccccattctccctgca

SEQ ID NO: 700110 - DNA, 139 bp, Homo sapiens
ctgcaaggctaatttccagtatctatgataggtcatatacgtatcatatgattgtagaacttgtgatattgcacaacttgaaaaaaacacactaggccaggttctatctgaaaaagcagacccaaagctcaaactgaga

SEQ ID NO: 700111 - DNA, 307 bp, Homo sapiens
cattgagccccttgatgcttccctaaatcttatatgctacaggtctgtattttgtaatgtcttttatatcgtctcatttatgctttcatctctgtcctttttcccctatatattatttagtgttagaaactgtacaatttattctatataattttcaacagtttattgcattctcatggtatagtataatatgttcctcttttctctgtattcttttgtaaattgtgtttctttgtaaatctaagagtggacaatcattatacaggttcttaatttttaacaaaatttgtgttaaaggctgttttgt

SEQ ID NO: 700112 - DNA, 405 bp, Homo sapiens
tttttttttttaatttgggttatttgggaataaaattaatttaatggcttaggatctatgacccctgccttgaaagggaaaatgggataggggagtagaagggaacctggcggtggatggggcaacagaaaagatgcgcaggcggggccctctcttcatatacacttgggagggcgccacctatgtgtgcccgaggcctgtgtgcacccgagaactctctctctcacacctgtgtggcctcccagagtgccaaggcatattgggatgcggtgtgtgtggacgccccaatcacggcgtctaagagattctctcacgagcccaactgtgtgtggccacccccccactttgtgggtggagggccccacgagctcgagacactctctcacaaaaaatatctccagagta

SEQ ID NO: 700113 - DNA, 190 bp, Homo sapiens
aactcactggacttggtctgacggggtctgacacgtctcctacgccactcagaactggctgtgagacaccctagcacggccactctcagggccactgtgcaggccttcctgagttcgatttgtagttgcatatttagctctgcacatttgaaataaaccacggttgccgcccccacacccaaacacaaac

SEQ ID NO: 700114 - DNA, 854 bp, Homo sapiens
ggcaatctactgagaactcataagacgaagctaaaatccctcttcggatccacgagtcaagcgccctgaacacatcctgcaaaaagcccagagaaaggatgtgctcatggattactacagaaaatatgcagctatcttactggtcacattgtcggcgggtgtctgcatgttcgtccgattccgctcctgatgtgcaggatggcccgagaatgcacgctacgaggaaaaccgcattcttctcccagaccgggtgacccaatacttcagtgctatgggcatgcatgcttgctcgtagagcatattccattctcacttgaaggtcctaatgaagaggatgtagtgtgccataatagatacgttacctcatgagtccaatagttgtgtagtctaaatcatataacagggtcacatgtcaatgtgggggtttgaaagtggatgaagcactatggcgtgccagtgcagtacttgaaattatcagaaatcttaaatgtttgtagcaagtgctgtcttgagtgagtgtgatttatcggctaaatggaaaatcaacgttgtcctagaagttgaatggctttgtcgagatgaaaactcgtccttttcctgtgaccataccactttttgtacatcgctctcaagggatatacgtgcatgctgttacatgccttccattcgttattctacagtacaatcagcagggcttagttcttttcacttcggaatgacatacccgcagttgtagctttgttccactgcaaataaaggccttttaaggtcctcgggaaaactggtaaaaaaactaaaaaacaaacacaacaaacaaaaaaatttgggcgcaaccccaaccaaaattaacaccg

SEQ ID NO: 700115 - DNA, 218 bp, Homo sapiens
tcattccctcagctggaaaaacacaaaaagttaccccgatgtttactgtctttttttttggcagcatatgaggcacggtggatgggcacatacaatatatataccattggaggcatcatctttggatggaaaatccagaagggatatgggtgtatgtgagaagtaccataaataagggtaggtcaatgaaggtgcaacttatacataatggctacagg

SEQ ID NO: 700116 - DNA, 967 bp, Homo sapiens
gctgagatcaataagaaatgttcaggagagaggaaagaacaaaaaatatatgctccacaactttatatttagagagagaacacttagtcttgcctgtcaaaaaagtccaacatttgcataggtagtaggggccactatattacattcagttgctatatggtccagcaagctgaacctgcctattacctggagcaaggaaatgatccctttgctctagcgaaagcttgagcccaatattgattttcttctttttccccctgtagagactgactgttggctaattttgtcaagcacagctgtggtgggaagagttagggccagtgtcttgaaaactcaactcaagtactgcacatgtgatctcttttgcacgagctcatacgactagcaaaacagctggaacaactacaggcgaaaaatacatagctgcttattcgcggcgcatacattggacaaagctaggagtgtgcatctgttgaaagtgcttcaagacttaatcattagccttattgaaatcactgtaacatgcccccatgcggttcctcattcttcccaggtgtgccaagggaatgaatcttggttcacctacaagttaaccattcactccttgcacaatcatgtcattgacacgtgccgtttaacgacaagaaactggtcactgactgggaatcctcttcagaaaccctgacgattaaaacaagactattgcggactaacttatacggaaagcctagaaactcccagctaacagtcggggacaccactgaacgtacttcacctgtaacatatagcatcggaacactacgttcaaatataagcagggtgaatcaagtcatttgaactataggtaagaaaatggctctagactcaccgagtcgctgagttacacaaaatcgacaactgtaagcatagaattagcgaaccgaacactcactgaacctgaacaatcgaacacaccacaaacacaacg

SEQ ID NO: 700117 - DNA, 336 bp, Homo sapiens
  misc_feature (136)..(136): n is a, c, g, or t
gggcccccccggggggtttgggaacaaaaaggggctcctctccccagggttttgtgtgtccccccaaaaggggagcccccggcttgggggggaaaaaggggtttccttttctttttttttttcgggggggggcccntaaataaccccccccccccgttgggctccccccaatttggaatccgggggggggggaaccccccccttttttttttttgggggtttaatttttttttttcccccggggggaggggggtcccccccccgggcccggggaaaaggtttttttttttttacttttttttaaaaaaaaaaaaaaaaaagggggggggttcttta

SEQ ID NO: 700118 - DNA, 252 bp, Homo sapiens
ggctatcacattatcgaggattaggggaagagtagcgtaggcaggggcccatgtgagcaaggtgctgggaactgcatggaagtggtgggagggagaatagcattgatttcgacagtaaagtaggggaaggccagaaaagaaacccagagggcgagaggcatgatcacagagggccttatgtccacactcaagcctttgtttggctttatccctgagaacagccagggaacagttgggaggatcatgtgatag

SEQ ID NO: 700119 - DNA, 298 bp, Homo sapiens
  misc_feature (3)..(3): n is a, c, g, or t
  misc_feature (73)..(73): n is a, c, g, or t
  misc_feature (141)..(141): n is a, c, g, or t
  misc_feature (150)..(150): n is a, c, g, or t
  misc_feature (204)..(204): n is a, c, g, or t
  misc_feature (218)..(218): n is a, c, g, or t
  misc_feature (227)..(227): n is a, c, g, or t
  misc_feature (229)..(229): n is a, c, g, or t
  misc_feature (256)..(256): n is a, c, g, or t
  misc_feature (264)..(264): n is a, c, g, or t
  misc_feature (272)..(272): n is a, c, g, or t
  misc_feature (297)..(297): n is a, c, g, or t
ganactaccctctctgctgagagctgaaggggtgacaggatgatctgcctgcagagaggagctaccctctctnctgagaactgaagagacgtttggatgacctgcctgcagagaggaactaccctctctgctgagagctgnacattcttngggacagcctgccaagcagagaggagctatcctctctgctgagaactgaacacntgttgggacacccnggctacagngnggagctagagttgggaggacatcacgncttatgtnctctggtnagtgaaggatttccaggagaggttnt

SEQ ID NO: 700120 - DNA, 269 bp, Homo sapiens
  misc_feature (239)..(239): n is a, c, g, or t
gtgattacagacccttcgtatatgtacaactgcacattctgtacatgtatccatttttggacgaataaaaaagtgaataataaatttaaaaaagaaggtctagggcacctcctggatgcgtcctcccaaggctcctaggcctgagcctctgccaggagtgggccatggggtcaagagtggggacctggagcagccctgcctaggacttgactccgtgctctgccttatggtagctgtgntacgcttgggcgagttccttaatcactctg

SEQ ID NO: 700121 - DNA, 158 bp, Homo sapiens
  misc_feature (117)..(117): n is a, c, g, or t
actagaaggtatagctgggctcaatgtacttagaattattaatgagccaactgctgctgctattgcttacggcttagacaaaaagcacccagggcagtattgagatacgattctctnctatgaaaggaatcgaattctatacctcattaccgtgcccg

SEQ ID NO: 700122 - DNA, 134 bp, Homo sapiens
gtggcgcgtgcttttagtccgagtagctaagattacaggtttgaagactgctcattctgctctagtaccaaccggtttcttctgttcttgttgatcaatgtgattcacaaggacctccttaggtaacaaacgga

SEQ ID NO: 700123 - DNA, 357 bp, Homo sapiens
  misc_feature (17)..(17): n is a, c, g, or t
  misc_feature (20)..(21): n is a, c, g, or t
  misc_feature (118)..(118): n is a, c, g, or t
  misc_feature (120)..(120): n is a, c, g, or t
  misc_feature (127)..(127): n is a, c, g, or t
  misc_feature (266)..(266): n is a, c, g, or t
  misc_feature (338)..(338): n is a, c, g, or t
gattacatattcctttnagnntttttaaaggttacatgttcaagagtgaaaataagatgttctgtctgaaggctaccatgccggatctgtaaatgaacctgttaaatgctgtatttgntncaacggnttactatagaatgttacttaatacaatatcatacttattacaatttttactataggagtgtaataggtaaaattaatctctattttagtgggcccatgtttagtctttcaccatcctttaaactgctgtgccccaaaantgtcatgacttggaaaggcaagggtaggggaaacactttaggggatatgtgggggttttttttacccttccnggggcttgtggggcataat

SEQ ID NO: 700124 - DNA, 141 bp, Homo sapiens
gctctgcgcgaattgcattgttctgtcacccccatcaccaattttgcagggcagcagtctcaggacacagtggaatctttggcctggctcacaaacctggaagagctgcaggtggccgattgggagctctgagcctctgaa

SEQ ID NO: 700125 - DNA, 719 bp, Homo sapiens
attaatcccctggcccaacccgtcatctactctaccatcttggcaggcacactcatcacagcgctaagctcgcactgattttctatatcctgagtaggcctagaaataaacatgctatgcttttattccagttctaaccaaaaaaataaaccctctgttccacagaaggctgccatcaagtatttcctcacgcaagcaaccgcatccagtaatccttctaagtagctatcctcttcaactaatatactctccggagcaattgaaccataaccaatactaccaatcaatactcatcattaataatcataatggctataggcgaataaaagccgtaggaatagccccctttcactgtctgagtcccagaggttacgccataggtcacggccctcgtgagcatccggcctgcttcttcgtgcacgatgactaataatactagcccccatctcagtgcatgataccaaatctctccctcagtaaatcgtaagccttctcctcactctctcaatcttatccatcatagcaggcagttgaggtggattaaaccaaaccatctacgcagaaatcttagcatactcctcaattacccacataggatgagatacatagcagttctaccgtacaaccctaagataaccattcttagtttaactatttatattatcctaactactaccagattcctactactcaacttaaactccagcaccacgacccta

SEQ ID NO: 700126 - DNA, 813 bp, Homo sapiens
ttgtatctgttactagaggaaggctttgagggtgccacagatataattgtggtttttttgagacctctgcatccctcagattctgtattgatgatgcttttcatggcttactgagggaaattcgcaagaaggagtccatgccatccttgatggaaaagaaactgaagagaaaggacagcctgtggaagaagctaaaaggttctttgaagaagaagagagaaaacatttcttgttatccttgcttatgagctcctcacgctctctgaattctattacgaggacacttgcatatgcaggattctgctcgcataatatctgtctatgcacctctgcatctttcagtcagtgcgtagaggcataagccagctctgactacctcaccctttcgacaatacccccgctccgagctttcacacccagtacggcatgttcacctacctccgataaccctccttattctaaccacactttctctctcccgcccccgcgcgcgttcattttaaacaaaagaacactgcgcgtggttactaaacaacacagattaaatacacatctcgtcgcttgatcgtctgattagagtcagaggttagagtcgaaacactagaatttcatcgtctatttgttttcttcccaccacgctcacgcaccctcatacggtcgacccgtcgcctaggcggctcaagaacgcgggtcctccatcgttgctatactctatgtagttttggagtcaacgtcagagataatgcctcataagaatcgccggcaaccctccatcacgctatatcctgtcaagtcaataatagacacactcag

SEQ ID NO: 700127 - DNA, 769 bp, Homo sapiens
  misc_feature (576)..(576): n is a, c, g, or t
  misc_feature (614)..(614): n is a, c, g, or t
  misc_feature (651)..(651): n is a, c, g, or t
  misc_feature (657)..(658): n is a, c, g, or t
  misc_feature (769)..(769): n is a, c, g, or t
agcgggctcctggcgcctccctcctcgctgaacgccaacagtgctcttcctcagatgctcgatttgactggtgtgaggtacaaaacagtcacgaaagtgaaatcatgagactattaccgatgtaaatggcagattcacctcaagaaggagatacttaagaaggtctcagagacagattatgccacttctggatctactgaagtctgagtcacacctgagaaacacagatgcaggagaaatctcctaatatattcagaattgatgtgtaatcccccataaaatacatcgtttccattgtaaaaatcagcagtgatgcaaacccacttcacgcgcagcaccacctgcaccgtaccacacaacgctgtgacaacactaacacgaagctgatgctgattgctcaacagtgagggatccctgcccaggagcagccagcaccgtggagctggtggagtctcgctctgtcatccaggctggagtacgtggaatacagtggtgcgatctcagctcactgcaacatccgccttccagattcaagtgattctcccaggtagctggaactacaggcacctgccacangcctggctagtttagtagagacaagttttcgccatgtnggccaggctggtctcaaactcctgaccataagtgatncgcccnnctcggctcccaaattgctgagatcacaggttgtgaagccatggacctggacccaaaatgaacatcttcatagtaaacataaaagaaataggctaggcaataactaatatan

SEQ ID NO: 700128 - DNA, 644 bp, Homo sapiens
  misc_feature (590)..(590): n is a, c, g, or t
gattcgagctcctaccctgatttggtggtattcgtgtggtcttcccatctgccttcagcccaaatgtttctgtggcactcttgggagttcaagacaaataattcctaagggaatctgaggaaatgtcttccatatacttaattctaagtgccaagatgtgcaaacagggaaagagggcaggataagagtgtttgaggctgagctactctgaaggcagggccgatccttgtattctcaatgcagcatgggcctcttctgggtcataaattaaggaattagggatcagaagaaactactaacagctgcatagtttccatacagtctgcattttgcccagtgttgcatcactggttgtgtttggcagagatggttccctgtggctctgggtggcttgcagaatacattcccagatcattcctctccccatttttaaaaatgtagttatctttgaataggtaatacatttgtatggttgaaaatttaaaatatacataagaggccagccactacgcctggcccttccgaagatattctatacatatatgagcaagtgtgtgtggtagtaatgtgtaccaaagcttttttttttnttgactctatatcccacgcaagtacgcgataccacctaattcaggaccgagctt

SEQ ID NO: 700129 - DNA, 781 bp, Homo sapiens
agcgggctcctggcgcctccctcctcgctgaacgccaacagtgctcttcctcagatgctcgatttgactggtgtgaggtacaaaacagtcacgaaagtgaaatcatgagactattaccgatgtaaatggcagattcacctcaagaaggagatacttaagaaggtctcagagacagattatgccacttctggatctactgaagtctgagtcacacctgagaaacacagatgcaggagaaatctcctaatatattcagaattgatgtgtaatcccccataaaatacatcgtttccattgtaaaaatcagcagtgatgcaaacccacttcacgcgcagcaccacctgcaccgtaccacacaacgctgtgacaacactaacacgaagctgatgctgattgctcaacagtgagggatccctgcccaggagcagccagcaccgtggagctggtaggttaactcatcaacttctaagcatggtaaaatctcaggcccttcagagttcttgacaataaccacacctcagggagctgtagaactgtgtagatagaacctggaccacctaagcttatttttctggtgagtaaaatatagtcaagatagtgaacatgttagtcatggcaactccaaggaacactgaaattctgtttgccaatgtgtgtagtcagagacgaaaacaaaatggagtgaccaatttagaggacttccagttgtgtcctggtcattactgatgctttctagtcctgattgctttttaagctgtagattattgttggaactaaagct

SEQ ID NO: 700130 - DNA, 339 bp, Homo sapiens
gcccctttactggatttctttggggcaaaatggccttttggttggactgcccccgctaacccttcatcaggtgccgtgtaaatgggggctggctctagccccgactaatgtgatctaaagtgccgccgggtggctgatgctgccagttttgtctaaggctagggactatcaggtgtctttaattgttgcccctgggggaagccaatgtaaaactgggtaaggaaatttttttggcagttcagccctttccctttttccccctaaattttttcttaaattacccctgtaacccttttaactctcccgggcactttgcccttaaagtctcttccccttgga

SEQ ID NO: 700131 - DNA, 233 bp, Homo sapiens
gtacccttcatttaggcgcgaagtttaagttgaactaagattctgatcttggtacagccatggcgtatcaacagagctcggtagagtttgtcgtcctctacctatgaatcttcccactatcttgcgacttatacaggtgtgcgcttttagctgttctgaagacgctcgtctggtttcgggggtcttaactatggctctcctagcaaagttatatctagttcattcattatgca

SEQ ID NO: 700132 - DNA, 754 bp, Homo sapiens
ggcagttactgagaactcataaagacgaggctaaaatccctcgttcgtgatccacagtcaaccgccctgatacacatcctgcaataaagcccagagaaaggagcgccatggattactacagaaaatatgcagctatctttctggtcactattgtctggtgtaatctgcgatgtgctccattccgctgcctgatgatgcaggattgcccagaatgcgacgctacaggaaaacccattcttctcccagccgggtgccccaatacttcagtgcatgggctgctgctgtctctagagcaatattcccacttccactaacggtccaagagagatcgactgttgtgtccataaaggaacgtcacctcagagtccacttgctgttgtagctataatcatatagacagggtcacaggtaatggaggggttgcaaagtaggagaaccaaacggcgtgccactgcatgtaccttgtgaatacatcacgacatctttactgttttactctaagtgctgttctatgatgactgctgcattggctgggaatggaatacattgaagttgcaagaggggtttccatggcttctgtgcacattaaatagttccttcacttattgcctttacacaatgacccaacgttttgaacgacggcatatacaaggggcactaataaccttgaccaggccctttggtaccatggcccatttccccatccctataattccccaaacaagttaaccaactacaaggcagtgcctaagtt

SEQ ID NO: 700133 - DNA, 417 bp, Homo sapiens
  misc_feature (22)..(22): n is a, c, g, or t
ttttttttggatcttaatattnaatacagtcaggagtggtgagaaacctatttagcctctgaagaggagaaattaggaattaggatacctgctcatcttctttttcactctgagatgtgaactaaaggaccataggctcaataagagcctgttcctctaggacactttatgtctgataacagtactctccctttgttttacaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaaggtatgtgtccagattttgtgtaatttaactcaaaacttctggtcga

SEQ ID NO: 700134 - DNA, 110 bp, Homo sapiens
cgactctgaggatcccgttaaagctaccgcctggctgtatctgacttacaggcgtcagacataagggtactgtgctcggacttacgtaatcgatggtctctatgcggtac

SEQ ID NO: 700135 - DNA, 518 bp, Homo sapiens
  misc_feature (90)..(90): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttgagtcagtataatggaggcagggaaatagtaataaaaaatgattttaaagccctattgcacttgaggaaggaaaaaaaaaaaa

SEQ ID NO: 700136 - DNA, 256 bp, Homo sapiens
  misc_feature (33)..(33): n is a, c, g, or t
tgctgctccctcttcagccacttgatctaaatngcccctctgaggtcaaggaacacaagatggttttggaaatgtgaaaccgaatattaataacatcaccagcatcgtgcctgaagccaagcctgctgccaccatgccagtcctgctcctcactggcctttttctcttggtgtggaattatgagggcacatcctcaataccaggtcctggctactgcatgggaattggacccctcatctcccacggcagattcctg

SEQ ID NO: 700137 - DNA, 882 bp, Homo sapiens
tggggaataaaaaatttttgggacccggccccccttggggggcacaaaaccacccttggtgcccaaaagggggggggttggcgcctgggggggaaagggccccgaagaggggggagcagatctgttccctccccgggggaggagaagaggaggcggattccatataatcggctttccgcacggtctatagggggggtcgcccccccaccgatggtggggcgggggagagacacgagagacaccaacacaggaaacggggggggcccaccaacaaaactacatcgagtagctatggggggtaaacaccgtagaagagtggccagcattaagtagccaacacaccgtggggctctttagaaaactactttaagaaactataaaaacagaaattgtgaggtgtctattaaaaaaacatctaggggggtcctaaaaaaaatataatacatatatttttcatagacatgttgtggaggtttttgtggagtcttaataaaccagcgtggtgctcattaaagaaaggggggcgaatagtggtttgaaaaaaagaagccttgtaggggggtgtgctcgaccacattgtaaagaattattataacaacagtgtggggtgtgctgtatagttgtgccgcacacgaagtggggtggtgggggagcgcttttataaaacaagctaaaagaacgtttagaggcacggcggaagtggtggtggcccgagggagatatttagacgggggttttgtaaaaaggacaaaaggagcggtgaaaaaattttattaacatcctttaaaaattgtggggagaagttgagttgcaagaaactttgtagtcccgcacagatactaaggtattcgaggtaagttttaaaaaatcagatttttgaag

SEQ ID NO: 700138 - DNA, 3650 bp, Homo sapiens
  misc_feature (90)..(90): n is a, c, g, or t
  misc_feature (3118)..(3119): n is a, c, g, or t
  misc_feature (3165)..(3165): n is a, c, g, or t
  misc_feature (3192)..(3192): n is a, c, g, or t
  misc_feature (3231)..(3231): n is a, c, g, or t
  misc_feature (3238)..(3238): n is a, c, g, or t
  misc_feature (3245)..(3245): n is a, c, g, or t
  misc_feature (3288)..(3288): n is a, c, g, or t
  misc_feature (3645)..(3645): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcatgctttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcaggaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaatgaagccatttctattaattaatggcactttatattttatatagagaaatagcttctgtttgattttctggacaccatgtcagtcaagatctactttctgtgtaannatgaataagtcttgcacataatccattcgtgttgcataaggttgcnaaaacaattaagtgggaaatgactccnaacttatgtgtctactctgcctagaaagacagtcttganggcatcnatatatntctcataacaatgtctgttctttatggatttgatccataaatntttatctatctgacaactttgatacttggcatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttatattaatccttnctaga

SEQ ID NO: 700139 - DNA, 173 bp, Homo sapiens
caaaaggaaatctgtaatctgtgcgcagcggtcgccgcacacctgtgacggaaactcctgtactgacacactgtgcacgctcaactcccagtgagcaaagccagagtggcttaagattgcgtccatcgacatgaatagacacaaggaacaacatttcataacaattaaaacca

SEQ ID NO: 700140 - DNA, 3486 bp, Homo sapiens
  misc_feature (2954)..(2955): n is a, c, g, or t
  misc_feature (3001)..(3001): n is a, c, g, or t
  misc_feature (3028)..(3028): n is a, c, g, or t
  misc_feature (3067)..(3067): n is a, c, g, or t
  misc_feature (3074)..(3074): n is a, c, g, or t
  misc_feature (3081)..(3081): n is a, c, g, or t
  misc_feature (3124)..(3124): n is a, c, g, or t
  misc_feature (3481)..(3481): n is a, c, g, or t
agcgggattgcggcgggaagtcctccgagtcatgaatgtttcagcgcggcgcgcgaggtgagggccgcgcgtccaggtgtaagctagcaggttgtcgctgacatctgtttgcagcggcggcagcggcctccccagcccgcagctagcggccggattgtcagcggaggtagttgagagcggcaaaaccgtttgggtctcactctcgctgcctggaggcctgaaacaccaaagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcatgctttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcaggaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaatgaagccatttctattaattaatggcactttatattttatatagagaaatagcttctgtttgattttctggacaccatgtcagtcaagatctactttctgtgtaannatgaataagtcttgcacataatccattcgtgttgcataaggttgcnaaaacaattaagtgggaaatgactccnaacttatgtgtctactctgcctagaaagacagtcttganggcatcnatatatntctcataacaatgtctgttctttatggatttgatccataaatntttatctatctgacaactttgatacttggcatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttatattaatccttnctaga

SEQ ID NO: 700141 - DNA, 3599 bp, Homo sapiens
  misc_feature (90)..(90): n is a, c, g, or t
  misc_feature (3067)..(3068): n is a, c, g, or t
  misc_feature (3114)..(3114): n is a, c, g, or t
  misc_feature (3141)..(3141): n is a, c, g, or t
  misc_feature (3180)..(3180): n is a, c, g, or t
  misc_feature (3187)..(3187): n is a, c, g, or t
  misc_feature (3194)..(3194): n is a, c, g, or t
  misc_feature (3237)..(3237): n is a, c, g, or t
  misc_feature (3594)..(3594): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaatgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcatgctttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcaggaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaatgaagccatttctattaattaatggcactttatattttatatagagaaatagcttctgtttgattttctggacaccatgtcagtcaagatctactttctgtgtaannatgaataagtcttgcacataatccattcgtgttgcataaggttgcnaaaacaattaagtgggaaatgactccnaacttatgtgtctactctgcctagaaagacagtcttganggcatcnatatatntctcataacaatgtctgttctttatggatttgatccataaatntttatctatctgacaactttgatacttggcatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttatattaatccttnctaga

SEQ ID NO: 700142 - DNA, 622 bp, Homo sapiens
ggaccgcgtgggtcgatcattgagaactttcaagcatcataacttgaagaagtatatctcagttgcagtatatcgaaatacttggctactacttctacccacttgattgcttaagatagtgtgtccatctgaaatgatcgactaggggaagaattgatcaatcaatctattgtacatgaagctgctgatcgatgcccctggttgattccaatgttgtaccaccatattggacctgccattgaattaccccatcgagagaaatagaggaggaactatgggatcacatcatacgaattccagacattcgtatccagaattaggaacctcatcagagatctactggaggattaatggatgatataacctaagacggaatcctgtgccagcgttctttacgagggtctcgttcgattcatttggatatgactaacaagagaatcctaaatgcatcgaattgatcctgcaagggatgcttaccatagtagggtatgatacgacgacggatgagacgagctaacgtcatgcttccaagcattgcaagtaccactggacgaaaccacgcgcctagatctgtcgcgagctcgggtcgcaatagcctggttcgtttgaccaaaatcactcc

SEQ ID NO: 700143 - DNA, 3601 bp, Homo sapiens
  misc_feature (90)..(90): n is a, c, g, or t
  misc_feature (3069)..(3070): n is a, c, g, or t
  misc_feature (3116)..(3116): n is a, c, g, or t
  misc_feature (3143)..(3143): n is a, c, g, or t
  misc_feature (3182)..(3182): n is a, c, g, or t
  misc_feature (3189)..(3189): n is a, c, g, or t
  misc_feature (3196)..(3196): n is a, c, g, or t
  misc_feature (3239)..(3239): n is a, c, g, or t
  misc_feature (3596)..(3596): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcatgctttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcaggaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaatgaagccatttctattaattaatggcactttatattttatatagagaaatagcttctgtttgattttctggacaccatgtcagtcaagatctactttctgtgtaannatgaataagtcttgcacataatccattcgtgttgcataaggttgcnaaaacaattaagtgggaaatgactccnaacttatgtgtctactctgcctagaaagacagtcttganggcatcnatatatntctcataacaatgtctgttctttatggatttgatccataaatntttatctatctgacaactttgatacttggcatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttatattaatccttnctaga

SEQ ID NO: 700144 - DNA, 2822 bp, Homo sapiens
  misc_feature (90)..(90): n is a, c, g, or t
  misc_feature (2290)..(2291): n is a, c, g, or t
  misc_feature (2337)..(2337): n is a, c, g, or t
  misc_feature (2364)..(2364): n is a, c, g, or t
  misc_feature (2403)..(2403): n is a, c, g, or t
  misc_feature (2410)..(2410): n is a, c, g, or t
  misc_feature (2417)..(2417): n is a, c, g, or t
  misc_feature (2460)..(2460): n is a, c, g, or t
  misc_feature (2817)..(2817): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactctctttgcatttttcgtttaattaatataattttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcaggaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaatgaagccatttctattaattaatggcactttatattttatatagagaaatagcttctgtttgattttctggacaccatgtcagtcaagatctactttctgtgtaannatgaataagtcttgcacataatccattcgtgttgcataaggttgcnaaaacaattaagtgggaaatgactccnaacttatgtgtctactctgcctagaaagacagtcttganggcatcnatatatntctcataacaatgtctgttctttatggatttgatccataaatntttatctatctgacaactttgatacttggcatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttatattaatccttnctaga

SEQ ID NO: 700145 - DNA, 701 bp, Homo sapiens
  misc_feature (90)..(90): n is a, c, g, or t
gcaaagtggttattaaggatcctccaccaccacgcgtccctgcaccaaaagaggaggaagaagaacctttgcctactaaaaagtggccanctgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgca

SEQ ID NO: 700146 - DNA, 321 bp, Homo sapiens
aggtttttccctaaaacccatccattttttaaggcttttggttcattcccccccttttaaaattggttggttttaaattgggaaaaaattttttcttttttattaattttattgggtggtaaaaagccaataaaaaggctggggggggggtttccctttggtaatcccacccctttggggggttaagtggggaggttcgcttaagcccaaaggtttcagcccagcataggcaccaaagtaagcccttgtttttcctaaaaccggaaaaatcagttaggcccaggggcaggggccggtagtcccagctccttttttttttca

SEQ ID NO: 700147 - DNA, 494 bp, Homo sapiens
gaaataagagagactgatgcagttagtataaaacagaaattagctatcagatatcaatacgtggaatcaagctagtctactaaaacaaggcttatcaaaatacttgtgataaagaaccaattgcacactgataaaactgtaaatatcaataaaaataactaattagaaaaagaaaaaatccatgaagacataagaaaatataacccccaaattttattattaaatggacagacatagaattactttgtcaaatggctatagaaatatctaaacactgaactctcgatttcagcactaatttcagtacaagcagtccatgagcctcgcctgaccacatttagagagcactagaactggaggaacatgctactcatatggtctagcacaacgctctatcaaaactacacctttagatgaccccttcatagcatattttacctactgtagctgctacttggcaaagaaagatttagaaaaaggtctcaagtctacgt

SEQ ID NO: 700148 - DNA, 262 bp, Homo sapiens
ttccgacacttgaacgtaagactctgtcaaacgttcctagaactgataaatgacttgagtaaagttctaggatacaaaatcaatgtacaaagagtcagtaacatatctatacaccaataacattacagctgagatccaaatcaagaatgtaagcctatttacaatagcaaagaaaagaataaaacacctaagaatacagctaaccaaggaggtgaaagatctctacaatgaggagctgaatgagaatcatcgatgaaatgct

SEQ ID NO: 700149 - DNA, 262 bp, Homo sapiens
  misc_feature (14)..(14): n is a, c, g, or t
cttaaatataacantcttctggatatgttaagtgaaaaacattattaagtacactatgctactgtgtaaaagcaaataaaaacaggcacaaaactttctaatgcctgtaatcccagcactttgggaggccgaggtgggcggatcacgaggtcaggagatcgagaccatcctggctaaaatggtgaagccccgtctctaccaaaaatacaaaaaattaggtgaccgtggtggcgggtgcctgtagacccagctgcttgggagg

SEQ ID NO: 700150 - DNA, 1055 bp, Homo sapiens
agcggggcggtggtggccgtagacggttcctacctggccctgttaatgtacgtgggccaggccgggggagtgatggctgccctaagaaccctggacttgctggaggtacgtgggcgggagagggacggggtaggggacctggccaatagtcggagtgtgaccctggagtcatgctgcagctgctaggggctgccagttttaaggagaggctgccgactatacgactactatggggccagctaggtggaggcgatagacgagtatcagatatatagcaagacatctacaaacaggaggcccaagctcaacacaaataattctgaattcacagaagaacaaaagaaaaccataggcaacattgcaacatgctatggaattgcgaagtgcagcttctacagtaccacacagtctacaagacagactataacctggaggacctgaagcagctagagccaatcctaaagaatatctaacatataataaagaattcccataggatgtacagcctgacccataaagaagaataaaggcacctggtgacagcaagagaatatggacattgagaagatagaagaacgatggtgatgctggaacagagacacaatgaatacaaaacactgctagaagtaccacggaacttaataaaccaaggtagccataggaaacaggaatgacaattacctcactgaatcaggaaaagcgcacaaagggaaagaacactgctggacactgcaatcgaacccaaatataacgaacgataaaggaaccagcggaggaaacacagcacaggaaagaaacccgcgagctacgagaagacacaaaaatgacaaacggaggacaactccacaagtcattggaaaataacaagagggcgaccgagcgagcgggagacgcgagagcgaaagacggatacacagaaaagggaggaagagaggagtggtgagtagacgcgagcgagatgtgaaggagaaccgtggcgagagcagaggaggggcgacacagagtaacgggcgagcaggaagaaatagaagaaaggggacgggaaaaacggagaa

SEQ ID NO: 700151 - DNA, 1389 bp, Homo sapiens
  misc_feature (475)..(475): n is a, c, g, or t
cattgctgcatcaacagaatgtgtccctaccatgtgtactcgcgttcttcccatgggccccaactctccctacctggtgcaaatggtcctagggagcttacgcaccaaccacctagagtaggtctcattgtctccaggacaggcgtgaaacgaagaagaggaggcgcgtgccacaggcgctttacactcgaaactagttcagatacgcttatctagtcgcgaagaggtagtgtgacgagaaattgtctgaccctagttgtgcgtcaaccaggagtgtgatcgcctaccaagtgatggtccccctatcctcccgccatgggacgcacaacgcaaaggctgctccgcacaacgcatgagccaggcggagggcatctctgggcatctatgaactccatcacgtcacgcatccgcaccacttatggcacgagggcgaggaggccttcacatcgaggacacgcgtcccttggcagttggncaggaaataaaatgtcaattagcgccgccctgctctcacatgcacgcatgcatgtctgtgcaccacgcctctgtgcagaggggacgggtggaggcttacaaagcgcaggctcaaatggaccaacggtcccataggtcatccgtcccaccaaagggtcacccatgcgcgttcgagaccaaccatgctcttaaccccttcctccacctccctgccgtgcgttgcggagcatttggcaaccgtcccacatactcccgcaaggccacattgagtgagaggaccaggggttttggaagccagtaatgtacttaggcggcctagaagaaagccgcggagaaattgggaatgtaaccagtgtctctagggtaccgaaccggcggacacccttctcaggatgggctccgttcatggccgaaatctcctggatccatggtcctacgcccctagaccaaataaaaaggcgaccaaggaaactagaccaatgtctcacacccaaggttcggcggcctgaaaccgctggcgagggggatgtgacccttgtacagggaatttgtccctgttggcacgccctggtcaatacccgatggaacaaccgagaaaaggccaccgaattggatcccacccttacgaagaggaattctttgggcatggaccaccataggtggttccccatctgaactcgagaatgactagggagcaggagaggtcgtaggaagtcacaggacagaacgcacgaacaaaggttttgacaccgggtggtttgtggccccaagactctccttgcagagggcggaaggtgccacccctccagaaaaagttggaatgtacactcgattcaccacgggagccacacatgtgcgtcttggctgagcctcacaagatgacaagattagaccgtggtgtgtgttccccactca

SEQ ID NO: 700152 - DNA, 486 bp, Homo sapiens
ccaccatgcatgtgtatacctatgtaacaaacctgcacgttctgtacacttatcccaaaacttagagtataattaaaaaaaaattttctaatgttgaaatactctcacatttctcaaataaaccatgtttacttgttcaaaacaaaaaaagaaacagaaaagcagagctgacctacattctggaattctcagatagagactcacattaattcgaatatacacatcttaaatgatctggagaaaaaggcagttaatcaacttgcacagaagatggtggccaacttacaatttcagcagtgagaaattgaagaaaaaaaaaagagccaaatggaaataacagaaatttaaaatatcaagatttccactcatcagtgcattcgatgggttaccagcaaactggtcacaccaaaaaatcagtaatcttgaaaacaggttagaagacatctaactggaaaccaaagagataaagtgaaggacaacaaaaaa

SEQ ID NO: 700153 - DNA, 137 bp, Homo sapiens
gcattatgaactaatttacattcccatcagcagtgtaaaagcgttcctatttctccacagccatttaggtaacagccatttaggtaacagccatttaggtaacagccatttaggtaacagccatttagggggtaccg

SEQ ID NO: 700154 - DNA, 970 bp, Homo sapiens
gtgatcagatcaactatcccgagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaagcttaaaaaagaaaagaaaaaaatcatatactgaggttgctaagatctacatgacaataagatattttgggagagagatacgttcacataattttattacatatattgttacaattgttctattttgttagttactgtggtaatctcttactgtgcctaatttataaattaaactttagatatgtatgtacaggaaaaaatgtagtatatagtatcgtatatatgtacaggaaaaaaagtactatctgtggtttcaggtatccactgcgggtcttcagaaacgtacccccatcaggatgagaggggactgctgtacacagaatactacggaaggcctctagactaccatccattccttactcaaacaggaggaaacacttcctggtacaagtacaaacggtacaggcttaactgatcactgacagaaaaagctaagaagaacaaacgtcaaaacgagacagagagctcaatcatggcccaagaaggcagtgcaggggccacgagacacggaacacatgacaaatctccaaactacccacggtcgcagcgaagaaccgcagtgcgcaagcatcccaagggagccgggagatacaagacatgacggcaacaaaccggggaaatcgcggaagcaccagcagaagcacggtcgccaaggggcgcggcggccccacccgagcacaggtaacaccacacagcaccaaacagacgggagacgcggtagacagacaaggcaagaaaaccacaacaacaacaagcacacagaaagcagaacaaaagcaaacaagccgcatgccagacggaacca

SEQ ID NO: 700155 - DNA, 1170 bp, Homo sapiens
  misc_feature (563)..(563): n is a, c, g, or t
agtggataatgacagcttgaagtagttcgagaataccgaggatgacttaaatcatgtacaaacatacctacaatacttccacccggttgatgcttatgaaccaggtgaactgggattaccctttgaaagttgaacaaatcgcataatagtccacgcactctcgatatgccacgcccagttcagcccttgatcactttgatcaatcagcgaaagtacgggtcatgtgtcatctccgactgaatgccttggtcactgctactatttcagacatatgagacacatcgatgctagcgaagtgtacacctggtacagtctagatcacaatcccaacgtttcgaccagcgtaacaacagacacggaggaagtgttactcagcgagtctagtttgctacatagaaccattctttgtggtgaggtcgacacacgacaaggtgtctgcgatagccccccgatgctggtgctccttaaagacacatttccgaataatacacacttcgtcataagaaattcattttagtcacatatacatgggacacgcagttgatgttcttaccgcataaatncagtcgtactcgcacgccttcatagaagcccacatacataaccagtccagatcagacaacagttgagaaaactgccgaagccaagcaattaacccccggggaccattctgaatcaatcctcactggatcgccacaagggtgccaaagagggtggttttcctgaaagcagctggctagggggcttattactttgtgaactggaccgtctggtcctcaatcgagttcctctacgtaagaacacaccagaacatttgtcatttggcactttcaaaccaaaaatcgatatcagcaatgtaccaaatcccaaaaagcatcgttactggattgcttactttcacagaacgaagaagcctgcggaagcccagaagagccaggcaaggtgagatccttcgacccggaaaagagagaacttgcgcattcggagcacacgccagactggatccgaaaggtgggactccccatttttcccggagtacaaggctaatctccaggccacgggtaactggcaatcgttgcgcgaggggggaaaatacatttaccccacaggggtggcgctccccgctttttacacccgcttaaatatgtgcggtataacaacaaaaaagag

SEQ ID NO: 700156 - DNA, 968 bp, Homo sapiens
tgcgcggccggagttcagattttattatggggaaagaggggctccgcgtgcccgcaccgcctccccaaagccctctttccgggaggctcgtgatcagcccacaatgtgtaaaagttagattttcgtgccagggtgggccaggtataactcaagtgacgcgggccttggtggacccaggggccaacgcgcactaggggcgcggtggtcgtagcacggcgcaagcgtggacggcagagaaagagagatctccgtggccctgcgagaagaaggcggtcgaaagaaaggagaagagcgcgcagcaggatagtaagaagcacaagaagagaggaagtggtctcgcgggcgcgcgcgcagagaacactaccgcgagcgcggagtatcccacaatgcgcgggggatctagaggggccccctatataagcgtggtacaccacacaaggagagtgctctccagggcgtgggaatacagcgtgtcacaaacaagacacacgaggccacaagagaagacgacgaggaggttatctcccaagcgacaacaccttcggtgaaagcccacacaaagaggggaacccacaggggacgtggaagcccacgagcgtggccagcaacaaagacggggacgccgggggcacaacagtgtctcaccacaaaaaaacctacgtggcgcagaagagggctccaccgcgttggaaaggcaccccacgaggtgggagggacacgtggaggagcagcaacaggacactctacaacgaatcctatcaggagaagacatggcatgcacgtgacaccgaccagggactcccacatcacaccgaactgagaaagtcgcgcagagaagccatccaccaaaaggaagtcgccgcagtgaacacagcgtgcaaaggggaacaccagcgcacgatagcaaccaaggagaacggcgggaatcgaggccaacaacacacagcgagaggatacgaaggaccccg

SEQ ID NO: 700157 - DNA, 174 bp, Homo sapiens
aatatcttcctctaaacatatgcaatattataatagctcacatttcttgaatgtttttgtgctggtacttgtgatggacatttattgcttgccttcccagaacccatcattaatatacaaatatagtacagataatacacatacacatatttacggagctttctcctttctctc

SEQ ID NO: 700158 - DNA, 118 bp, Homo sapiens
ctttggtcactgcttcagcttgacggttgttgttggcctgtaccaaacgcaagttggcttgctcgatcgcaaccacaagatctttacggcaagccgcgaagatcgtgccgatatcgct

SEQ ID NO: 700159 - DNA, 810 bp, Homo sapiens
aatgagttaatatataaagcacttgtgttagtgactggcccttagtgagcattagctattactgctgttactggctttgagttccaaaacagggtattgaagtttccaaaaccagcttgggtaacatggcaagaccctgtctctaccaaaaaaaaaaaaaaaaaaattagccagtccggggggttggggcctggtagtctggagctactcaggatggctagaggcaggaagatcatttggagctctggggagggcagagattggtagtggaactggagattggcttcatggtactctagctggggtgacagactggagactctgtctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaagaaaaaaaaaaaaaatcaaaacaagaggggggcgagaaaaacacgtaccctccgcgggcgcgccaaggacacacccagcagtaccgatacgacgtacgcaggccgacggcgcgccgcagcacgcgcgcagggaagcaaacacaaaagcgatcggggagcagcgggcgccaccccaaccaagccgagagacacacagacaacaggagagacagacacagcaccgcgacgacgaagccacacagcctagcgcggggagaacaactaccccccccaaccaacacgacggaagacaccatcgggcccgcaacaacaggaacgcgggacacggccgaacaccacgcagcgatgaccgggagacaagt

SEQ ID NO: 700160 - DNA, 140 bp, Homo sapiens
aatatcttcctctaaacatatgcaatattataatagctcacatttcttgaatgtttttgtgctggtacattctgagcagggtaggtgctggcaatgacgtcatataggaattgatattgctcgctactctgtgaaagtgg

SEQ ID NO: 700161 - DNA, 150 bp, Homo sapiens
ctgttgtccagcagagagcacaggtagaagtgcgattggctcgctcctgctcccagaggctgttagcagtggcgcatggcatgggcgatgaagcctgcagggcctcctgtgcctcctcccccatgatctgtcattgtgccagcgggggct

SEQ ID NO: 700162 - DNA, 524 bp, Homo sapiens
aaccagggcaattctgtgtggcccctgggtctatgctttggcttgtaagtattattagccattatgcactccactctaaggtgttagcctgagacctgcatgtccagtaagggggcttcctagcttacaaggatctctgtcacagggctggagagatggctcaggggttaagagttaagactgctcttccagaggtcctgagttcaaatcccagcaaccacatggtggctcacaactatccgtagtggaatctgatgccctcttctggtgtgtctgaagatagctacagtgtactcatatacacaaaatcaaccaatccaaaaaaaaaaaggagctctgtcaccactaggctgtagtagaagctcagcctgctgttccccacacttgaccttgaggcacccccagtttctccctgtacctatagtgaagctgagaagacagtaaccattgggccttgctgttctgtaaaactcactttatatccttagcactgtagtggatggccagtggccccacggtaaccc

SEQ ID NO: 700163 - DNA, 263 bp, Homo sapiens
ttttggggtttaacccgccctttttttttatggtttttggcccctttccctgggggagcccttttctgggggggggttttaaccccggggtaaaggcccccccccccgggcccccgccctgttttgctttgggggcccggggtcccccccaaatgttttggggggggggggggtttcccccctttccccccaggttttttcccccccccccgggggggggtttccctttggggttttttttttaatggccttggggcttttga

SEQ ID NO: 700164 - DNA, 381 bp, Homo sapiens
tagtaatcttttttatatcatcacatatgtactttaacaaccgatgtgaataagaatatctggattaccgaacaaatatagtaaaagatctgctattagtattatttagaccaatgaaataactgataaagcttgattatagttcatatgtataaataaggagggttaactaagttagtttttttaataccttcttagaggtgtggtgcatatttccctagcactatatgcagatgccgtctttggaaatgttcaagagaaagctatgaaacttcataaatgcttctaattctgaaatggtaaatactctagtgtaatatcttcaaattagacagatttaaaaaatggtgatacacgtaataagatgacataattataata

SEQ ID NO: 700165 - DNA, 139 bp, Homo sapiens
cagagcaatcaaaacctctatccgacagacaaatagaactcaacatctcctgagagacctttcttacctttttttaaaaacaaaaaatgaaattattttgcatgctgctgcggcctttaaagtattgaagtaactggag

SEQ ID NO: 700166 - DNA, 201 bp, Homo sapiens
ccaaccgtgtgagtggcagggcaacttcggtgcgcggggccaaggccaggtcaaccagggatttgagttgcccaatgacggtttcttcagcctcagcgccgacgtcggcatccaggaaagctccaacgtggccggcgcggtgccggatcgcaccagcatctatttccgccagaacggccagcccgacccgcgcgagaccag

SEQ ID NO: 700167 - DNA, 559 bp, Homo sapiens
gggagggggtaaaaaaaaacaaaaaaaaaaaaaaaaaaaaaaaaaaaaaaaaaaattttggggcccccggccccgaaaattttaaaccctgtgggggggggggcccaagtaattggtatcgaataaccattgggcgcaagaccgcgtgttgtcccactaagggaacaactcgttggtactaagacacggtggtggggggtttctcacccaaataaaaacaacggcgggggggggcagcacaggggcggctttgtggaaccaacatcccacagacgtgggaggttccggaggggcaaacatgggggcgacttttcttaccacaggggggctttccaagagaggagcgcgcaggcaatgaacaaattaggccgcgcgcggaggaaacaacacacaattgatccactgacgacactgtgagcactctaccacacacaaatatcggacaccaaccatccacccagcatccactacacacacacagcacgcactaatcaccacatacagcaccgtacgcatccatacctagtctcctccccctaccagtacacacgagcataca

SEQ ID NO: 700168 - DNA, 83 bp, Homo sapiens
ccacgcgtccgttttttttaaagcaaagacaaaaaagtttatcttattagaaacaagatacaccaccacttatgtcttgcttt

SEQ ID NO: 700169 - DNA, 308 bp, Homo sapiens
attcgcggccgcgtcgacacttgtagaaataatactggctcagccgggtgcagtggttcatgcctgtaatcgcggcactttgggaggccgaggtgggtggatcccttgtggtcaggagttcgagaccagcctggccaatatggcgaagcccccgtctcttctgaaaatacaaagattggctgggtgtggtggctcgcacctgtaatcccagctactcggaaggctgaggcaggataaccacttgaaccatggaggcatatgttgcagtgagctaagatcgtgccactgcattccaacttgtgcgatgg

SEQ ID NO: 700170 - DNA, 122 bp, Homo sapiens
gttcacctgtccctttgttgagaagttctccattgacattgaaaccttttataagactgatactggggaaaacgatgatgtgttcagcctgtctcctggggaaaagaaccagctgataacag

SEQ ID NO: 700171 - DNA, 785 bp, Homo sapiens
aaggtgtatttaaatgtaattcatttcactaagtcccagaggaaaatagagatagagagagagagagagagagagagagagagagagagagagagagagagagagatgtattagtagtagagagaaatatgacgagtgatgagtatgtatatatttgtgttttgtcgttcattattctaatgagctagaggagtgtgtctcagaggaaataataccatattagtgtagtattgcgattcatcattctacagttgagtcgtgtacgcgtgtctgagcaaagtacaaatatcatttttgtatgtgctgtgtgtgaagaagtgaggagagaggtgaggggcagaggagaggagtagagaaatgacataatgtagtataaggggagggagagaagtcgctatacatctttgataccattagatggaaggcgaggagacggattatcatacttctacttccttctatgatgattgtggtgctgccgaattatccacattttgttgaaccatggaatagcagtcataccatgccttccatggttgtaggggtttgttgggctgaggctgttactgcgattgtacaaaagcagtcgtagctagtgctcgctgcggtggttggtgtgctcggttcaccccattcaatcaacaagaaaaacaaaaaaaaaaaacaaaaacaaaaaaacacagagcacggtcggccaggagccggccacccgcggacaaccacaggagataggacataatacaaaacacacggaggggaggacgtggggcccaccggggaccacg

SEQ ID NO: 700172 - DNA, 364 bp, Homo sapiens
tcgccattgggactctaccctgggcatcaaaagtgaaactccatcactaaaaaaaaataaaaaataaaaaaataaaattattgaggccgggtgcagtggctcacgcctgtaagcccaacactttgggaggccgaggcaggtggatcatgaggtcaggagttcaagaccagcctggccaatatggcaaaatgctgtctctagtaaaaatacaaaaattagctgggcgtggtggggtgtgcctgtagtcccggctactcgggaggctgagacagaagaatcacttgaacccagtaggcagaggttgcagtgagctgagatcgtgccactgcactctagactgagtgacagagcaagactccgtctc

SEQ ID NO: 700173 - DNA, 341 bp, Homo sapiens
  misc_feature (132)..(132): n is a, c, g, or t
  misc_feature (157)..(157): n is a, c, g, or t
gaggatcccgtgtagtactggctctggggtgatgattaacgtattctgtctgggagtggagggtatatactcatttgtgacatcttggactataggtacattcattttaagctatcacccctcagatcacancatacttgactaagggtggactgtntgcatagggtacattttgggatgggggcaagggaccatactttgaacttctataaacggttgatttgggtggagttgaaaccaaattaccacattaagttagactgaggagggctctgtcttgactcttgtttagtttctgacctgcacattttatgttatgttacctatcttcgggtttgctt

SEQ ID NO: 700174 - DNA, 108 bp, Homo sapiens
tttcttggtagctgctgccttttttccccaccaaaggtctcctccggctcctaaccaccaacagcagcctccttcccttcctaaccaaccacaggctcctggctggca

SEQ ID NO: 700175 - DNA, 194 bp, Homo sapiens
  misc_feature (105)..(105): n is a, c, g, or t
  misc_feature (122)..(122): n is a, c, g, or t
agcccgggcgagcccggtggggcggccccagagcgtgaggtgccggcggcggccaggggctgcccgggtgcggcggcggcggcgctgtggcgggaggtggctgcnttaggcggtttgtggcnggcggggagcaagaggcccagttttttgtggcggctggggaaggagacattgggccgggcctgcagggccca

SEQ ID NO: 700176 - DNA, 539 bp, Homo sapiens
taatcgagctcgtaccgactttacgcaggctctctagagggatatgaatgcacccagggcctttgagtttcaagctgtggctcgtagatgtgctggcgagcagttcgttgatttaactagttgacgagtttaggcgctaagtcgatagtggggtatctaatcccagtatgggtcttagctatagtgtgtgcagatatgttaaagccagtttcgtagtttatattgtgtcaacgggcagtttgatacaagtctaggtgagtttgagctatattgtgggagggggtgatctacaacactctttatgccgggttctattgacttgggttaatcgtgtgaccgcggtggcttggcacgaaattgaccaaccctggggttagtatagcttaatttaacttacgtttattgctaaaggtttatcactgctgtttcccgtgggggtgtggctaggctaaggggtgagagctgcatgtttgcgtgcttgatgcttgtcccttttgatcgtggtgatttagagggtgaactcactggaacggggatgc

SEQ ID NO: 700177 - DNA, 780 bp, Homo sapiens
cagagcctgtatatgttaggccacttaatgacatgagagggagttctaagacatcggcatctaaacgaggggacgcctttctacattggctccttctggtgccagccgcaaaccatttgtgcggcccctcatctggccttgagattgcacattttcctttcttcaaacctacacatgttggggcaatcttgtgaccccttttggcccctagggccttcggcaaggtgaccactgaattgacaaattcaggaccagggctcaccggtgccgtcacttaggaatgcgggaacaaaagggacattttctcaaagttcccctgaatggacatgccaatctctagaaccattttattctccccgaattctaccccacacctcgtgtcctagagccctctgctggcagagtcaaggaaacattatgggcccagactggatatgttgtaaattggataatttgtgccccgtctcagggaagcgctagtaaaggtcaataccattttatattctacaaaacagacctattctattgttcataagggaacttctggagtgtgtttcagactagggaaatccctcattgagaggatcattaattgcttgtgtgccctgtcccactgctgatcctgaagtttctcaggagggaccaggcaagagcagtaccattctaaagcattccaagttgacctcaggcctgtgttcttttctacaacataacgctctctgtcgcggaggcgcctggtaggttcattgctgacataaccttccctaagcggccattata

SEQ ID NO: 700178 - DNA, 240 bp, Homo sapiens
ccccttgggctgtgggtgtccgcgtggatatctagcgtaggagacagatgaggatactcgatccatccattcatgcgcgctcagcgtaattaaatgatcgaggcctctgagcttaccttttacgagagtcattactttttcccggttgtttaaaccgcgcttcattgaatttcttcactttgacattcagagcactgggcagaaatcacatcgcgtcaacacccgccgcgggccttcgcg

SEQ ID NO: 700179 - DNA, 199 bp, Homo sapiens
gatgaagcccatttctttctttggggagcctgggggtttttattaagggtgtttatgttaaaccaaaagaaggttgaaggcttctttttgttgccaaaaatgtaagggtccccggcttcctttcaggcccacccgtctttcccggcggaccttattaggcgcacttttttgagagaaacacccgcacttttttttttct

SEQ ID NO: 700180 - DNA, 837 bp, Homo sapiens
  misc_feature (41)..(41): n is a, c, g, or t
  misc_feature (478)..(478): n is a, c, g, or t
  misc_feature (597)..(597): n is a, c, g, or t
  misc_feature (602)..(603): n is a, c, g, or t
  misc_feature (614)..(614): n is a, c, g, or t
  misc_feature (718)..(719): n is a, c, g, or t
  misc_feature (765)..(765): n is a, c, g, or t
  misc_feature (804)..(804): n is a, c, g, or t
  misc_feature (806)..(806): n is a, c, g, or t
ataataattaattgtatgttttgatggtaggttgtatattngtttgtagtttagagaagtgagttgcgttttatgtggtagctgtattaaaatatgtgtggtaacgctgtgagtgcaggaacaagcaatacctgtggaagttacttcaaccctgaaagtagggactttccagcactcccatattctggtatgggattgcaatgatggtaaatgtaaaactggaagtggagatatagagaactacgatgatgctactcagctatacaagttgattaggccctataaacttctaggtttgctatacatgttctataaaagctctactgaaagagaagtagtgcagttttgaaatgggacgaggataagtcctagaactactggatcttcttttgtctcactgtctagccatatatgcgtccggcgtgatgtctgtaacaacgtataacaaaagcataaaaaagaaataaaaacttaattnaaaaatatagaaaatagtagagataataggggtggttttgtgtagataataggtgtttttagacgaaataaaagaaaagaagtttagaaaaatagaaagaagaaaagaaaagaggatgnaagannaggaagtgggncgaataacggaggctaacccaatagagtgtgagaggtgtcgttgctttttatttatctagtttaaaaaaatagcaatgttcaagtcgcacttatttttaatttnncatagaatctcaagtttattagtggtgtttatcatggtttatcccnaacgagccccgaggatctgcaatagactgtgggaggcgncncgggaagcataagataggtaataacaagttt

SEQ ID NO: 700181 - DNA, 498 bp, Homo sapiens
  misc_feature (498)..(498): n is a, c, g, or t
tgcccaggtggatgtttaaaaaaagaagtttaaagtcccatcctttcaaattttaacctttttgatttattaaaaaggggattggccataaaaaaaaattactttaaccaatttacaggactggggaaaattggttttttcaaaacataagaaggacaatcggtttttgccatgtgggtgggtctctggaaacccctctttgttgccctccgtaaaagggcgctttgggtttagaaattaacccacttcttcttccccggggagataataagtcctccccacggaagcccagggccgaaaacaaaataaaccagcacccacttggggggggggggctatagctgtttattaaaaagaaaaaacctttgttaataaaaacgagggcgcattaccaatatataaagccggggggggggggtaatataaaaagagccttgccccttaattccagaatgtggggtaaaaaccactactgggatacaattaaaccggaaggcn

SEQ ID NO: 700182 - DNA, 339 bp, Homo sapiens
tagaggactggaagcatgcagccaactaagcatggctacttcagtgtaaaattaacactgagttacaaactgaagtggtaatgttaaaatccatggttctgtggttaggggaacaagtacaaagcttacagttgcaacagcaattgcactgtcattttaatcacactcatatttgtgtaaccaacttaggaatataaccaaagagtatccatggggaccttgtaaaagcccatttgcagggagcttccacatccaacatcaccttttgacatagggtggaattaccaaaaaaaaagttcttggattttaaattaaggccaaactccaggagttttcagc

SEQ ID NO: 700183 - DNA, 177 bp, Homo sapiens
cggatgattacctgaggtcaggagttcaagaccagcctggtcaacatggttaaaccccgtctctactaaaataaataaatgaacaatacaaaaattggctgggtggcacacgtctgtaatcccagctgctcgggaggctgaggtgggagaatcgcttgaatctgagacacggaggct

SEQ ID NO: 700184 - DNA, 179 bp, Homo sapiens
cccatggaggcattcctcccagagaggtacatagtaaaggcagaaaatgtctggaaaacaaggagtgggtcattttggctgatgtgaagggtttgttagaaaacctacctttcaattagttggctgtataatttggagatgactttttgaagccccttctcctacagagcaaagcagca

SEQ ID NO: 700185 - DNA, 1217 bp, Homo sapiens
  misc_feature (9)..(10): n is a, c, g, or t
  misc_feature (37)..(37): n is a, c, g, or t
  misc_feature (42)..(42): n is a, c, g, or t
  misc_feature (56)..(56): n is a, c, g, or t
  misc_feature (64)..(65): n is a, c, g, or t
  misc_feature (159)..(159): n is a, c, g, or t
  misc_feature (183)..(183): n is a, c, g, or t
  misc_feature (190)..(190): n is a, c, g, or t
  misc_feature (195)..(195): n is a, c, g, or t
  misc_feature (201)..(201): n is a, c, g, or t
  misc_feature (229)..(229): n is a, c, g, or t
  misc_feature (249)..(249): n is a, c, g, or t
  misc_feature (277)..(277): n is a, c, g, or t
  misc_feature (281)..(281): n is a, c, g, or t
  misc_feature (283)..(283): n is a, c, g, or t
  misc_feature (290)..(290): n is a, c, g, or t
  misc_feature (293)..(294): n is a, c, g, or t
  misc_feature (305)..(305): n is a, c, g, or t
  misc_feature (332)..(332): n is a, c, g, or t
  misc_feature (345)..(345): n is a, c, g, or t
  misc_feature (371)..(371): n is a, c, g, or t
  misc_feature (374)..(375): n is a, c, g, or t
  misc_feature (516)..(516): n is a, c, g, or t
  misc_feature (558)..(558): n is a, c, g, or t
gctactttnncataaaggcatttgtagtacacagaanacagnagtatcagtagtgnaaaagagnntatacagcccttaaatatcagactttgtaacaggtagaaatattacagaataatttaacgacactacaatggcgggcaaatgaaataggaaaanttttagtgagttacccgtactcanagcattntcagngctttnacaaggaaaaaaggtgatagtttaattntaacatgttaattggctagntcttgcccatatatgacttaaatgtctnagananacccccngcnnaaattaacaantgttagtattagtctcacacataagtnccatacattttancctcatggatgtgatgcactgaaaantcnnccgctccccttttttcttttttttgtcgtgcatattttatttctgtagtttctggttagctaccctaaagtgatttaaaaatttagaatgctttgtgtttcctatttggtaatcttcattgacttttctttagttaatgantattaaatagtgcatattctgtagactatagggtttacattntgttgcatcttataacttgtatagattgagctgattgaaataagattttgttccaagtattatctgatagaatacaagatgattcaaaattatatagatatttaaagcttttctgctgtttttttttttttttaattggcaactggcttttctggccgggcctctcttccctacccaaaagtgatgagttctgaacaagacaagactggtcatattggtagagacttgggtatgtgataccatagaatactgattgggatagccatcctagtcacttaccaatactggactagaatgttaactcttaattctaagctatcttaaaatggctattattatatacttcttggcttgggaagagcaaaacaaattcaatgttggtcatggcctggataatttcagaatgccaccggtatagcaagaggggtgacccgtgcttttcaacccttttacacttttacacgggtgttgtgaagcaccagttactcccttaatatttactcaagtggattaagaaagtttcaagatttggcagaatttatcaattggggctttcggtcctgaagtggtctgtgcggctttgcaagtgtccctttatttccacactttgaacagtggtaagccctgatgtcactgtgattgactcagctgggcatatg

SEQ ID NO: 700186 - DNA, 769 bp, Homo sapiens
agcggggggagtgggctatggccggagcttgagatacgccgctctgaatcttgccgccctgcactgccgcttcggtcactatctaacaggcagagcttcgccctgcaggaggcagattatgggattgcccaggattccaacgatacacgtgtgtctccagcactgtatgacgctggcttctatgtgcttggggcgagaagcgagatccagagtagctagtgttcgtgcatggagcacttcttgtgatagaacggcagtacatatttgggttaccgtacctcgcctccctgggaatacagtcccttgttctacagagagcttgttgctgggaagacgggaaactaagctgataggatgccctagagggactccgacctcctgcactgtgaatacatagaccggtcctagctcatcgatatcagatatcgcacagaaaacggtcatgtggaggctgtatggccgctggtaggtcgcgcctcaggccctggaggcgtagtgaatttctctagcatgaggaaggtcaggtatgctgaccaaacgctgggtatctgtgaaaaggccatagaatacaagatttacctgccttggatagatgtagttcctgcaggggactatgttttagactataaaacattttgtattttgcacagactgaaaacttttttcccatgcatgttccttcttactcctcccaagcactttgtgaggtaatgggtgggtgatctccatgctgggagagtaaaccagggttcacacatctgatctaacg

SEQ ID NO: 700187 - DNA, 1303 bp, Homo sapiens
  misc_feature (2)..(2): n is a, c, g, or t
  misc_feature (5)..(5): n is a, c, g, or t
  misc_feature (18)..(18): n is a, c, g, or t
  misc_feature (21)..(21): n is a, c, g, or t
  misc_feature (60)..(60): n is a, c, g, or t
  misc_feature (82)..(82): n is a, c, g, or t
  misc_feature (85)..(85): n is a, c, g, or t
  misc_feature (134)..(134): n is a, c, g, or t
  misc_feature (234)..(234): n is a, c, g, or t
  misc_feature (277)..(277): n is a, c, g, or t
  misc_feature (347)..(347): n is a, c, g, or t
  misc_feature (378)..(378): n is a, c, g, or t
  misc_feature (439)..(439): n is a, c, g, or t
  misc_feature (441)..(441): n is a, c, g, or t
  misc_feature (468)..(468): n is a, c, g, or t
  misc_feature (472)..(472): n is a, c, g, or t
  misc_feature (475)..(475): n is a, c, g, or t
  misc_feature (479)..(479): n is a, c, g, or t
  misc_feature (558)..(558): n is a, c, g, or t
  misc_feature (586)..(586): n is a, c, g, or t
  misc_feature (602)..(602): n is a, c, g, or t
  misc_feature (756)..(756): n is a, c, g, or t
  misc_feature (836)..(836): n is a, c, g, or t
  misc_feature (905)..(905): n is a, c, g, or t
  misc_feature (951)..(951): n is a, c, g, or t
  misc_feature (1014)..(1014): n is a, c, g, or t
  misc_feature (1016)..(1016): n is a, c, g, or t
  misc_feature (1018)..(1018): n is a, c, g, or t
  misc_feature (1126)..(1126): n is a, c, g, or t
cnctnttctcttttaaanacncaaccgactcggtaaccaacaccgacgaacgcgacaagngaaggtggtaggtgttgtgtantcnacgttagtcgtggcggcggctctgtccggcgtgatgacgcccgcggcangtactgggcgctgtaggtgagacgagtgatgacataatatcgtgccgtagcacaggcagtatcgcgtagtatgcgaagctgctatacatgatgaatgcgnggcgacggagcaggcgccgcggatccgggggcggaggcgcgangcgagcacgggtaagagcggaaacaacgcgaccaacaacgacccacacaaactcaacgaacccaccacgnccaccaacacatccacacaacaacagagacnagggaggacacacgagtgagtgtaggtgagaaggacgatgggaagaaggggtgagaaggananaggatcgacagtgcaccactccacgcntcanctntttntgcattagatatgtgtgacgtgagagtgtgttgggttgtgctggtatggtatcgcgcgtctgtatggtggggctacgtntgcagtgatatgacatatagtattaatnatgtaagagtgcactnaggacctcaatacaatgccaccaaatcactggatcactcgtaccttactgtatgttttagcataatagtcaatactattagtcgatgatgcctagtcacatccgagttccgcgaaatcgtattatcacttctctgctgtcctgctcgctgtcgntatgtggtggcgacgcgaggttagcgcacgcgttacgtcggagatgatgtgccacatcagctgctacgcggatgcccgcngcccgtagcgtagagtgcacatccgtaccttagacacgcgtctgtcgttgcatagatgtggacggatantggcggatcatctgtgtcagcgcacgtgtgtcgattcagaaggganaggacgagagcggatggttagtaactattcgacgacgtgcggtgtggcgcagcgatcgagtgnangntcgcaacgctacgcggcgacgatgcgcgcgtgtagcgctgcgagtgtggctcgacgcatggtgctgcctgtatctgctctcacgacactattgtgccttttgtgtacntcggtctggtagttccgtggagcgacgaatagagttgaaggaggaaggatgaaggtgagtatagatgtgggtgtgtttgctattagccctcatagtcactgagcgatgccccacgggtcccccgcttccgcacccggctgcgcgcggcgcgcggatagtggtttgcttctcgcctct

SEQ ID NO: 700188 - DNA, 179 bp, Homo sapiens
gcatttttagtagaggtggcttttcacctgttagccaggctggtctcgaactcctgacatcaggtgatccaaccgccttggcctcccaaagtgctgggattacaggcgtgagccaccgtggtaaaccgccttgtattaattcaatctgcagccacaagtccttatataatccagacatt

SEQ ID NO: 700189 - DNA, 306 bp, Homo sapiens
  misc_feature (248)..(248): n is a, c, g, or t
  misc_feature (254)..(254): n is a, c, g, or t
  misc_feature (275)..(275): n is a, c, g, or t
acatacacacacacatacatagtgattttaacagacaactcaatagcacacattctttccttttctaagctgtagtagttttgactttttgggaaagatacctgcttactgaggccaaagcaatttttcttcagtgactgtaatttgcctgtgtgactcgggtacagctctgaacataatttttacaaagtctgtgcccacaaaataggacttaaaatcatttaaaaatggcaaaaggacccaaaatngggacngggtgacctgggtgccttttnggggtgtccgggaaatgtttctcttctcctt

SEQ ID NO: 700190 - DNA, 130 bp, Homo sapiens
ttacagataacacaaatctaacctatattccagtgcttcccatgcagtcccctaagcagactcagctaccctttaccctccagatctcactatcttgtcttcactccttcttgtacttcttgaccgtcct

SEQ ID NO: 700191 - DNA, 130 bp, Homo sapiens
gcggtgaatagagcgggtactcgaggaaatactattttgggtcgagaggagtgaaaataaggggagatatgagccttataaaatttgttgaacaggccgggtgcggtggctcacgcctgtaatcccagca

SEQ ID NO: 700192 - DNA, 179 bp, Homo sapiens
gtcgatcgagctcggtccctaatatgggctatatttagaaactgggttcgacaaaatttacttctacacgatagctttgcacattaagtatattgggcctattaaaatttttaattttcagaatatcgtctgccacatattttagcaacacaaataatttttaaaaatattttctggtg

SEQ ID NO: 700193 - DNA, 279 bp, Homo sapiens
tgctggaaggctgcgggaggtagagcatatgttaatcagtggcgtgtaagcgtgtttcctgcaactggatgtcccggtttcgctgtcacccctctggaatccacgtatacaaaattccaaatgttagttgggcatagtggcaagcacctgtagtctcagccacgtgggatgttgaggtgggaggatcgcttcagcctggaaggttgaggctgcagtcagctgcgatagcactactacactccagccttggacaacagagggagacctgagcaagccagg

SEQ ID NO: 700194 - DNA, 1262 bp, Homo sapiens
  misc_feature (380)..(380): n is a, c, g, or t
gctcctactcctcatggtacccattctaatcgcaatggcattcctaatgctgtgaccgaacgaaaaattctaggctatatacaactacgacaaagggccccaacgtgttgataggcccctgacggggctactacaaccctttcgactggacgccgaatagcaacgtcttcacgcgaaacgagccgcctacaaacccggccatcatctagccattcacccgtctagcagtcatcggccccgtgacacttaggctcgtcaatccgatcgcatcgttctgtacatattgaaaatcccacccatccactcaataccctgaaacctcacctgggagtcaaactcctcgagagccttaaagacactcgctagtatattaactatcncaaagctcataggccttatgcccgtcgtaagctccaaatacccttcttagactcacagggggtcggaaggccaatttcagagaccctacaaaaatttgattcggcccctggatatacgggtcggccaactggccgaaggcaatagaaagggactcagagacaaatttctgccaatattggaaaagttcccacccccctgaaaggcgcgaatttccaaatttcctaaacattaaataccaaaacaaattttaaactctcaacgtaaataaacgttcggggcatgcaacctttttcataagcactttcctttcccaaaacccaccttataaattcacagcgataagcaggccaccacggaatatccaaccgctgttccctttgaaactttacatcggatccccgttggcccccaatgttccaattttgggaccccccccggtatgtggagggcgccatagtttaacacgacttaacgttcggaagtttgtacacttttcttgccccaaccggaaacttgagatggcgaacggaaaggaaacaccaaaaaatctccggagatagatccccaccacgcagtaattcgacggaatcctttgatggaccccagcgaaaacgggctgcggcaaaggttcccccgtaagacattctttgaaagggttcactttcccaatgacggttccttttcactagaccggaactttccgcaacaattaaaactggccccccggacaacgggggacccccgcaaaatacctgcgctcccctaaaatatgttccgttctcgcaattaagaacccggcaacaattaaagcagatccaataggacgcccgttttggagttttcacttcggccttcaaacatgcaaaaccgccctttcatcc

SEQ ID NO: 700195 - DNA, 243 bp, Homo sapiens
tagcgggatattgttgacccacgctgtctgtgcatgtgttggactggtgctgtgctgtgactatgcacatgagctggggtgagcttgctcagttgagtgtggatgcctggctggcgggacgtgtgtggatcctgtgtggtgagcctggagtccctgccgattggtgtggctggagtgtggagtgggccctgtgcgaggccgcgatgaagcctgagcggcgaggaccatggctgtgctgcttgc

SEQ ID NO: 700196 - DNA, 464 bp, Homo sapiens
tacagtgatgcccgggagatcgagaccagccgaggcacatagtgagacccgcatatcgctacaaaaatacgaaaaataaaaatacacggggcgtggaggtacacacctgtaatccacatctacttggaagacagaggcaggaggaatagaggccagaaattcaggtccagtctgggacacatagtgaggacccatgtctaataaataattcagaattttataatttaaggtagttcttcagcaagccatatgttttgtgagatgcaaaacaaatataataactttgcatatctcagatattatgacatgatacgtaattcaagaagtctgacatatattctaaagctagtcttgactatcagcttgttcctgtcggactcaagaacgcggaagaaaggtgcctgacaatgtcagagaactaaaaaacattcatcggatcaggaacgcatcactcttacaaagct

SEQ ID NO: 700197 - DNA, 127 bp, Homo sapiens
cacggcatacgaagggcattgaataaatcagtcaaaatgcacaaatgacatggacggatacatagggcgaaaattagtatttgtacttgtatgatacagacacgagtcaagaattccgtgctgttaa

SEQ ID NO: 700198 - DNA, 126 bp, Homo sapiens
agagctactccaaggctataagttaagaggtgaagatagacaccagaagcacaaactagggtaacctttggatagccaggtgtggtggtgtgtgcctaatcccagctattcaggaggctgaggagg

SEQ ID NO: 700199 - DNA, 262 bp, Homo sapiens
aggcaataatggatatttcctttattggctatttcctacagagtgaaaggcaagcctaatgcagttttatatctattctcttaaatgctgaatctaaatgttagcatatattactgtaagccttatgatttgaaaacccaaataacccctctctggatggaaatgggagcctgagacttttccttccttttttccctgccttgatttatttattccaacgcactgggttttacatgcctgttctgggccctaggcatgatgg

SEQ ID NO: 700200 - DNA, 478 bp, Homo sapiens
  misc_feature (38)..(38): n is a, c, g, or t
  misc_feature (67)..(67): n is a, c, g, or t
  misc_feature (74)..(74): n is a, c, g, or t
  misc_feature (94)..(96): n is a, c, g, or t
  misc_feature (100)..(100): n is a, c, g, or t
  misc_feature (105)..(105): n is a, c, g, or t
  misc_feature (132)..(133): n is a, c, g, or t
  misc_feature (137)..(138): n is a, c, g, or t
  misc_feature (142)..(142): n is a, c, g, or t
  misc_feature (144)..(144): n is a, c, g, or t
  misc_feature (156)..(156): n is a, c, g, or t
  misc_feature (160)..(162): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (203)..(203): n is a, c, g, or t
  misc_feature (205)..(205): n is a, c, g, or t
  misc_feature (208)..(208): n is a, c, g, or t
  misc_feature (212)..(212): n is a, c, g, or t
  misc_feature (214)..(214): n is a, c, g, or t
  misc_feature (216)..(218): n is a, c, g, or t
  misc_feature (228)..(228): n is a, c, g, or t
  misc_feature (231)..(231): n is a, c, g, or t
  misc_feature (280)..(280): n is a, c, g, or t
  misc_feature (291)..(291): n is a, c, g, or t
  misc_feature (319)..(319): n is a, c, g, or t
  misc_feature (333)..(333): n is a, c, g, or t
  misc_feature (341)..(341): n is a, c, g, or t
  misc_feature (354)..(354): n is a, c, g, or t
  misc_feature (360)..(360): n is a, c, g, or t
  misc_feature (388)..(388): n is a, c, g, or t
  misc_feature (395)..(395): n is a, c, g, or t
  misc_feature (397)..(397): n is a, c, g, or t
  misc_feature (412)..(412): n is a, c, g, or t
  misc_feature (418)..(418): n is a, c, g, or t
  misc_feature (467)..(467): n is a, c, g, or t
aaagagatctaattgagaaaatatacaaagcatttaanaatttcatccccagaaactgattgaaggngttacanccctcctctccaaggctcannnctgngatcngttagcatattgaatgatcagtaaaannatgnnaaantnagatgggaaggngaannngtgcattcccctaagctgagggggatggtntttttnancanangtngttngntnnntttgttccangtngctcttcctttccctctgtgttatctttcaaaacagttccaagcttggngaaagcaatgngctccacctactcagcagatcccacggntcgttccccgtggncgtgactnagcagtgaccttncctgcnccgttcctcagccgcccatcccactgcnttgactnangggaccctgcttgtnctcctngggggcaggactgggggtcctaactccttgcttcttttgttccactcanaaaacagttgt

SEQ ID NO: 700201 - DNA, 208 bp, Homo sapiens
atcttagaggattccccctggggactccttatttaaaaaatcttttttctgtttttgtcttttttgcaactggattcttgctgctatctgcccaggctggtctcaagaatcctggagtctctagcgatccttcagcctcagactgccctgagaactgggattatagacgttagccactacacctggccgatgtgcatttttaataagg

SEQ ID NO: 700202 - DNA, 241 bp, Homo sapiens
  misc_feature (12)..(12): n is a, c, g, or t
  misc_feature (36)..(36): n is a, c, g, or t
  misc_feature (127)..(127): n is a, c, g, or t
  misc_feature (182)..(182): n is a, c, g, or t
  misc_feature (209)..(209): n is a, c, g, or t
  misc_feature (222)..(222): n is a, c, g, or t
tggggggacatngagtcacgaaagcaccgtagactnaggtcgttagaggagagacgagtttgaagagttcctgccgagactgggtggttagatgaagtgagtgacatgtctgggggtaattgggatntgcaatgtagaggtgcttcttaatcagtacgtgtgagaaaagcctagctgtctcnaaatggctgtgtctctcatggcttggnccacaagcagtgnggcacactggcgagtgcca

SEQ ID NO: 700203 - DNA, 399 bp, Homo sapiens
tacgacttcgagggcgagcgcccactggtggtcatagaggacgcacatgaacttgagcgacatggaaaacagaattcatactatcgttacgcaagcttccaggacgtgcacgtgatggtcttcgtgggcttcggattcctcatgactttcctgcagagctacggtctcagctgccgtgtggcttcaacttccgtgtttggagtcttcggcatccagtgggcgctgctcatgcggtgctggttccacttcttacgatgatcgctacatcgtcgtgggtgtggagaccttcgatgaacgctgacttctgcgtggcctctgtctgcgtggcctttggggcagttctgggtaaagtcagccccattcagctgctcatcatgactttcttccaagtgaccctct

SEQ ID NO: 700204 - DNA, 203 bp, Homo sapiens
atacgcaatctacaccacagttgatgagatctatctcggggatactctacaggctagccgtactcccgcacgaggcagcgcaccttcacaggagtgcaggaacatatagctgtccatcttccgcatgtgtaacaaatagtaacaaggcagagctgatgaaggcgtgtgacagcctcgacttggtgatgaggtacctgcatgga

SEQ ID NO: 700205 - DNA, 179 bp, Homo sapiens
atattttacagaaaattggggctgggcgtggtggctcacacctgtaatcccaacactttgggaagccaaggtgggtggctcacgaggtcaagagatcgagaccatcctggccaacatggtgaaaccccatctctactaaaagaccaagatcagcctggtcaacattgtaaaacccgtct

SEQ ID NO: 700206 - DNA, 399 bp, Homo sapiens
cacgccgcctctcgaagccaggctgatgacatgagggtggagggcgcctttcccgtgaccatgctgccaggcgacggcgtggggcctgaactgatgcacgctgtcaaggaggtgttcaaggctgcctctgtcccagtggagttccaggagcatcacctgagcgaggtgcagaatatggcatctgaggagaagctggagcaggtgttgagttccatgaaagagaacaaggtggccatcattggaaagatccataccccgatggagtataagggagaactggcctcctacgatatgcgactgaggcgtaagttggacttgtttgccaatgttatccacgtgaaatcgcttcctggggtacaagactcgacacaacaatctagatctcgtgatcattcgaga

SEQ ID NO: 700207 - DNA, 563 bp, Homo sapiens
ccaggagcagaagcagatgctgggggagcgtctgttcccgcgttatccaaacaatgcattcaaacctggctgggaaaatcaccgggatgctgctggaaatcgacaactctgagctgctgcacatgctggagtcccccgagtccctccgctccaaggtagatgaagcggtggcagtcctgcaggctcaccatgccaagaaagaagctgcccagaaggtgggcactgttgctgctgctacctcttagacaagaaaaaaagagtcgaaagccaaataacccctcatggcatccagctaaggtctgaagacatcctagtttgtctgtggacctccacaccaagaaccaagttgcaaattcaataggtcatttgtatcagaaggtcaattatgaagcacctataagtttttcaattataagaatatattctctgggttctgttgtgacccagatgataacttttttttttctattatgggttctggttttttttttccctcatcccagaaatgggttttgatgtacccaagacttaagtttctcaaataaaggaaataaaatctccat

SEQ ID NO: 700208 - DNA, 236 bp, Homo sapiens
  misc_feature (13)..(13): n is a, c, g, or t
  misc_feature (76)..(76): n is a, c, g, or t
  misc_feature (89)..(89): n is a, c, g, or t
  misc_feature (151)..(152): n is a, c, g, or t
aatccttggttcntcaggggttaagtgctgtgtgcctcatgaggggttaagagctgtgtgcataagctggttcatntttcaaactcctntttgtttgcctcttgatggttcagaaacattcagctgctttcacctctaggccaaatgcttnngattttactctcatcaacattggaactttacgaaaacaggattcctggttcatcagaagcctgttttaatgaaaaatgcatttt

SEQ ID NO: 700209 - DNA, 394 bp, Homo sapiens
atccggctccactggtgctcagtgtgtgcagcactctttcagaaaccagcatggagcactaggtacccagaggtgtattgtgattttcttggctactttctccaactttagaaatagatgaagtgaaatagtttcttctacctattacctctggtgtactggaggggatatctgggatcatgctttcttataatttctcttatctttccctcagataccttctagaaactaccaagaaatattcagctgacttgcaggaatactttttcagtaggcagataaaccatataccccaaagtaatatgtagctttctttctttctttctttcttttttgagatggggtctcactctgtcacccaggtaggagtgcagtggcgcgatctcagctcact

SEQ ID NO: 700210 - DNA, 448 bp, Homo sapiens
tgcgtgatagccaaactactggatgctgggaaggaagagtcctcgctcatcaaagcatgcaacttttccaccattgctctaactcttctttacttccctaatcttcataagttgttttgcctgaaatgtacaccctttccggcactggaacgctgctcttcctcttgccattgtctccctgtgaaatttttatcctcctaaaatcatgccatcatgacctcgggaagagctatgccaaccagatgggttccctgtgattccagcatatgctcccttagagacaccagagtccacagaatcatggcggaacagggagggctggtgccaagaatctcctgcagttcgtaggggaccattgttaaaaaaaccatcagaggaattatgtcgacggcggcttactccaaatctaccttctcctctgggtaggacacgaatgttcaggggatcc

SEQ ID NO: 700211 - DNA, 723 bp, Homo sapiens
atgttatgttcacttccactccatttacgctcctcatactaggctctactgtctccacacactttaccatatacctatgatggcgcgatgtgacacgtgctcgcacataccaaggccaccacacaccacctgtcgcgaaataggccgtgcgatatcggcgatgaatccttacttattacgctcacaagtgttattctcttcgcagggatttcgtctgagccttttaccgactccagcctagcccctactccctcctattaggagtgcattggcccccaacaggcatcatcctccgctaaatgcccgctagaagtcgccactccttatacacatccgtattactcgcatacaggagtatcaatcatccgtgacgctcaccagtagtctaatagaaaacaagccgtaatccaaatgtattcaagcactgcttattagcaatatttactgggtctctatttttaccctcctagctcgcctcagagtagcttcgagtctcccttcagccatttccgacggcatctacggctcaacattttttcgtagccacaggcattcgcacggacttcacgtcacttattggctctactttccatcactatctgcttcatccgccaactaatatttcacgtttacatccaaacatcactttggcttcgaagccgccgcctgatactgcattttgtagatgtggtatgctactgtcttattctgccttatagatcc

SEQ ID NO: 700212 - DNA, 200 bp, Homo sapiens
ttttaaaatgtgcaaataaggtaatctgtattcagctttccagagtagtggcatgtgtttttcctttgctctctaatagtcatctaatcagggttcttacaatagcaagatagcaatttatatcactcagtatgagccctagttatttccattaagttttagtttgtaatccatcctccagtaggtagaagaatgacttc

SEQ ID NO: 700213 - DNA, 140 bp, Homo sapiens
aggacaacatagcatgcatgcttcttcttgttggttcgacttagaggatcccgtagaatgggacactaagtggttctcatccttaagcttgcagggccaatgtgctgccgggttgtggagaaggaccggtgggtaccgag

SEQ ID NO: 700214 - DNA, 263 bp, Homo sapiens
gagctcagatgggtctcattatgttgcccaggccggtctcgaactcctggcctcaagtgatcctcccgcctcggcctcccaaggtgctggtaccacaggattgagccaccaagcccggcccgaatataatttttaattttttttttttaagacagagtttcactcttgttgccttggctggagtgcagtggcacgatctcggctgaccgcaacctccacctcccgccatcttgagcctgtgtctccatcttgagcctgtgtct

SEQ ID NO: 700215 - DNA, 779 bp, Homo sapiens
caagtagctacatatatggcattcagcccattgtttctcctttagttggtagtgctggccctgccatatacctagctgcctgcttgtatttctttggtctttgcacagaggctgatctcacactacactcagcgtggaattagcttttgtctcgcagagcagctgttttagatgggaaccaaggtgtcatgctcttgccctcaagcatctgcttagggttaaatgatgaaccggcggggtgctgagatttggcaatggtggctgcatccttaagcaggccttcaagactccagagagacatgaatttattcaggtgaggaagggagcacacaggagacagagaggactcagttgggccactcgagacccagcccagtctctgcttcctctgccaacatctttgctaagccttcagccagaacagctatggtctgcgaagattaagtaaagaaaaatagcagctcctcctcctccttgtccatcagtgtgtgctcagactgttgtttgatcctgtgggctgggggtcgtgagcggcataccagtgtcctgcctctcttcttcttgatctcagcctgggcgcgcgcccgggcccgctgcagatgctcctcctgtaggatcttttgcatctggagcttctcttctcgaagtctgatgcgccgctccttctcctttgccctctcggcctgctcgatcttgacctggggcacgtgctccaggttctctagcagctcatccagctggtgctcaatgatggtcagcatctgcacggtgcccaggtt

SEQ ID NO: 700216 - DNA, 317 bp, Homo sapiens
tgaaataacaaatcacataaaagttcttaacaatcccctctttcgaagtgcatttttttaaagcagggcacgagacatttggactctagctatatgacatactgggaaaggcagagggtgtacggactatttaacttcatggtctagcccataatatctaactggctaacgaaaccattataatgctaaaattgcgtcatttaacactaacaatttatacttgttaaaccgagcatggaataatggctggataactgtcaaagtaagcgccgaatccataaggcttctaacttatttaaaattggtgtgtcagtttt

SEQ ID NO: 700217 - DNA, 1022 bp, Homo sapiens
  misc_feature (903)..(903): n is a, c, g, or t
cctgtagtcctagctacttgtaaaggctgaaccaggagaatcatttgaacccaggaagtggacgttgcagtgatctgagatcgtaccactgcactccaacctgggtgacagagtgagacactgtctcaccatgaaaaaaaaaaagggacactgcgggcgcaaaattggaatcaagggtcctatatataattcacgataatcagcttttattatctaagtcagtagaaactccctctggtaaattccctggatttcggatcaatgcgcagtatgggtcatcggaccactttcaaaataggggacacatggggtcacgtggggtaccacgtgggcaataccctagggtattaatctggggcacgatatttattgatgtcataaccaacaacattgaaaactaatttcccgcaaattgcaacgcgtcatcaccctcttctactatcattacagcgactactcggggacccttacaaaccacagtgtcctacaaccccgttgtgtccttgaacatcccaatagggacccaaggacgagggtgtactaccacaaaagtgcctgcgaaacgggtctccccacgggaaaagaatacaggcaagggtctaacgttcctgcgcccgggtggggcaataaaagcatgttctcatcctttttcatttaaccttacaaacgaaccttaaaccaatggttagggtcgaaaaggctacaccaaagaactataaaccggactccataggggtgttgcactgtccatcatggctcttacgagaacaggaggggcagcttacgttaccatcggccagggtgatccgagaaatgaaggtcactgaacatcttaaaaaaagggtgacgaccacgtgcgctacatgttgtcttcctccatcatctcatactatctcatacccnggacacagacaatgacatcaacgagacacaaagaacaaaagaacaaacaacaagattatgatacagacgtaaaagagagcatataataacaaaaaaaaaacgaagagagctcgatacca

SEQ ID NO: 700218 - DNA, 165 bp, Homo sapiens
aaggaaaggagaatgttatgtggaccactttggtttgctttttcgcgtgtggtagttttacgttattagtttttaaaatcgagtagctttttaatggaaacaacttgaccaaaatatttgtcacagaattttgagaccgcattaagaaaagttaaatgagataga

SEQ ID NO: 700219 - DNA, 169 bp, Homo sapiens
  misc_feature (65)..(65): n is a, c, g, or t
  misc_feature (164)..(164): n is a, c, g, or t
atggaaaaagcgtatattaaggaaaggtaggtctaatggaacaaagagaaagaagatatattaancccttcttatacaatggtattcattaatgaaactggccagaaaaagggaactggcagaagaggggactctttggaaggaaaccaaggtctggagggaanccacg

SEQ ID NO: 700220 - DNA, 220 bp, Homo sapiens
agcggtagccatgctcaccggtgagctcaagaaggcactcatagaggttctgcagccctggatctgctcgagcttgtggtcggtcctcggggaacaaggtcaggtacatgaaagacactgttgacatcacaggttcgcccccatgcgaggggtacgcgagctcgcaattctgtaattctatggtctatagcgtgttccgaagtatcgagtaagtgtatca

SEQ ID NO: 700221 - DNA, 166 bp, Homo sapiens
gactgtgaagacagcacatccaccctccacctttagcccagacacccccatttgtacttataatcaagagaaaagctctaagtatctggcattgccatagggtgctttagtgttaaaagaaaagtttgctgaaaaagtaagatttcttgtgcctggttaaagaaga

SEQ ID NO: 700222 - DNA, 350 bp, Homo sapiens
ggggttttaaaaaattttttttttggccccccccttttaaacaaaaagaattccccccccccctttcaggatttttttatccccctggcaaccatttttccaaggggttcccgggtttagaaaatgggaaaaagggcccctcccccttcaagggaagaatttgggggtttccccccccaaatttgaggggtttggcccgggaaaaaaattgccccttttttttagaaatttatttttttcttggggggtcatgaaccgggccaacccccggggggaatttttttgttttgttttttatttttttggggtttcctccccccggggattttgaataaatgggaaaaaaggca

SEQ ID NO: 700223 - DNA, 240 bp, Homo sapiens
cccaaaaagacccccagaacaccggggcacaacgaaggccccgccacaggggccccgggcgggcaggagcctccccgcagaaccaaccggggccccccaggagggggggggacagcggaaggccaggaccaagaggacaggcaccccccggggaaaaggcccgggaccacccccccccacccccaaccaccggcacagcagagggagacgcagcacaggagcggcagagagacgcacggg

SEQ ID NO: 700224 - DNA, 908 bp, Homo sapiens
  misc_feature (118)..(118): n is a, c, g, or t
gaccagcaaatggcgtgattgaagcacttttggtacctgatgggggagcagtcgaatgaggcactccacttttcacactcaggaaaactggtgctgctcctgctaaggccaagccggnctgatagtctcctgcgtgctgcagtcccaagaagcagaaacctacagcagcggcagtttcctcccccttgtcagcattccagtaccctatctcagaatgccaccgtatgtccctcgacctcatcactaagcctccttctggcaaacctgatgtctgtcaagtaaaatcgcatctgtatgcgcccatcctacatatgctgaagtcgctaggtagtctcgggcataaggtcttggcgttcatgatacgatcgaggtagagaaagtgagacagtgatgccggcagtcgcgattgctcagacgatctgaaggatggcccagaatacatgtgcaaatgctgacaacttttaatgagattgacctgagtaacatccaggagatgagggctcggcacaaagaggcttgagggaagaaacataagcctcaaagctaggcttcatgtcggcattgtgtgaaggcctcagcctttgccttgcagggaacagcctgttgtgaatgcagtgattgacgactacaaccaaagaggttggtgtctagggattcactattgacatcagtgttgcaggtgggcaccgcaaggggtctggatcatcccagtcatcaggcaatgtggaagcttatgaatcttcgcaagactattcgaactggaccatccacttgacctggggcagactcacgggccctgacagacttgacctgtggcaatgagggatatgggactggtgagtaccttctaccagataaggcattgaaggcgttcggggttcgggcttggaacgcaccatatcaacccc

SEQ ID NO: 700225 - DNA, 377 bp, Homo sapiens
  misc_feature (287)..(287): n is a, c, g, or t
aaggggaaaaccccctttttttacccggggtttttggggggggggttttttgggtttttcccctctttttgggggccttttttttttgaaaaaaaattttccccttttttttttaaaaaaattttccaaaaaaaatttttttttttgggggggcaattttttaattttttaaaggggggggggtttattttcctttaaaagggggggggtttttaaatttttcaccaaaaaattttgggggggaaaaaaatttttttttggcaaaattccctttgggtgggggtttnagggggaaaaattttaatttttaaaaaattggggggccaaaaaaaaaaacccaaacccctgggggttaaattttgatttgaaaaaaaaaa

SEQ ID NO: 700226 - DNA, 935 bp, Homo sapiens
ctggcccgtgctttaagagggttaggccgcatgaacccgggttgtgccttgtgagtgaacggaccgggctcagatttgtggcgaacagttagcccagtctcacgggaacctcttgaattaattgaggggaattcgtttcctttcgcgaatgatgaaaataggcttctagttttatgagagctcaccccgcgaaaccacaccgttggcctaggggagtcacccccccctgtgtgtttcggttggtagtaacgtgagattcgcacgttgtccaaagcgttggcgcatcaccacatgtttctttagacctggataatcccggctggcaattctctggaccctttttgcttgacctcagctgcgatccattctcacaggtcttgccccgatttcgtgctagcaagctaccccattctggagtgcaggacgtgaaacctcttggtcctctgacctccatgtaagctgggggtctgtctaagttgaacagattctgccctatgttggtcaccaccaaaagaccaccgcccagacattgtttaagcccttacgctcactcgtcagcagtgagtcttgaggaaattcataacccacggcactcccatattccttgtggaggcctaggcgaacaagtgacagtagggtatattaaatttttgtggctcttggtagggacgaactacccatattagatattcttttaaatctggcccttttttataccaattatgctccatagttcacacgaggttactgcagtcacgctaatttaagtaacaactataatgtatgtgtattaccataattttaggaaggctgcagaatccggcgtactgagtgctttttgataagtctccagttttaggtccatataggctcccttctgtgcattctgttctttgccaagacctgtttgaattaaaaagacaattttaaaacca

SEQ ID NO: 700227 - DNA, 683 bp, Homo sapiens
  misc_feature (323)..(323): n is a, c, g, or t
ggaaaaaacaccccttctctccctgaataatttttttttgttgttgaggggggaggggttttttaagcgggggggcctctctttttaaagaaatttttcttttttttaaaaaaaaaaagaaggggggggcaaaaaaaaaaaaaaattttcccccccccctaacaaaagatttttttaaaaaaattttttttttttttaaaaaaagagcggggccccccccccttttgtgttttctcaaaaggggggggggggggggttttttttttttttgaaaaaaacaactttttttttccgggtttttttttttaaaaaaaaaaaaactnctttccaaaaattttttaaaaaaaaggcccccggggaattttttttcacaaaaaaagggaaaaaaaatttttggccaatttttgcggccccccccccaccccaccttttttttaaaaaaaggcccttccccccccttttttatatttttctaaaaaaggcccccctttgaaaattttagaagaaggggctctcccccccggggttttagaaatttttttcccccaaatttttataccagggggccccccccttttttgggggtttttgggaaaaacccccccctggaataaacccgggttaaaagaaaaagaaaggggaaataaaggtttacccccttctgtgggccaacggcggggggg

SEQ ID NO: 700228 - DNA, 100 bp, Homo sapiens
ttttgtggactggccttctctttatgtttacatttcatttccccaaaatgttcagtgacttgagatcaagtccctgtgcctgtacgtccgacaggaagtg

SEQ ID NO: 700229 - DNA, 182 bp, Homo sapiens
ctgtgtacgtagttgccactgatgactgggctgtccttgggcctatatatacatagctgttggaataaaataatcacagtactttccagtcagtcagtccctggtttcctagaatttgttctaacccaatgcaagatatctatattatcctcccattgggctataatcagtgttcgtaaact

SEQ ID NO: 700230 - DNA, 280 bp, Homo sapiens
cgcataaggaacacctggacttcctgcctcacgtggacagcgcggatggtcgccgagttagggcggattgctgtgcgaattcctgagacgcggcgcaaacccaaataatctacgaaggccccgccagaaaactcaatgtgagtagtgacattgtccatcctggtgtgcgcaggcttagcagtaatctcctcactgacagctcaaagctcatgatattctgaactggatttccaagactctgtactggtcctgggattctctgaagaattacacgaattgt

SEQ ID NO: 700231 - DNA, 794 bp, Homo sapiens
agtgcccattactggccgggggcctctcccttccacatataccttggggtcgagcatgaccgtgctgggtgggtgcagaggggtcacctcctctttcatgtgtacgtattgctacagtaaatcattaagtttacaaaacctgcaagaagatacgtggctgattaagatcaggcaacttggggatactaaacacctgggggaggccgacgacgagccgcgattaaactatctgttaaggaccccccgcctcccttgtggggagcgcggaggtccccccaaaggagtgttcagaccagcagtcgccacgatatagttcacccacgaagaatccccctgtggcgaataagcacgaggggacggcgggagagtttattctccgccagagtaaaaaaacagaggcgcccttgtgggggccacaaagcccaggggtatctctgttacggccaatagacacttccacaaggcggtactacctaagaaggagcctatactcggggggaaacttaaccaaaaagggagggttatacgcgagcgatcttgagctaagagaaaataataagccccaccgcgcccgtgggggtgtaatcattacaatttttacgaaaacacattccttgtttcctacaaacaaatttccccaattcctcgggcatggtaacccagaattttcggttgtctcatatactaaaacaagaagccttgaccttgacattatatttaaaataacctttgtactacacttttatcacccttaacctgggtcatagaaatactctaccaggttataaggctca

SEQ ID NO: 700232 - DNA, 154 bp, Homo sapiens
ggctgtctctaccatgaccaaagtatcctaccttccacccaagctgacatcgtcgtcaggtaagtctggtcaaagtgtataacgacattcctcatgcaagcctacaggacagggtttacgagctgagatcatatagggataatgcttggttgag

SEQ ID NO: 700233 - DNA, 551 bp, Homo sapiens
agatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttc

SEQ ID NO: 700234 - DNA, 240 bp, Homo sapiens
gacagaacaaataggacatatgtatatatgaaagggagtttattaaggagaagtgatttgcaaggtaaagtcccatgataggccatctgcaagttgaggagcaaggaagccagtagtggatcagtttgaattccaaacctaaagagtgagggaagccaacaagtgcaacattcaatctgtgtgccaaaggcccaagagccacaggcaaaccagtagtgtatagtacaggagtgcacaaag

SEQ ID NO: 700235 - DNA, 217 bp, Homo sapiens
tacccccccggttactgtcttacggcccagagcacctggcgtgatcccccgcgctctcatggacctcctgcggttcacaaggcgaggagggtgctgagggtcggccatgggctctctctgtcaccatttcctacttagagatctaccatgacaaaggtcaggctcttttctgcactctatgaacgaagagacgaccggttaaatcagcacttatctt

SEQ ID NO: 700236 - DNA, 195 bp, Homo sapiens
ttctgtattcatcacttaaaattttaattttccgggacctcaagtacatttgaccatgctgctgttgtaccttaacaaaactcagtgataccgatatttgatctattaaaaatgctctttttgaggaaaaaggtttggaggtctctgattagccgaagtttgatgtgggcctcccataggaaatttggggcccac

SEQ ID NO: 700237 - DNA, 938 bp, Homo sapiens
gggaggaagatgatatcaccgattctagcagcaaatggcaaagacgagactacctgcttctggtgatggagggcacagatgacgggcgccgtgctggaggtatgatactgtgaccaggaagtaaaagttttattggaccagctgcggttcccgaatggagtccagctggtctcctgcagaagacttgtcctggtggcagaaacaagcatggccaggataccgaagagtctacgtttctggccatgatgaagggctggggctgatctgttagtggagaacatgcctggatttccagacaaacatccggaccagcagcgtctggggggtactgggtgggcatgtcgaccatccgccctaaccctgggttgttccatgctggattgtcttatctcgagagaacctggattaaaaggatgattgttcaatgctctttagtcgatagtagacggtgatgaaggttgtgccgctggtacggaagcctcgtcctagaagtcagggacaggggtgccttccggagaagcctgccatgagtcccagatggtgctggtggcccacctacatcagcgaggtgcagcgaacacgatgggcacctgtacctgggctctttcaggtccgccttcctctgcagactacaggctgcaggctgtagagccctccagatagctggccctggcaaggcaggcatggagtcttcgcactcaggcagcaacgcctggtccagcgaggagctgggggacacaggcgtggttccagtgtgcaccatgcaccctgtagtccctgaggaagtgggggggaacgggcggcgacacaatcccgaggaaggcccgggcccccggggtggcgccagctaaggaaggggagaaattgccggcggaacaaaatgttaggcctttcttaaaaaaattctgtgaagacccacagaagagaagcgcgcatga

SEQ ID NO: 700238 - DNA, 111 bp, Homo sapiens
agaggatcccgtggactcacgcgggcacggtgcacggttcacgcctacatcatcagctccctcaagaaagagatgcccaattgtctttggtaaagagagcaaaaagaaaga

SEQ ID NO: 700239 - DNA, 256 bp, Homo sapiens
aggaactgatcgaggataaagggtgtgaaccaagaataggaagccatcaggggttatcagaacatgagctgaggaaaaatgatagagaacaagccgaccaatactgggattcccgaaggaaccggaccaaccccccccctggtgatggaaacggcccttccacgggcggcttgagcccaacccttttaaaccccccccttttttccgccccgggccccccctctgcaggggggggctccccccccttttccccccc

SEQ ID NO: 700240 - DNA, 154 bp, Homo sapiens
aaagtcgcgagtggcttgatgttcttgggagaaaaataaacactatgaccctgcttgtcttactattcctgcaagagaacactactttggacagaaacagaggatgttggctgaagaactgcctaacagcaaataaattaactatggaaaacat

SEQ ID NO: 700241 - DNA, 1500 bp, Homo sapiens
  misc_feature (23)..(23): n is a, c, g, or t
  misc_feature (1019)..(1019): n is a, c, g, or t
atcgagttggctcttggtcttanttcagtcctctcgcgtggctctgttggtggaggtacagtcatctctggttgtccgtgcgaccgaggtagtcgtagttctatctgttgctgcatgctgcggccgcgatgtttcgttccttccccccgctggcgtgttatgcttgttctccgctctcctctgttttgaggaagcgtctctgacgtattttgcccacgagaggaggggttcgttctctattatcgtgggaactactaggggtcgttcgtgcccccttggagaaattgtttgtgcccctctctgtgtgtggtgggggagaaggtagtttctccccctcttggggcccaaggtgttttgaaaagcgtcgctttgtggggttttttaccgccggcccgttagcacagagtagttcccgcggcgtggtcgccgttttggggtgggccccgccccccaacgtaccgggatgggtttttggcgccccacctagtgggaggagaattctcttttgtatgcgcctctcctaggcgggtgaccccaaagccgggggcgcccacacgggacatattcttttgcgtacagacgagttcactttatgtgcgggaagttccacggaaaggcgcaacgcatttgtggaaaaactgttgtagtatttcggccgcgtccctcctccctcttgtgtgttgccacgggggcacccatagccttttcggaccggcaatttttatagggtagaagtatattgcaaaggaattgtattgaagcaccccggcttttttggggaattcctcttggctcgttgggttttctgggtctgtggaacaccagcacacgccttttcgggtctcacgcggttatactcttttgagcccggagccgctttaaagcacatatttgggaagatatatgacatatatgaaaagaaattgcgtttctcgccctccgttttttgagacaccttgagcccctgaatcgccaaaagggtggagaagaaacgagcgccccgaacagagaggaaaccnccctgagaagaggaccaccccacgagaagaccacccaccacgagatgacccccacgaggccacacgaccgcgaagaatgaaagagaatatggagatgtttggggagaccacgaatgagaagaaagaaagataaccacgccacacacaggaacttctaccaccgctgagaaacagagtgagattgtaaaattataacttctcacccactttggagtcctcttgtggagagcggaaatgtgaaatttaccactcactttctcttttgggagagacacttgttttggaatggccccctataatccccttctcccctgcacctgtaaaatgtgggattattgggtcacccgggaaaagtgggttttttagttgaattttttttaacacttcctcactgaaatgtaaagtttgtactatttaactgagctattcttgaatgtaaaatcttgtcatgtgtattaaaattaaaaagatcccccaatta

SEQ ID NO: 700242 - DNA, 145 bp, Homo sapiens
cccctgttatatacactacatcggcgtctcatctgcgggagggagctgtgtgtgtgtgggtgtgtgtgtgtgacggctgatgtgatgcgcggggggcgcgtgtgtgtgtgggtgtgggggactcctctacagtcaccctgcacgg

SEQ ID NO: 700243 - DNA, 166 bp, Homo sapiens
  misc_feature (160)..(160): n is a, c, g, or t
  misc_feature (165)..(165): n is a, c, g, or t
aagacggggtttcaccatgttggtcaggttggtctcgaactcttgacctcaggtgatcctcccacctcggcctcccaaagtgctgggattacaggcgcgacacatgcgcctggccccaagtaaactaattgaaaatactctggggtagtttctgtaatcngtaant

SEQ ID NO: 700244 - DNA, 131 bp, Homo sapiens
  misc_feature (44)..(44): n is a, c, g, or t
  misc_feature (64)..(64): n is a, c, g, or t
  misc_feature (69)..(69): n is a, c, g, or t
  misc_feature (76)..(78): n is a, c, g, or t
  misc_feature (81)..(81): n is a, c, g, or t
  misc_feature (90)..(91): n is a, c, g, or t
  misc_feature (95)..(95): n is a, c, g, or t
  misc_feature (115)..(115): n is a, c, g, or t
  misc_feature (119)..(119): n is a, c, g, or t
  misc_feature (130)..(130): n is a, c, g, or t
agcatcaaataccactcctctccccgccaaaaccaaataaaccnacccaactctttggcaacanttgtnttaaatnnnatnttaggttanncttnttttttgttcctgggttggntcantgctacatggnt

SEQ ID NO: 700245 - DNA, 166 bp, Homo sapiens
ggacccctaggatatgtcgtgcaggtatagctgaaaactgagacattctgtgacaattaaaaatgctgctcttttgtaattttatcgttgcttcatgcattatcggcttagtgatgctgaatcagattgccatactatggcaagatctctctgccagggtctttat

SEQ ID NO: 700246 - DNA, 250 bp, Homo sapiens
atcgcgaatcacctatgttctttttactttggtgctagactcagggaactgtgcatcaccctaccaccagaagttaccaacaggtttctaagagcatttttcatgcagagctattcccaagaattatggctaatttgagggcctttttggataccaccttttggcacaggaggttaaattgcctttagcggtgaatgttaaatgtataatgccagactgggaagcacactggcacagggcaatcgcgaag

SEQ ID NO: 700247 - DNA, 224 bp, Homo sapiens
  misc_feature (59)..(59): n is a, c, g, or t
tatgctatagctgactcctgaggatcccccacacgccccaaaggccagtctctggccgngatgttgctgctcgttgcgcttctggcgccgacgttgttgttggtcgcggtttgcggcgcgcgggtgggcgtgtggagcgctgatttcagtctgggcgtgctggccctgaaagcggggcgggtgctggcctatctgggcttggcggccgccctggccgcctgcct

SEQ ID NO: 700248 - DNA, 1020 bp, Homo sapiens
cacgcgtcgccacgcgtcgggctattgtccttgttccttcatgtattatatgatagtttttaaaaaagacattagtgtgattttttttcttgcttcttttttttctttcttgtttttcttccccataaaaacgcttagggaacaataaaaagaagggtagggatagggttgaggtaagtagtaatggaataatggatgtgaactaatgatatatattataagatattttaaaagtaaaatgacataaatgattagaataggtagtgttgacaagatatcaagcgaataagtagatataaaaacatagtgataaaatgaaataataaatagggtataaaagtgagaagagatggaatgaaattgcaaataaaaaaagatgaaactaataacatgagattgagataaattagtacaagttaaaaaaaaagggtaagtcgattagaggaaatgaagaaaataaagaaaatagactcagaaaatctcacatgcgaaaaaaacaaaaagagacacacagaggaaagaagaatgaacaaaacacaacagcaagagaagagatggaaaacaacgaaaaaacgaaggacaggaagagcatatcgccacaagggagaatacacattgaaaggagaaatgacaaacaacaagaagtacacaatagaagacacaacaagagacacacgaaaacagaaaataaagactaaaaagaaaatggacagaacaacgtaaaaaagaactagaaagacaaaggataaacaagacaacgataacaggtcacacaggaacaacagtaaacgagcataagcaaaaaaacacaaagcaatagttaaaacaaaaaaaggaagatgaagaaagaaaagaaaagaaggagaaatgataacgctgagacgacaacagtatggaagacaacacactaagggaacagagcgcaaacacaatagaagaagacgagacaagaaaagtaacaatgatacacacaacaagaaaagaaggaacaagacagagatagagaaagcaagacagaac

SEQ ID NO: 700249 - DNA, 511 bp, Homo sapiens
tgtctcatttcgggacggacggcatggagggcggaaaccaggagggaagggagggaaggagggaaggagggagggagtggatacaacggaggaagacggaacgaaacggggcgtggactctgtctacatatcttaataccctgtcatgtctccagtgataatcgttgttctgatgtcttgcagggtagatgtcgcggttgatattgcatggtaagaatctcgtaagttattcctatacatatatcccagacggtacctggtctgggctctgcattgtcatcaacaggtatggtctccccgaaagaggccctgtcagcgtccacggcagctgacttcgggaacatggtcctcatgttcaccagccctctgagatcaacaaagcacattactacgctaaaacctgaaaatcctaagatgcagcctggtataagccagtgttttccaacttattttcaccatagcatagttactgcatggaacaactgtgccgccgaacttgtggtctgaggag

SEQ ID NO: 700250 - DNA, 159 bp, Homo sapiens
ggggggggaaaaaaaaacccaaaaaccccccccctaaaatttaaaggggggttccaagggggggggatttttttttttaaggccccaaaaaattttttttttttaacccggggtttggggggggggttttttttcccccaaaattttttaaccccctga

SEQ ID NO: 700251 - DNA, 968 bp, Homo sapiens
  misc_feature (24)..(24): n is a, c, g, or t
  misc_feature (109)..(109): n is a, c, g, or t
  misc_feature (113)..(113): n is a, c, g, or t
  misc_feature (169)..(169): n is a, c, g, or t
  misc_feature (176)..(176): n is a, c, g, or t
  misc_feature (215)..(215): n is a, c, g, or t
  misc_feature (257)..(257): n is a, c, g, or t
  misc_feature (285)..(285): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (334)..(334): n is a, c, g, or t
  misc_feature (337)..(337): n is a, c, g, or t
  misc_feature (364)..(364): n is a, c, g, or t
  misc_feature (371)..(371): n is a, c, g, or t
  misc_feature (424)..(424): n is a, c, g, or t
  misc_feature (450)..(450): n is a, c, g, or t
  misc_feature (464)..(464): n is a, c, g, or t
  misc_feature (479)..(479): n is a, c, g, or t
  misc_feature (481)..(481): n is a, c, g, or t
  misc_feature (539)..(539): n is a, c, g, or t
  misc_feature (545)..(545): n is a, c, g, or t
  misc_feature (564)..(564): n is a, c, g, or t
  misc_feature (583)..(583): n is a, c, g, or t
  misc_feature (618)..(618): n is a, c, g, or t
  misc_feature (625)..(625): n is a, c, g, or t
  misc_feature (637)..(637): n is a, c, g, or t
  misc_feature (642)..(642): n is a, c, g, or t
  misc_feature (657)..(657): n is a, c, g, or t
  misc_feature (697)..(697): n is a, c, g, or t
  misc_feature (699)..(699): n is a, c, g, or t
  misc_feature (798)..(798): n is a, c, g, or t
  misc_feature (809)..(809): n is a, c, g, or t
  misc_feature (873)..(873): n is a, c, g, or t
  misc_feature (877)..(877): n is a, c, g, or t
  misc_feature (883)..(883): n is a, c, g, or t
  misc_feature (908)..(908): n is a, c, g, or t
aaaactattctcctgctatgagtncaatatttttatttctttacaatgatttcagaagagattacaaagagattaatatacttaaagaatcagattttggcaaacagtnaaancattaaaaagagcttattttcattaacatgtaattaacaggaaggagaggattggngagtctncttcgtaaccaggtccactgtggataggaagggcctccnttccttcccaccatggagagcctaaaatcacaagccccagcntccatcaatgaggaaagggttaccagtnacataagcngantcatcagaagcnaaaaacacgcagagcatggttattnctnctgcagtggcgaatctccccgtttttngtttttncaggaaatcattccgtgcctttccaggattccctctggcttgtatcctttctngtagagagggcgtataaactgtcccngggcacaaacagtngcacctgaggccctncnggatgaaatctgcagcaacaaattttgttaggccaatgacggctgcgttggttgtccngtacanacatttttccacaactccnttgaggctggaagccacanaagacatgtggacaatattgccagatttctgagcnagctttntaggaaggaatnccttnatcatcagggacatncgcgcgcacattgagatttatcgagaagtcccagtttttntnctcaaaatccaggacagttccatgagggacaaaaccagccacattaaagagaacatcaagttttttaacttcattggcaaactgatcaatttgtttttnctttgttacancaaggacacgagttttaatacccgggtacttttccagtccctgaagtttggactcattaatgtntgtngctatnactttggcacctcctcttgcaaaanccaaggcagccgcctggccaataccctaaccagcggccgtgagattgaagactttcccat

SEQ ID NO: 700252 - DNA, 315 bp, Homo sapiens
gaaaggacaccacaggagtggagcctgcgagcattaataatgacacaacacgagaaaacctcacccggaccggaacacggcacaggattgacagcatagatagctcttactcgaatatacacgaggagataggtgatgcatggccgtacttagttaggtggagcgatttgtctggttaattccgataacgaacgagactctggcatgctaactagttacgcgacccccgagcggtcggcgtcccccaacttcttagagggacaagtggcgttcagccacccgagattgagcgtacggggattgggcgtacgggga

SEQ ID NO: 700253 - DNA, 135 bp, Homo sapiens
cggctttggtcgatggacctctgtcctcagtaggagaaggccccgcctttcacgtgcatctgctcactgctttcctcctcagtttccgcacagtgccaccataagtatgtccgacaagcctggcagaaggcagac

SEQ ID NO: 700254 - DNA, 295 bp, Homo sapiens
ctgttgtccaggctggagtgcagtggcatgatcatggctcacagcagcctcagcctccctggctcaagcgatcctctcgcctcagcctcctgagtagctgggaccacaggcatgcaccaccacaccgggccaatttttttttttttttttttttttttttttgtagagataggatctatgttgcccaggctagtttcaaactgctaggctcaagctatgctcccacctcggcctccaagtgccagggtgtgagccacatgcctgggctgtgatttttttttttctttgtcgacgc

SEQ ID NO: 700255 - DNA, 210 bp, Homo sapiens
gtggttcgccgaacatatagatatatcagtctgtggctgtgaatgtatcatcacggagcagaggtacagcaggtacacaggtacagagcagccaggtacagaggtacagcaggtagcagcaggtacagcaggtacacaggtcgagcaggtagagaggtagagacgtagagaggtacagaggtatagagcgatcaatggcagagggccccc

SEQ ID NO: 700256 - DNA, 287 bp, Homo sapiens
  misc_feature (187)..(187): n is a, c, g, or t
  misc_feature (189)..(189): n is a, c, g, or t
  misc_feature (211)..(211): n is a, c, g, or t
  misc_feature (225)..(225): n is a, c, g, or t
  misc_feature (269)..(269): n is a, c, g, or t
gtaacgacggcagtcctgtcgtagctataggtgtaaacgaggtgcgtgctggtactagcctgtgagggtaaaacgagcggctggtgcatgatcattgcggttagtgtccatacaccggcacatctgtggcatagcggtgagctgtaagatatgtcgttggattgccgaacgataaaggtgacatagncntcatagccaaagaggcacgtancgattaggcccagnacccctgcgacgattttggagtggtttcctctctcaacaagganaacaaatagtcagcatca

SEQ ID NO: 700257 - DNA, 719 bp, Homo sapiens
gagctgacgaccaaggggagatgtttattagatgtttgagcgctgccagagatggctggttcaaagggacatccatgcataccagcaagataggggttttccctggacaattatgtggcaccagtcaacaaggtatggttttgaatacatagtatactatgttactaaacaagagaagctttgttcttttccatggttaatcagaactatccagattcctttcacattatcattgacctgtaacatagaccaaggttttacaaaagtccatgtctacatctgctaaaatcccttctaactctacaaatcaaacagctatataatcacatggatctcatgtgaaattataggtaatcataccagtaaatgtactgggtttcaagttatttgctttaatgggagaacggttcaagaagagcattataagtattttatctagtagaaaaggcatagtgttgatacaagaggaaaagctatatcattaatacttatgtgtacatataatgccgtacaaatatgccaaagaagtgcacgaatattataagcattgcgcttagcaacatgattaaagcatatcacttcttaacattaggctgctaacaatatgagggcaacatgagaatactcaataccaagaattgtcatgacaaatcagactacattacacgaaagtgcacacaaacatcaaagccctggagatgctagacatcatataaatg

SEQ ID NO: 700258 - DNA, 92 bp, Homo sapiens
aattcaagcttctaacgatgtacggggacatgctcacttttttatattaatttttacagtatttgtaagaataaagcagcatttgaaatcga

SEQ ID NO: 700259 - DNA, 444 bp, Homo sapiens
taggctataactaagtgactacataaaaaactgagtatgagaaccaagaaaaatagattctgtagttttcgttaaaaaaaaaattgacttgtaaatcccaacttaagcgggaggctgagacacaagaatcgcctgaacccaggaggcagaggtcgcagtgagcagagattgcaccgctgcactccagcctggacaatacagccagactccatctcagaaaaaaattaataaataaataaaataaataaactgaaagtatttcggctccactaacctgttaggctaaaaccagatactgtttgctctttttcaatgactgtaagtataagtcctttgacagcagtcaacataaagtccgtaataacaactgtttacaagatccctaaatgcactctttaagattctacctgtgattaattttcaattacaaacaagtaaaatgga

SEQ ID NO: 700260 - DNA, 273 bp, Homo sapiens
cggttcacctaccgttgcacactgccagttctctggtgctctttgctctggatctgagcctagactcgtggtcagggggaactcgtgctagcggccccactacgcccctgctgactcaaaacaactgtgttgtaggacgttcatcgccgtgttatccttatgtaagaatgaactctggaatgcccagccagggacaatgcacccttcacagagattctgctctattctgagtgaaggtctcaggtttgccatctccccctcatggagaccggc

SEQ ID NO: 700261 - DNA, 240 bp, Homo sapiens
gtgtgaaaatcaaggaagttaggctggtagatgtcattggattaggtagcacaaattttcatccttatatgtatggcttaaaatatgtggggagttgtgccgaaataaattcttatgtctgctgattactgctagtcaatatcttatgatgtgtgtacaatatgtattcgctactgatataaaccattttattgttttctttcaagagattttaagtaataaactctcattctcaagcca

SEQ ID NO: 700262 - DNA, 916 bp, Homo sapiens
gcccagtgggggcacttacaatcccggggcactatttaatttgtgcctgttataccgcaaaatcgggggggacacacacagccgtcgctgttttgggcactttctagcggtgattgtcaaaaagatgagagcatttccgttggtctaaaaaacagaggagacgtccacacgcttcaaacgatgcagttctttgctccgctgcgtacacattggcacaaatacagctcccaaacgttgaattggtttgaagaccctaacaatgtggcggaccatggatttcctcgcccttctaccgggggtaaatcaccggtccgcccttcttttccccgcaggcaatctcctattctttacccccttccgaccaaggggcaacgtctattactgtaaagggtaataaaagccccaatttacatgtcattcgcagtccttagataggtttaatttttcactcatatactcttgcactctgccctgtttctccactacgactgatatgggacaaatcacttacccgctccccccacggccgctggtcttcacgatagcgaggcatctttccacagtgtgttaagttgcccatgtctgcgcagcgtcccgttcccgcaacacatttgaacggggagatacccgacacgtagccccacctggtttaattctccagccggtggccgacgatatggacgagagaggtttgtccctatggagtatcccctgccgccactggttcaccatctgctgtgattttgactagaagaagttatcccttccacacaggcggcgcttacaaatgccgtattttgcaaatggtggaacaactgtccgtcaacttccgaaagcagtttccaaaccagcatgttactattccataatttttttggagaaataaacatatcccaaagattcacatagacgagca

SEQ ID NO: 700263 - DNA, 656 bp, Homo sapiens
  misc_feature (9)..(9): n is a, c, g, or t
  misc_feature (12)..(12): n is a, c, g, or t
aggggttcntcnttcgtgcaccatgaaaatggggcattttgatactggctcatggtcttatttcagatccaacttctacatggtcttgcaattaggaagagtactggggcccagtggaagcctgaaaacagttttgaggttggataacttcatgcttttttttactcctaaatgaatcccagattttgagtgctgtaaattttctgtttttctgtctgacatcagccagaatacttcagggttttgactactgtcttcctttagttttatctgagaggcactctggcaggatcatggcagcccttacctaaaaagcagataagtccaggaaacagtccagaggcttctgggagccagctgggcaggtctcacctcttcaaaggtgggcatccaactccatggtcaaaaagtaagaggctgcccaaagcccagcctaatcccagaagatcaccacaggagcctaccacagcaccccaaatgcccagcactggggccggtcctttagaataaaatactgtcattacaaggttcctttcttgaaattatattattaggttagaagtcagctgacctaccgcgcaaataatccaagcttcaactatcgaactttttttcccctttacatataactctccgggtctgtccaggatcactgt

SEQ ID NO: 700264 - DNA, 225 bp, Homo sapiens
taaacctttaaaacttttttggggtgtttttttttggttttttttttttttttgggtttttggtttttttttttccgttggagagggggggggaacggagtctgttggggcccccggggggggggcccccccccattatggggggttggggggggaaaatggggggaaactttggggaaaccctttgcttcaacccccgggggaaggttttctgccccaaggggg

SEQ ID NO: 700265 - DNA, 112 bp, Homo sapiens
aagtacaggcatcatcataagtgaaatggttaaaatcaatgtaaaagtgaactcaggcaaatcttagccctgctgtttacctgaaacatcacctctagcatcaccagtatta

SEQ ID NO: 700266 - DNA, 492 bp, Homo sapiens
  misc_feature (8)..(8): n is a, c, g, or t
  misc_feature (43)..(43): n is a, c, g, or t
  misc_feature (59)..(59): n is a, c, g, or t
  misc_feature (66)..(66): n is a, c, g, or t
  misc_feature (123)..(123): n is a, c, g, or t
  misc_feature (144)..(144): n is a, c, g, or t
  misc_feature (148)..(148): n is a, c, g, or t
  misc_feature (151)..(151): n is a, c, g, or t
gggaccgnccagacccccaaaggaacccctggagccagcaacnggaatcccccagtgcnccggccngagaccatcaaattaagccattttggagccataaggggcaatttggaaaaaaaaatncctggggattgtttgaagaantccnccnaggggggaattagggaaagtatgggtagaattatccttaccctgtgtggaaggaaaatgtcttttaaataatggcagaggccttagggtgagcattctgattgtgttgtctcatctggcacctgcaatacctgccagagttttagcttcctaaattactctggggcattagagaagatccttctgtccagagatattgtacttctttgaagaatactttgaatgagatttgagtttctatatagctttgacatttgccaaaaaggttacagtatccacagacacccaaatgttgtccctatatatgagtgtgcgtgttttcacggcagcgtagatcaaatt

SEQ ID NO: 700267 - DNA, 179 bp, Homo sapiens
  misc_feature (149)..(149): n is a, c, g, or t
acacaacgtacacgcacgcacttcttactctggtttggtaaactacacggggacttgtcactggtaacgtttggactacatacccccttactatacgttttaaacacgttgctgttccgctgggggactcctctacgacgtcgaccctngcacggcatgcaacgctgtggcacctggac

SEQ ID NO: 700268 - DNA, 344 bp, Homo sapiens
ttggcctgggggagggaatctggagtttttgacaattgagagtcttgctgagcgtggtggctcacgccttgaagtccagcactttgggaggctgaggcaggcgaatcacctgaggtcaggagttcgagaccagcctggccaatatgatgaaaccccgtctctactaaaaatacaaaaattatctgggcatggtagcgggtgcctgtaatctcagctactcaggaggctaagacaggagaatcgcttgaacccgggaggcggaggttgcagtgagccaagattgcgccattgtactacagcctgggcaacagagtgaaactccatctcaaaaaaaaagtcgacgc

SEQ ID NO: 700269 - DNA, 887 bp, Homo sapiens
ctgtggtaccatgttctctcgcgcgggtgtcgctgggcggtcggacctggaccttgcaggccgacaatgtgattcaagttcgaaatatgggaactttgaaagatatcaccaggagactaagagtccatcaataaatccatccaggaaaatgtaccaaggtctatgagaatggtagcgggagcgaaatatgcctcgtagctgagagagagcttgtaaaccagacctcggagagtatgatggatttgggaatctttagctctgtgatgagaaaagctgagtatcgaaggggagctgaagtatgagaaggagaaaaccttcattatatggtggtgtcctcaagatcggtagggactgtgtggatgcctagtggcattcctcgcatttgtctaacaaagatgagaacgcgaggttgtgtaaaactatcagttagcgggggaaagaagttatgcattgtgggactggtgacaaaaatcagaggcatacatgttataggattgcatttctgagccagtatatctggtagggtttcgaaaggaagtgggaaagagaagccccaccaactttttggagatgcgtcaggggcgttgtccttgaatttagtagaattctggatttgaattgatgaagggtacaatatatgtaataaattcacgtgcgcatctcctataggacagaagagaaggccatctgttcgttaatacgcgtgaaggggtgacagggggagtatctaggacgagatgtggtgaggtggcaattacaaagagtaattggaaatgcactagacgagaggggcaacaatatggaagggaaggagaagatgaagggaagagtttgagattggatgcatgcttacggccggcaggaacaacaaggggaatttgaggaaa

SEQ ID NO: 700270 - DNA, 119 bp, Homo sapiens
  misc_feature (76)..(76): n is a, c, g, or t
aggtgcagctgctgctgcggtcgactctagacgtgatccctgtgcaccacttgtgcggctggacactttggtcacnttttgaatgcatgttaataaatgtcactgattaaaaaaaaaaa

SEQ ID NO: 700271 - DNA, 596 bp, Homo sapiens
gaggggatagcattaggagaaacacctaatgtagatgatgggttgatgagtgcagtaaaccaccatggcacgtgtatacctacgtaacaaacctgcatgttcgtgcacccgttatcccagaacttaagaatataataataagaaataaaactgaatatttgaattctcaataagaaaaaaggaagaataaacatagaaaaaagaacttttggggcggctctgggccgtcggaaaagtttcgtcaaccccaatggggtggggcgtcgaggagcgcccctggagcggtctacgtgctgcacactgtgtggtgcataaggagtgttactccaaaggggacaacccgcgggaacatgaacagataagagggagcgtgggggttatttccttccgccctaattaaaaaaaaaaagggcccggggggggtaataacacaggcgaagggtgtttgtgtgagaagccaattgccccaatgagtgcgctgatgcagagagaaggctcacaaaaagggggggactctctacatgacgcagggggtagtcctcaaggggggagcactcgattggttccatttttaaccccccgagctcgggggtagt

SEQ ID NO: 700272 - DNA, 1145 bp, Homo sapiens
  misc_feature (16)..(16): n is a, c, g, or t
  misc_feature (954)..(954): n is a, c, g, or t
tgggcccgtggagtangccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaaccccccaccccctggattttccttctccctccatcccttgacggttctggcctttcccaactgcttttgatcttttgaattcctcttgggctgaagcagaccacagttccccccaggcaccccagttgtgggggagcctgtattttttttaacaacatccccattcccccacctggtcctcccccttcccatgctgccaacttntaaccgccatagtgactctgtgcttgtctgtttagattctgtgtataaatggaatgttgtggagatgacccctccctgtgccggctggttcctctcccttttcccctggtcacggctactcatggaagcaggaccagtaagggaccttcgatttaaaaaaaaatatagaaaactcaagactagttctctcc

SEQ ID NO: 700273 - DNA, 716 bp, Homo sapiens
  misc_feature (525)..(525): n is a, c, g, or t
ggaagggggaggaccaggtgggtaatggggatgttgtttatatttatacaggctcctccacaactgtggtgcctggggggaacttggtctgcttcagcccaagaggaatccaaagctcataagcagtttgggaaggccagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaaccccccaccccctggattttccttctccctccatcccttgacggttctggcctttcccaactgcttttgatcttttgaattcctcttgggctgaagcagaccacagttccccccaggcaccccagttgtgggggagcctgtattttttttaacaacatccccattcccccacctggtcctcccccttcccatgctgccaacttntaaccgccatagtgactctgtgcttgtctgtttagattctgtgtataaatggaatgttgtggagatgacccctccctgtgccggctggttcctctcccttttcccctggtcacggctactcatggaagcaggaccagtaagggaccttcgatttaaaaaaaaatatagaaaactcaagactagttctctcc

SEQ ID NO: 700274 - DNA, 240 bp, Homo sapiens
  misc_feature (182)..(182): n is a, c, g, or t
  misc_feature (186)..(186): n is a, c, g, or t
  misc_feature (206)..(206): n is a, c, g, or t
  misc_feature (240)..(240): n is a, c, g, or t
ccagagcaaccaaggaggccagaggcaccaaggaggccagaggcaaatgatttatgccagctccaaggacgccatcaagaagaagctgacagggatcaagcatgaattgcaagcaaactgctacgaggaggtcaaggaccgctgcaccctggcagagaagctggggggcccagaagataacnccanatcctccttcttgccctccnttgtgcctctgaagggatcctctagatcacccan

SEQ ID NO: 700275 - DNA, 604 bp, Homo sapiens
  misc_feature (16)..(16): n is a, c, g, or t
  misc_feature (144)..(144): n is a, c, g, or t
  misc_feature (165)..(165): n is a, c, g, or t
  misc_feature (170)..(170): n is a, c, g, or t
  misc_feature (183)..(183): n is a, c, g, or t
  misc_feature (207)..(207): n is a, c, g, or t
  misc_feature (211)..(212): n is a, c, g, or t
  misc_feature (216)..(216): n is a, c, g, or t
  misc_feature (218)..(219): n is a, c, g, or t
  misc_feature (244)..(244): n is a, c, g, or t
  misc_feature (255)..(255): n is a, c, g, or t
  misc_feature (267)..(267): n is a, c, g, or t
  misc_feature (273)..(273): n is a, c, g, or t
  misc_feature (275)..(275): n is a, c, g, or t
  misc_feature (291)..(291): n is a, c, g, or t
  misc_feature (311)..(311): n is a, c, g, or t
  misc_feature (323)..(323): n is a, c, g, or t
  misc_feature (329)..(329): n is a, c, g, or t
  misc_feature (332)..(332): n is a, c, g, or t
  misc_feature (347)..(347): n is a, c, g, or t
  misc_feature (369)..(369): n is a, c, g, or t
  misc_feature (376)..(376): n is a, c, g, or t
  misc_feature (385)..(385): n is a, c, g, or t
  misc_feature (392)..(392): n is a, c, g, or t
  misc_feature (436)..(436): n is a, c, g, or t
  misc_feature (494)..(494): n is a, c, g, or t
  misc_feature (504)..(504): n is a, c, g, or t
  misc_feature (512)..(512): n is a, c, g, or t
  misc_feature (519)..(519): n is a, c, g, or t
  misc_feature (530)..(530): n is a, c, g, or t
  misc_feature (589)..(589): n is a, c, g, or t
tgggcccgtggagtangccgcgttcagtcgggtcccggcagcggctgcagcgctctcgtcttctgcggctctcggtgccctctccttttcgtttccggaaacatggtgagcggcaggccacggcgcctgaaggaggcggctgcnggtcggtcgcctgcacgcagnaagcnactggagaacaangtccgcaccccctcccccaacacnccgnncagnannaaggtctcgcacgaaggggcgggcngtgccggaatncacgtacacacncgtagncngggaaaggccggtatngacgtcgctcgcactccgcntggactcccctnccccanccncaggtacacacacanagacaccggcagcaggggggangggttcngggcgcgcnctggggngcccctcgcggaacggccggcgtcgcgcctttcttcttaggggngcgctctcgactggagcatgcggcgtccaaacccggcccgggggcggcgaggaaaaancgcgcgaaangtctcggngcgcgcnccccacccaangctgttcctgtctgcacgtcaccctccctcggcagccgggtccgtctcgggagcaggtngcagggatgtctgca

SEQ ID NO: 700276 - DNA, 301 bp, Homo sapiens
tggctgctctagagatccccctccataatgtgtgcccaggtatttcttttttttgttttttgatgttttccccgaaaaggcccccttccagggggggccgcgcccccctggggggaggggggcaattttttccaatgggggttattttggaaaaatgggttcttttccaaggcttttggaacccttaaggaaaagcccccgaatcatttttaaaaaccaatcaagccagggcccgggaagggggagggccctaaaaaacaactttttatggaccggggcccaaagaggttttaaggctcct

SEQ ID NO: 700277 - DNA, 788 bp, Homo sapiens
ccgtttttggaaggtgggacgtattcttacagtactagggggactcatttgtgactcgtgatagggttaacagcgggacagtggaaagagctactgagccccagggtcttgagataggcgagatgagaatagagcagcgaagtgagttcgatgggtatatggtaacaatgattgacgagggagggtaccatggggatctaatgcgtacacgtggtgatgtgaggtatggtgggatcttaacaatgggtgagtggaagctattgcttgggacagaagtgatcagcgaagaggaaatgatacgtgcttgtaaacggattaggacttatgaggggggacatgatatctggcagagctgtgagcatatgtttgaggttctaggcgagtgggatgggggtagagagatgaaaggtgcggactgttatgtcgggaattggggttagagacgccgtatatgtaggagcataaatgggggagtggtatgtcttggtacgtctagggacctgctaggtagacaatatggcgtgttttctagcgggtgaaatgaagaaatgtcggtgtttatatcatacatgggtgcgttataaggagtcgtctatctgagaatgatgtagtgagatgtgtgaggatagcgagaggatgttatttaggaaacagttacgttaaatgatgctatgatcttacggactggatatatgttcgagctgctatgagggctatactcacatattcgggcggattgagttcggctgcgtgacagggagtgtgatccatagcgtgggggtgtcccc

SEQ ID NO: 700278 - DNA, 1091 bp, Homo sapiens
  misc_feature (16)..(16): n is a, c, g, or t
  misc_feature (900)..(900): n is a, c, g, or t
tgggcccgtggagtangccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaacctatgagaccaaggagagcaagaaggaggatctggtgtttatcttctgggcccccgagtctgcgccccttaagagcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaaccccccaccccctggattttccttctccctccatcccttgacggttctggcctttcccaactgcttttgatcttttgaattcctcttgggctgaagcagaccacagttccccccaggcaccccagttgtgggggagcctgtattttttttaacaacatccccattcccccacctggtcctcccccttcccatgctgccaacttntaaccgccatagtgactctgtgcttgtctgtttagattctgtgtataaatggaatgttgtggagatgacccctccctgtgccggctggttcctctcccttttcccctggtcacggctactcatggaagcaggaccagtaagggaccttcgatttaaaaaaaaatatagaaaactcaagactagttctctcc

SEQ ID NO: 700279 - DNA, 355 bp, Homo sapiens
cctactactactaaattcgcggccgcgtcgacagaacttgccacagcactctgataaagaaatagctttaaggctgggcatggtggctcacacctgtaatcctagcgctttgggaggctgaagtgggaggatcacttgaggtcaggagttcgagaccagcctgaccaacatggcgaaacctcggctctactaaaactacaaaaattagctgggcatggtggtgcatgccttgaatcccagctacttggggaggctgaggcagcataaccccttgaaccagggaggtggaggttgcagtgagccaagatcatgccattgcacttccaccctgagcgacagagcaagactttgtctc

SEQ ID NO: 700280 - DNA, 110 bp, Homo sapiens
cccgtctacggtactcaaaacaacagagtatgcattctcctcatctgcatatggcacatactctaacattgaccatacaattggccaagaaaccatcttcagcaaattca

SEQ ID NO: 700281 - DNA, 629 bp, Homo sapiens
  misc_feature (16)..(16): n is a, c, g, or t
tgggcccgtggagtangccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgatccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctcctggaggcagcctttagagcccttctgccccctccttgtgcaaagctc

SEQ ID NO: 700282 - DNA, 238 bp, Homo sapiens
gtgggaggttgaggtgggtgatcacctgaagtcagaagattggcctggccaacatgatgaaaccccgtctctaataaaaatgcaaaaattagctgggcgcagtggcacgtgcctgtaatcccagctacttgggaggctgaggcaggagaaccgctggaacccagaaggcagaggttgcagttagtggagatcatgccactgcactccagcctcggagggagacgagacttcatctaaa

SEQ ID NO: 700283 - DNA, 311 bp, Homo sapiens
tacgactctacgaggatccgcaaggtacccacctgcaggtacggttgtgtgctgaactctcaggtacacgggttacggctacgagcgatccgtcatcctccggggtgttggagattgtggctggtgataaagggttggggtggctctgcatagactgtgatcgccgggagtgggatccaatggaggccagtgtctgagttatgggcttgacacgtataggatccactattatccacagtgatgtgggggataaagagctcttgggtggatggctggaaagtcccattgacaaaccaagagtactgtgcagg

SEQ ID NO: 700284 - DNA, 1142 bp, Homo sapiens
  misc_feature (16)..(16): n is a, c, g, or t
  misc_feature (951)..(951): n is a, c, g, or t
tgggcccgtggagtangccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaaggacggggcaaaggacgaatccctggggtggggggccgaatttggttggggggggccccccaagggaaaacctttggttccggaacgggaaccccccttaccgcccacccttttgtcaagatgctgccagataaggactgccgctatgccctctatgatgcaacctatgagaccaaggagagcaagaaggaggatctggtgtttatcttctgggcccccgagtctgcgccccttaagagcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaaccccccaccccctggattttccttctccctccatcccttgacggttctggcctttcccaactgcttttgatcttttgaattcctcttgggctgaagcagaccacagttccccccaggcaccccagttgtgggggagcctgtattttttttaacaacatccccattcccccacctggtcctcccccttcccatgctgccaacttntaaccgccatagtgactctgtgcttgtctgtttagattctgtgtataaatggaatgttgtggagatgacccctccctgtgccggctggttcctctcccttttcccctggtcacggctactcatggaagcaggaccagtaagggaccttcgatttaaaaaaaaatatagaaaactcaagactagttctctcc

SEQ ID NO: 700285 - DNA, 506 bp, Homo sapiens
ttgactggcctgcttggcaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcaggccgcaccctgcttgttggacttgcgctcttcctgatgtgcctggtgcatgacccatgagctacctgttccgggtgaaccggacaccatcaagctacccagttctgagacagggccctgctgatgtgccctcgcttccctgtgggtgagcatgctgcttgcgccggtacccatcctggggaagggagctgttgcattagccttgcagagctctgctgaggccatcttgccccggacccatggcccattcatcccatccgacggcctagaagccaaaagatgcttgacttggcaagcc

SEQ ID NO: 700286 - DNA, 296 bp, Homo sapiens
tgtacaagaatcatgctctgctatcacatggttaaacgttgcaactcatgattagatagaggacacatatcaccaacaagtttctgagaatgcttctgtctattttttatgggaagatatttcctttttcaccgtaagcgtcaaggcgatcgaaactgtccccttccacaaacctaccaaaacgacgtgtttcaaaccctgactctatgacaaggccagtgttcactctctatgacgttgacatggacaatatccgacaagacacatttcttgagaattacgctgctgtacgttag

SEQ ID NO: 700287 - DNA, 179 bp, Homo sapiens
tttcctccgccccccgggccatccttttttttcctcctcttttgtaatggtatggccagcctccctctccctccctgggggtggatgggttccccctgttagctacatttgtggtcacaaaccctttttttaagtgaatttttttcatttgatttggcaataaacgaatccaactggga

SEQ ID NO: 700288 - DNA, 510 bp, Homo sapiens
  misc_feature (260)..(260): n is a, c, g, or t
  misc_feature (269)..(269): n is a, c, g, or t
  misc_feature (276)..(276): n is a, c, g, or t
  misc_feature (287)..(287): n is a, c, g, or t
  misc_feature (344)..(345): n is a, c, g, or t
  misc_feature (351)..(351): n is a, c, g, or t
  misc_feature (353)..(353): n is a, c, g, or t
  misc_feature (372)..(372): n is a, c, g, or t
  misc_feature (390)..(390): n is a, c, g, or t
  misc_feature (403)..(403): n is a, c, g, or t
ttgactggcctgcttggcaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtagtatgccgggagccgacctgtgtggctgactttcaggctggatactggtcctgtcgaacggccatacnccgtcaganggccgtngctgttcgggngatgctggcggacatcgagaggtgatgctgagttgagcttgccgcagctactcagtnnaaagtngngcgtacaccgttaataatncaaggattatgggtctgngagcgcggatcangcagccattggttcacggacataggtgtgaacagggagtgtcggaagtgagcaacgcgcaatcaggtgatctgatcgggacgccacggccgagcctgtgccatcacc

SEQ ID NO: 700289 - DNA, 117 bp, Homo sapiens
ttggcagcttgtgatgtggattttggcacaacccccttttgacatggaaagccttaaattgaggccattacctaccatggttacggggagctcataatggggtccaaggagaattcg

SEQ ID NO: 700290 - DNA, 156 bp, Homo sapiens
ttacttcgactcgggtattggaggatctctatagcaccagcgctccatcttaacgatattgggagtgtcagcacggtgtgctcacgtgtctgacggaacttgtacaggggaggcatgcaccgcagttgtgtgaactacacggtcgaccatggctcc

SEQ ID NO: 700291 - DNA, 967 bp, Homo sapiens
tcttttgttgtttctgtgcattgttcctgccatggccgtcgtgttatgtttgggtttaccttcctgggtcttcttccccagttcttccttcctggtttttcttacgtaccggttccagtttgatttcgttctattccgttcctcaccctatttattgggcggctttgtgttcgtcttctccccgccgtgtcggctcttggctcggcaattaacctttctgtattatgcatgaccattttataccgctatgttgacttggatccatggcccataattccgtgccctagtcttgttatttcgtttcgatgatgccgtggtccgccgggtcattgtcggttactctggatgtccagatcgcatgcgcgtatgtccgctgtagctttctgtgtggactgtgcccgtgtgggttgtccatcagtcttcatgtctggtggcgttggtacactgcctgtcatgctcctggtccgtgtggatgcgtccctccaggccgcactgctgcctacggttcctgggcacgtatgatcgtcctgctgtcgtgctggctcagtggggttcatcgaatgcggccgcacatattcaccctcagcagtgccttttcccgactccccttggatgtgcggaaactcgcccattggtgtcctctggcatccagatgccgatgccccatccaaagtggtggttgggaaggatctcacagtgagtggcaggatcctggtcgtccgctggaaaggctgtagactgtcgcctgctccgaagtcttccgtcatcaactcttcttgaccagcattatccctgagtggtgcggaccatgcagcgctttgggccccccgtttcccgctaagcctggcctgggcaaatggagtcgaggtcccactattgcgtctccattgtaggcagtgcgtccatccttccgtagggcaggaattcccacagttgctactttgacctaacgagcgccgcatgttta

SEQ ID NO: 700292 - DNA, 126 bp, Homo sapiens
atcggccccaagtataaagtaaccatgattacttccgctgtcgtgactttcactgtgtataatcattgtatgtatgtgtgcttaactgcactttgttttctatacatttgttactaattcaaccca

SEQ ID NO: 700293 - DNA, 305 bp, Homo sapiens
tccatttcaaattttttttttgccccccttttaaggactttgaatttttctttgtctttgaagacattgggagatcgggaattttttttttttgtaaaaaatgtgaattttttggtcccctaatttgttgttgccctggggactcccttggttgtaaagtcatttgaatccttggttctctttaaactccccagggacaaattactggtatgttttataagccgcagctactggacccagcctatttgaaataatcttgttttgctgatttgtttcttgtaaaaattaaaacgactcccccatta

SEQ ID NO: 700294 - DNA, 365 bp, Homo sapiens
gcgcctggttgcggttgcagtttgcccgcggctgtgtaagggagacagtgtggaggccacaagggtactttgcaagggtggggcagcaccttaggctaagggtcggcgggagtaagagaaagagttgtttcggcttaaaaggccaaggcccaaaagcaacctttaggggtttttaagggctggtttctcaaagttggggggacacttttctactacaaagggggggtggttggagagctccaagaagaggtttttgattgtcgccaagacaagataatcttcgaataggatttgtttggtccaccatctgtggtgcacactactcattagcaacgtagcaggataattatcatgagcacaacctt

SEQ ID NO: 700295 - DNA, 766 bp, Homo sapiens
gcagcactatgagataccgccatgccacggaggacccccagagcgccacggcgggactcccgtgatggctgggggggggctacggctccgacaagaggctgagtgaaggccgggggctgcccctccccccaggggtggccgtgactggggagagcacaaccagcggctagaggagcaccaggcacgcgcctggcagggtgccatggacgcaggcgcggctagccgggagcacgccaggtgtgcaaggtggcgagaggggcctgtctgggccctcggtgccgggggcacatggcaagccgcggtggagtggctgggctgagtgcggctttgcacaaggtggacattcccaggggcaacgtggtgccaggtggcggactggagtggtggcggagttgccagccaggaccggggcagcagagtccctcacccagaaccctcatccccgccccgcgtacccaccacttcacccggcgcggctactaaggtcgcactcgctgcgagtattcgggtgggcagacggcactgttgaatctgtagccaggcttccctccgagcttggggatcttttttaaaagcaaagtaaatcctgccaacatgttgtagctcagatagaacttgtgaagcttcaccttaatatatatgttgatgaagaaataaggtgttgtaacgttgtagacgggcgatattaaaactggggggcatcgtgtccgggaggggattcgattatgccattatgaggtttaaccttggagaaaatagaacaaac

SEQ ID NO: 700296 - DNA, 524 bp, Homo sapiens
cgacgatgacagacacgaggttctcaacagtctgggtgaggcccttttactacaccagcgaaatataatcctttgtcaccctcagagcaggtctatataatgataacaaaattacttgctcccagaagatagtccataactagaaccccaaaccttccaatccctgtggtcctctttccaccagatcttttattcataaaaatggcaagttctccttctatctaaaatattaataaatttacatttatgcaatatttttctttctctagtaaaataacaaaaaattaatacacaaaacaagagagattgcaccccccgaccccagctcaaattaagatatgttcagcctggaaaacatagtgagaccctttctctataaaaatttttgattaactagccaggtgtggtggcatgcacctgtggtcccagctcctcgggaagttgggatgggaggattgctatagcctgggaggctgaagtgcaatgagccatggtcacccaggttgggtgcagtggggccaatc

SEQ ID NO: 700297 - DNA, 296 bp, Homo sapiens
  misc_feature (10)..(10): n is a, c, g, or t
  misc_feature (37)..(37): n is a, c, g, or t
  misc_feature (65)..(65): n is a, c, g, or t
  misc_feature (114)..(114): n is a, c, g, or t
  misc_feature (126)..(126): n is a, c, g, or t
  misc_feature (139)..(139): n is a, c, g, or t
  misc_feature (159)..(159): n is a, c, g, or t
  misc_feature (181)..(181): n is a, c, g, or t
tggtttgccnaaatggcccctagattgccccttaccnggtaaatacaagtaaacctgtagtgggnatgaagtctgccctaagtacagaatgagggatttaattagaaaagttantttcccttttgnccctgtatcaacntgcagaacagctatatactnggtattttgtacgtgaataccnttttagcttttgtgcccttttgagcttgaagggttatccctcaaaggggaaaactatgaaggggaagaagacaaaccctaagataccataaagtaaaggttgacattacatattt

SEQ ID NO: 700298 - DNA, 672 bp, Homo sapiens
  misc_feature (86)..(86): n is a, c, g, or t
  misc_feature (153)..(153): n is a, c, g, or t
agggccacttataggccacggggagacaccccccgggaggagccacagcccacgggtttcaaccgagagcccaacgcggcgagagnctcagacacacatttgctgggcacagcactcggaggccggcgaccccaacatcgggggccaacaggngagaaagggctctcttattaagattttggagagagagaatacccacgggagaagcccctctctctcaaggggtttctcgaggcacgaaagagggcgcactgagagctgagattcaccactgttctgagaggagcctcttctagctggccacgtgctgaaggaggttggacgagagaaaagggtgtaaaagcacgaggaggaaccacgtgcacgggctgttaaacacgggttgcacggcgaagagactggggtgctgggctcccctagactaggactcccgtgccctcctctccccagagaccaaggcccttgcacttgaaggaggtgggagaatgattagattttgaacataatgtaaattatttttcagtctttttcaaagataccaatatttacatagttttaatcatgtaatatataccatttaatgtcctagtgttttacttaatagtgtatcatgttttccctgttggtatgtagcctggataaatgcttttaattattaaaaattctgtcgga

SEQ ID NO: 700299 - DNA, 95 bp, Homo sapiens
  misc_feature (94)..(95): n is a, c, g, or t
gcggccgcctactactactactgctcgaattcaagcttctaacgatgtacggggacatggaaataaagcacccccattgccccgggcccctgcnn

SEQ ID NO: 700300 - DNA, 420 bp, Homo sapiens
ccaaccatagatgtcaatgctgatgaagttgagaaccaagggtacgtcaaacaaatgtgtgtaagtgtcttagagtgtctacagctgtgcggcctgtgaatacaagaacccttgctgtgacccttgctcatgacatacccaagccaagcaggccactaccaggcagctgccccacagatcaccacatgcaagtttatcccactgtctagcaggtagcaggagagtccgtttccttaacaaagcatctagacagcacactaagaagcaagctcgtgtgcttggtcagtgtgggcaaagcatgagcgtttacccccaagttggccgatgaagtcccgttggggggtgggtttttgtgcactgtgtattcagatgctgatttctgttcccagagatctggttacagtccagacttttgggtct

SEQ ID NO: 700301 - DNA, 767 bp, Homo sapiens
atgaacatgctcattattactgcagactcactcccaccagaggaccgagaggtctctcatcaccactgctagtcattcttaccacctaggccccggtcactgccacaggacctcactctcctgcgcgtaccccacccgcccccgaagtcgtcttgaatccccatacccatcctcgggaatccgagctgcgccggtcgaagatggccgggccactcatgacaggtacagacgcgaacgagccaactgagacggttctcaattgattactggcaagacatgtaacctaagcagaggccacacggtcctacaagctacgcaaaattcgtgcattgccagagaacttgccgcgctaaggggcgaccctcgggagggaggacacgcagagccctccggaggccaagtacagtgcgtgagcgactttcatgcaggtgcaccctgctgacacactaactatgggctgcagagtctcgagtcccaattaacgttagaacgcaatcgggacaccagacggtaaaaccccgtaaggggaaattatacctatggacgccggaatctcgtaagtgtcttatagaggtcgcaattagtacaacccacagtacgcccgcttttataagcggacccctgcggagtggactccggggactcccacgggagcgattcgcccaaacgatggggttgccatgcccgccttactttgacacggcgctgccggaatttgggacccagggtcgcgacttaagaaggttaccgtagacgtggaactcctg

SEQ ID NO: 700302 - DNA, 191 bp, Homo sapiens
ggggtgctctgaggatcccggccgttggggtctcttcgtggtggatttagcataaactgagagtagagtgcttagttgaacaggccctgaagcgcgtacacaccgcccgtcaccctccatgcgccacaccaggagccaccccatgtgccccgcgacagagccccacgacagagaccccaaccgaggggtac

SEQ ID NO: 700303 - DNA, 431 bp, Homo sapiens
  misc_feature (406)..(406): n is a, c, g, or t
gtgttgcttttcgaggtggtttgtgatgcttgggtttcttcctggacagcgccccatcttgccctcacgggaactgggacagatgcggttgtcccccgaccccctcctcgcgaggctccagcaccggctgtgtgggccaccaggcctgccccacatggacagggctgcggaggggctggctccacagcccacggcggggcctctggccaggttctccctcccctggcagtggctgtgacgcttatgcccaggtggacagcccagaccaggctcggagccccatcccctccaaggcgggccggggtagattcacgccagcgtctcccttgaggccaggctctggcataggagagtgattcctctgggaggtccggggtcccgagccccgggaatgccggctgagggncacgcgacccctcttcacggaaccc

SEQ ID NO: 700304 - DNA, 201 bp, Homo sapiens
cagaggacccatgatgcactaactatgcatgtcttcatcatatgttagatctaggtttaattcacttgattaccttgagtcaaaccaattatgatgagtttcttaattttttatgtattacatgaagtattgctaatatctatgatcctaaattgcttcaaatctaccaaagcattttccaatacataacaccacacaatt

SEQ ID NO: 700305 - DNA, 235 bp, Homo sapiens
agtatacctgctgtattaccacctccatgctttgacacaggctgtttccttatgtcagaaaccattccatacactacgccttattaaggtccactgaaaatagcaagttgcaggctatagaatgaagtcttatccatcgcccttatcagaaggaaagtactacctccctaaaggcccaggtctccacatacagtcacactgggggttaggacttcaacatacagagcccatgccg

SEQ ID NO: 700306 - DNA, 690 bp, Homo sapiens
ggatacacggacggggcacaaacccataccatgaccccccatcaggctgctgccaccgctgctgctgctgctagctctgctgctcgcttgtcagcccaggaggcgtcttgcgcggttcccatgctgcgggcaaggggtgctcgcgggttgtccaggggctgcgtggaggatgaggatgggggttcgccagccgagggctgcgcggatgcttatgtctgtctcagtgagggaggggcaggagtgcgtgtggtcttcgaagcccctaactgcgcctccagtgtactgcagtgccatcctgcccaacgtacggacgaggctccttttcgtgcgctgctgctcggccgaggccgattccttccggtccgtgcgcctgctgttgcagatgagaatcctatagggagacgtaaacctccaatgcaggtagctgcctcgtgcctacacgtgatgtaacaccgcagcagatccaacagagcgaagtccaggcacttctaccaggctctcccataccaattctgcgggtgtccacaggacttctgagatgggcctcctgccgtatgacgactctggtagctctacgtgcgtgtgagctgactccagaccttgaggtctaccgatgggctctaacactctacgtgtccatttgtgagcatcgaggtttctagcgtgaagcggcagtgccggtctcgtctc

SEQ ID NO: 700307 - DNA, 751 bp, Homo sapiens
ccacgcgatcggaaaaccaaggaggagaagccagacagccgaaaggggtcaaggtaggaggtcaatgtaggcctgaagtggacctctccagtgctctggcttccttgctgtagtccctcacgtttcttcccactaacccctcagattttatattgtctatttctctgtgtatttatataaatattttattacacactatgaatatcacccagggtgcagaaagcataggggcccgagtctcagggcgagcatggtgcttgggatgagctcattctcgaggacgccactctttgtccagctcgattctatctccgtatacttaaacattgggaaccataaagggtgcgcaggtgctagggtgaaagggatactattatagtgcaaccataagacaagactccgtgacatggccaagtgccttgcgttagtgaggcgtcccggaaaggtagccccttattagaagcgagttgcgtagacagcgggctggctggcgtcttcgaagggatctcacgtgtccttattcgaggctcctaaagtaacatcagccgattctgagatcggttctgtcctacgtgaccttcccgagtaggccatcgaagtgagcgcaagaaatatggcctgccctctgtcatgtcttgctcctaatgctgcaggtggaggttgctagtctagatatcctttttgagatactatgagcactttagtgagcctctgggtcaataccaaggtacatttctaaaaagcgaaacac

SEQ ID NO: 700308 - DNA, 150 bp, Homo sapiens
  misc_feature (125)..(125): n is a, c, g, or t
aaattgtcagttcaggtgtcatctgacgcagcttatgcggaggagaatgtttcatgttacttatactaacattagttcttctatagggtgatagatgggtccaattggtgtgtgagagagttcangtttctcattccttgggcaggggta

SEQ ID NO: 700309 - DNA, 683 bp, Homo sapiens
  misc_feature (105)..(105): n is a, c, g, or t
agggtagtcattaccattaataccagctgggttgaaaatctctcagtgatggatgacttactgacacatagtcaacacattgtttttaatctcactgaacacctnggttcgtcacttaaaaaattggtcacttaattgattcaatttcttaacggtaaatgcatttattagaagcttgaaagttcaaaacattacaaaggcataaagtggtgggttcaaaaaaatttaaatctaatcatatatttcgtatgtaaaaaatcttacttacctttttctttccaagagagagtttaggaattttctcaggtgtgttttctgtaggtgatttcaacaagaattccaaggctcagcttttagaatgctaccaaggaaaataatagggaaaatctccttcgattttggctgtagaaaatgaatacatttccacgaggaaatattgtagataattggtgagttacataaatttataaaacattagttcctctttctgcagggtaaatttctgagagtgaatatctctgttctgtatcctgttatcttgatttctgagtttcatactaaatttcatgagatgaaacttggtacctcctagaagtttttccctatgactaattgtttactacattatttttaatagaaataatacaataataaatttattatctgaaaggaataggaaaaaa

SEQ ID NO: 700310 - DNA, 562 bp, Homo sapiens
  misc_feature (70)..(70): n is a, c, g, or t
  misc_feature (513)..(513): n is a, c, g, or t
tcattacgtcattgtccaaggtgacaggaggaactcagtcgttaaaatgacgagccttattttcatgaantaaccaggctcactgaggtaaatggtgcctgcctgggaaagagttattttattgcaaacccctagcttccatcggccttccctctcgagcctgcctagcctgcttgcaaggagggcagcctgcttgccctcccttggccatatttgcccctgtcctattgtccccttcagactgatgggtccagatcacagcacagagcctgccattgtcaaaacagcccaaagtcacactggactcggagtcctgtggtgtctgtggcacgaggcttttgatacctgtaagatctgcatgcctcttggctttcaagtgtcaggggttctttatattcacagcctagcacactaggcaagttccctcctttgacacaggtgtggccaacgtaaaggaaaaaaacacacacacatcaccgtgtcatttctgtgttcgggtgccttcatcccccnagggagttaatgacagcttgttcacaccacctagaaataactattcatc

SEQ ID NO: 700311 - DNA, 333 bp, Homo sapiens
ctacacaactattgaaaagttaaaaattaccttaattcattattcctggtaccactaccagaaatttacagggcaatatacctgatgtaaatgaaaagcaaaagacaaagacaaagctaacaacagctaaaagaccacaggaatgtacatctaattgacactgaattgcattaatcaatagctgcacttttagcaacactgtggctataacaagtcctgaccaagaagggtatcctagtataagctgcagtaactatatctagactatagatcatcgtaccttctgtggcagatttacacagtacctctaatagcatagggacgaatgtctca

SEQ ID NO: 700312 - DNA, 239 bp, Homo sapiens
ccaaggggggggggggggggtttaaaatgaaagggggggggccccctttttttgggggtagccccaagggggtagggggggggggtttaaattttccccatttaacccccccccggcccgacccccggctccccaaaaaaaacccccccccccccccgggggggggggggaaatttgtccccctttttggaccttttgggggaaaaaattccccaaaaaaatttttttttaagggccca

SEQ ID NO: 700313 - DNA, 761 bp, Homo sapiens
caccagatcatcccatgatgaggctttgaagaggcctccctcactgaagaggaggtccacggagcatccccccacatttaacaacgggaggctttctcgattgtgaaggagatttgttccagaataggtgaacctgggattattcccccaccccactttgtccccctctccatcttaacaggggtttgcaacactctgtttttgcttgtaggccctccactttttttatacacacacttttgtggataaagcgcgtttcccacgcacgagggcgacacactattttcttctaatggggacgagtggttgtaatgagcctcacgttcttactggaagaaagcatccacatggggaaccgtctggaacccgggtcaggcggaaagagggatggcgagtggctacagtgcaccacctctctacacgtctctgagctctactgcctctaagttgtagacacctctgtcctaggagacagaggaagaatgggggagctgtctggctgcatgcttttgggccacggggagccccaggaccttattgcaatccttatttctgaccccgtggcttcggctgagacctgtgtaacccctctgccccctccacccccaacccagtcctacactgtcacaccggacggacccgtctgtgccttttaccatcgttccaccaatgatgtaaaatactcatgttttacatcttttctttcatccgctggctccggccatatttgttgagacaatccccgggataacgatgcatta

SEQ ID NO: 700314 - DNA, 273 bp, Homo sapiens
tatcagagagtcaactttgtggcggaacgccgagatgccagccctacgacacatccacatgatatcgcggcagcagtgccgtcgtcaggtgcttgtacgacgctttcgtccaccgcgtgtcggggttgcagcagaatacccggggttgatttaagctgctcaaagggtgcaaagcacaaggtcgacatcggttttgaatctactcgcgcagttttactaccagaacagtcgggtaacagcagtctatacagccgacatcgataagcttcgggc

SEQ ID NO: 700315 - DNA, 1076 bp, Homo sapiens
  misc_feature (98)..(98): n is a, c, g, or t
ctcgtacttgcgtgctcctacacaatttctgtctatgtggatatgtcttgtcctggtactctcggtaatctcctcacaattgcgactgttgtagatcncaaagagaggctcgctccctcgtgattggtatcgtttctcctccccagatccttttgtgcattctcaggttcgggtatccgtgtagatccatcaggatttcaaggaattcgtcatgaatacgcttagtgcgccccgtcatgctcgtttcctaatgactgcagtggtaacagaggccgatggtcacatgggcaggacggatgcacaccgatgcagtgaccaattcacggtagttcagatgccacatcatagatatccaactgccatgagtgacttactagatgagagcagtgggtatccgggacagtgttccacttcccagaattcgggaactgtcgctctgatcaggacgcgtacctgtgatgccaggccagaacgtcccacatgagcgaccgctgagcctcttccatgccctcgtccatatgtcaggccctttcgcgctagtttcctgtccactgagagccgcatacccttgatagggtagaatgtgccttcctgccactagacaggccagcagccctgcagacagcgccagtgttcagtccacatccgaccccatcatgaccgccagagggatgaggctctcttcagagccgcctccccaaaccagcttcctcaggaaaagtcagttcccaaaagcagaatgaagcagagccaaggcctcagacaatgctcatcattcggatgatgctgaagacccaagtggcaagccagccgcattccagacctgggggagtgaagcatgtctgccaccgggaccctggagcaaggcacccagtatgtgtacatagctctgccagcggtggcagtaatagtgatcagtgacctggactatggagataatgcttttggagctggaagggtacagttagtggaatgcacctgaagagcgcctgcacccagaatagtgagacaacgtgaagaaacataagacgatccccggagaatagactatcgaaattgccctagagtcaccttca

SEQ ID NO: 700316 - DNA, 237 bp, Homo sapiens
aaactgccactctaaactcttgaagtaaataaataatctttggcggctggactatgctgaatctcctcacgcactctctaattagatggcctaggtcctcccaattcttagtccttttatacctctttttcgccttctcatattccatttagtttttcaattcatacaaaaccgtatccaggccatcaccaatcattctatatgacaaatgtttcttcttacatccccaaaatatca

SEQ ID NO: 700317 - DNA, 1008 bp, Homo sapiens
catcacccgatgaggcaaccagccagaatcgcctgaacgcaggcacatacttcctattgctacaccctagtaggtctccctttcccctgactcgatcgcacttaatttacacctcactaagacgcctaggctcactcatacattcttactactgcactctacactgtcccaaggaactatctaaactcgctgagctcaacaagcttaatatgactagcgttacacaattagcctgttgtatgaagttaaagcatgagcctgctttcacggcagctccaacttcatggaactcccgtgaagagctccatgttcgcaagcccccgatcgtctggcgtcaatagttgaccttgccgccaggtttactcttgagaaactaggcggctcatcggtataatacggcctcacagcgtcattctcaacctcgcctgacaataactacatagccgtaccccattccgttgtagcttactccctgatgaggcataatttattacaagagctggcgatctagcgctactgacaaacagaccttaaaagtcgttccattgcatacgtctgtcaaatcagagcacatagccctcgtaaggtagagcagccatggctcatccgaaaccaccctgaagcttcaccgtgcgcatgtcatctctcattaatcgcccacgggctttgcatcctcattactattctggcctagtcaaactcgacaagtacgagggcactcacagtccgcatgataatcctctctcaaggcgttcaaagctctattcccacctaaatagcttctgcgtgagtttctagcaagcctacggtagcctcgacgttaccccgcagagaattagcctacttgggaagaactcgtctgtggtaggtaaccacgttctacttgatccacatgtcaatcctcctaattaacgggagctcacattctgagtcgaagcgcttatatccctctacatatagagcacgaacagggggctcaataccgaacgagttaagacataaaagcgc

SEQ ID NO: 700318 - DNA, 621 bp, Homo sapiens
  misc_feature (568)..(568): n is a, c, g, or t
gattataggcgtgagccactgtgcccaaccacctgccactttttaaataaaacatttgtaatggtgccaaggaaaatggatcatctgtttgtctaaatatctaaagaactctgtctctattaaaactacaaaaaattagctaggcgtggtggtgggcacctgtaatcccagctcctcaggaggctgaggcaggagaatcacttgaacctggaaggcgggggttgcagtgagctgaaattgtgacattgcattccagcctgggtgacagagcaagactccatcacaaaaaaaaaaaacaaacacagcaaaaaaaaacttggtggggccggctctggcacctgaggagaaaggtttcaacaacccattccggttggggccgcgccgcaccccagtttggttaagcggacaaccattgggcatcaagggcgggtccccagagagaagacctggccaagagacataggggtggggtttcccccccaataaaaaacacgcccggggggacacccgacgcgtctcctggaaccaatccccagaaggggggtcgcgagggggaccaagcggggancacccacagggggcccaagggaagacgagaataataaccggcggaggagacac

SEQ ID NO: 700319 - DNA, 441 bp, Homo sapiens
gaaaaaacaataaaaagacggagaccaaaggaaacgtcatctcagtaaaatggttccacggggtgggagaggtttttttttaagacaatctaaattaaaaggtgattctttaaactggtttctcattaagttaatggacagcatattataagatgatgctggacggtgtcatcggtgtgggtaaaaatccacatatccgaatgggccacaagcctttctgagggttggtcttcggggagaatgggcggtgctcctggaaaggccagggggccttctggcgggggcgtgtaccaggcttcggcgtaatgggtaaacaaggcatggcatcttacacacacctggtttcctgagcggtgcggctccaccagcattgggggcataacaatcataagcacacccggtataagtcggttctcacacggctataaataaataaatacc

SEQ ID NO: 700320 - DNA, 625 bp, Homo sapiens
  misc_feature (314)..(314): n is a, c, g, or t
ccttgaaaaagcccaccctagggtagggacagtggaggacgtggcggcgatggtagttctggttgctgtcacgccaggccgggttcgtcaccgggcaagagttcgtggtggacggcggcatgagcaagaagatgatttacagcgagtagggcgggtagctgtcttgaagtcattttgtctttttcagaaaaacttcaagcaggctattgacttaggtccgctacctgcgtaaatttcgcggcctcaacgaagcaaagggtgattagctcagctgggagagcatctgccttacaagcagagggtcggcggttcgntcccgtcatcacccaccacttcttgagagttttgccctagggcaagacgcaacgttaaaggttgcaccgacgcgcagcggtagttcagtcggttagaataccggcctgtcacgccgggggtcgcgggttcgagtcccgtccgctgcgccatattttccaggttcgatatgtcgggcttgagattgaacagccaaggctgatcgatcagatgtttaaaggtggttgagggttcatgctcaatcagccaagcgatacgcagcggtagttcagtcggttagaataccggcctgtcaaaacgggggtcgcgggtt

SEQ ID NO: 700321 - DNA, 124 bp, Homo sapiens
ttctagagtgatccgtgcacacccctgctatgtggacaccccgctacgtggggagtgctgaggtgggaggattgcttgagccatggagtctgggctgtatgtgctgctatcggagcgggggtat

SEQ ID NO: 700322 - DNA, 122 bp, Homo sapiens
cacgagggctttctccaagttgtagactgaactctctgattttgtacaacagaaaaaccattcagttgacttaacaattgcccaggtgtatttttgattgtttcttttgttttgtttttaag

SEQ ID NO: 700323 - DNA, 129 bp, Homo sapiens
aactgagtggtagaatacgtttgtatagctcaggtacaaaatatacataacattattactatatcaatgggggtgggagagaagagtagctacccaatcagcttagacaattcagtagaatcatgctta

SEQ ID NO: 700324 - DNA, 199 bp, Homo sapiens
gcagaggaggagcgcagcctggctcgaagaacttctgcttgtggtggctgaactctgatcttgacctagagtcatggccatggcaacccaaaagggaggttactggtcaaagcgtgcttcagtgattcaagtgccatgtgaagatgcccatgaccctagagtgaaggccatagaaatgggctcgtgcacctgattgaat

SEQ ID NO: 700325 - DNA, 323 bp, Homo sapiens
caacggatggttacctcaactaggcagatgagtgaaaaccttggagttatagacctacagagtactacatgggaaactaatgctccagaaggcccagtgctgccttcgaacgagaatattagtagcattgcggatctctacttagtcctagctttcccctcattcctgatgtggtgtaattgaagggtgtgtgaatgctttgcctggtcatttgtcacctttatccagttgagggcttatacgcattaatgacacctattgcccattaacatcccatggcaaatattctgtgataaaatgtcgaactatcacgattgaatcca

SEQ ID NO: 700326 - DNA, 249 bp, Homo sapiens
ggcctcccaggttcaagcgattcttctgcctcagccaggacggcaggcatgcgccaccagggatggctaattttttattttaagtagagagggggtttcaccagtgtgggtcaggtggatctccggacctcaggtgatccacccacctcccaaagggcggggattacaggcatgagccaccacgcccagttagtcgcccaggccagagcgcaggggtgccgtaataattcacggcagcctcagactccg

SEQ ID NO: 700327 - DNA, 169 bp, Homo sapiens
tgcataccgagactcaatgggacctgtaccttagaggtttgagacaggtatttttgtttgtttgatgcaatattggtatctgtcatacagcaactacacagacagtggagagtggtggagacccagagcaagtgacctgtatagttcatggcaaagcaatgttctttca

SEQ ID NO: 700328 - DNA, 1056 bp, Homo sapiens
gactggctgctctgaaaagccatctttgcatttgttcctcatccgcctccttgcccgccgcagtcgcctccgccgcgcgcctcctccgccgccgctggactccggcagctttatcgccagagtccactgaactctcgcttttctttttaatcccctgcatcggatcaccggacgtgccccaccatgtacagacgcagaccgtaagacacacagatccgaaatcaccaccaaggacttaaaggacgaagaaggacagttgtggcagaggcagaaaaatggacagaagacgcccctgctaacgggaatgctacatgaggcaacatggggagcaggaggctgacaatgaggtagacgacggaccgacgacagaacggctggcgcgcggacagaggaccgagcgcacgcacgacggtgatggtgaggccagcaggcatggacgatgaccgcatgcaggaagctgaaccagctacgggcaagacgggcaagctgcacgctgcatgcacgactgacgactgtcgataaccacagaagcacggaagaaccgaacgagggatgacatagaccagcacaacaaacggacacacgtatacacataaaaagaaaccaaagagaccgacacgagaaccataatacaaacacatccaacataacgcgggtacaccacatcaacagaccgatgagaccaaccatatcagaggatacgcagaagggacaccgcaccgacaccaaacgaacgaaccaagggcacaagcaccggaaaaaataaaacaacaggcagcatcgtcacaacagccccagccccacaacggacccaaaaccagaagtgcaggaaaaataaggacaaacacccacggggcaagacgacaaacacacgcgagacagcaaaaagatacgagcccgaagggcaccccagaacatcgagcggccgcaacacaagaagagcaaacacaacaaaacaggaacaagcagaacaagagcaagcgacgacaaagcaccacctacgagagactgaagaaaacaacaatggagaaacggaccaccgagcactgaacaaaa

SEQ ID NO: 700329 - DNA, 1048 bp, Homo sapiens
gcagtgcgcggcctgacctggggcgggctgctactccgtgaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccaccgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccattggcaacagcctccgggggcattgtcaagcatctggagggtctctctgaagaggctatcatggagctgaacctgccgactggtattcccattgtctatgaattggacaagaacttgaagcctatcaagcccatgcagttatctgggggatgaacgagacggtgcgcaacaggccatggaagctgtggtggcaggccaaggcaaaaggcagcgggggcaagaacagtcccagagaccctcctgtccgttgactgcgcccactgaagttaggccattgagagtgagtgttcgacgggcagggacaacaaaactggcagagcacacataaatgaaagtaaaagtatactacacatctaacatataggagcagaaagacagagagaaaccaatatcgccatctacgcttc

SEQ ID NO: 700330 - DNA, 1521 bp, Homo sapiens
tggtggtgtttggttcattctgcatggtgtgtgttcttgggtcattttcttcctcgcctggcctttatgttttgtccttttcctgggcacctcagcttccatgtctttgcgcatccgtctcttcattcccccagttttttgcatgcgtcttgataggcttcatgttcgtgtccattcaatatgacctatgtgtattaccaggtcgtcagtttctgctgccttgatagctctgtttctcgagtagtaccctcctgtatgctttggacatattgtctcctcgtgtaggctgtttgccattgtggctgcttatcaagtactacgtttccccttccttgatctggggataccttatttcttctattccagaagggctagagctctttgcatatatgtatccttcaagactctcacaggtaggttagtctgatcttctgtgtaggtctgcatacctgcgatcctttctgtatgttgctgttgttataggtatggtcgggctccatcggagctggtgggacatcataggagcgcctccagtatcttcacctgggcctcaccatgctttgcagcagtttctgctttattgagtaccggttagacccccatagtgccgtctcattgaggcgccaagtcctctaccactggcacctactatctgatcaatggcatctagcactgtccagtaggtccggatcgctctcttctgctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccattggcaacagcctccgggggcattgtcaagcatctggagggtctctctgaagaggctatcatggagctgaacctgccgactggtattcccattgtctatgaattggacaagaacttgaagcctatcaagcccatgcagttatctgggggatgaacgagacggtgcgcaacaggccatggaagctgtggtggcaggccaaggcaaaaggcagcgggggcaagaacagtcccagagaccctcctgtccgttgactgcgcccactgaagttaggccattgagagtgagtgttcgacgggcagggacaacaaaactggcagagcacacataaatgaaagtaaaagtatactacacatctaacatataggagcagaaagacagagagaaaccaatatcgccatctacgcttc

SEQ ID NO: 700331 - DNA, 156 bp, Homo sapiens
  misc_feature (16)..(16): n is a, c, g, or t
  misc_feature (39)..(39): n is a, c, g, or t
  misc_feature (60)..(60): n is a, c, g, or t
  misc_feature (125)..(125): n is a, c, g, or t
gagagaaagtaactcnaggacgagaccggagcgacccgncagagcaataggcggcgactngcccaggccccgagaccggcagctgcgtggggcgggggctgcgcgagccagatctgccgctccgntccgagtggtctcggaaagagggtcgtggtc

SEQ ID NO: 700332 - DNA, 453 bp, Homo sapiens
  misc_feature (9)..(9): n is a, c, g, or t
  misc_feature (43)..(43): n is a, c, g, or t
gggcccccnaaaccccaggttttgtccctgctcccctttccgnggggagatttccccaaaacccggtcacccttctcctctttgggtaagggttttttctccccccccctccccctggggtgggggggaattggggggccggggaaaaattccaaaacccccccccccggttggggttccggggggcctttttttttttttaaaaacccccccgggggcaaaaaagggggggcccggggggggttttttttttttccctttttggtttggggtttggcccccccccccccccgaaagggcctttcctttttcccggggtttttggtgggggggggggccccccccccccccccggggtttttgggtggggggggggttttttggggggcccccctttttatttttttccggggccccgggggggggttttggccccccccccccccctgggga

SEQ ID NO: 700333 - DNA, 428 bp, Homo sapiens
gataggaagagtgagtgtggtgaggtgactgtgggatgtgcgggatgggtgacgggcttctgggtgacgaggtgtgtgtgaaaaaaactgtagtcaggtctctgtgctgggatggatgatcgggccttctgagtgatgcaggtgtgtgtgacagtgcaattgtagcctccagaagtctctgcgtgcttcccctgacttacactcctaaccaagcggtacctgcctgagaacaaagggccgcggagggacgtgagcgcctgagcctcgccgtggaaattcaccagcaagaaggcagaacacagccatgaggtgacggcttcagagccagaaagtgctgtgcatgcaggcacctgagtgacagggggacggtggctcaggaggtagaattcctcctgttagaggggacagggtcctgatgtgggaaacag

SEQ ID NO: 700334 - DNA, 822 bp, Homo sapiens
  misc_feature (1)..(1): n is a, c, g, or t
  misc_feature (300)..(300): n is a, c, g, or t
ntcgaaagttctgcgtcttgcccccccctgcttaattatgattgtgttcctcaaagaagtataatgggttgtcgccgacccccgctagcggtctggtgtaggtgcgctcgatgatatactctcctgtgcccgagcagaggtgttgctgtcgccgacgactgtgctggtgcgatgcatggtatttcctctcagctgctctgtggtgaagcggagcaaagcgcgcggggtgtgcttggtatgtctattcctattctcatgtgtatgggggcgtctctcctctgatcagtctgttcttggtgntggtgatatgataaacccgatagtgaagggcgctcccccccgacgactgcgatggtgtagcagaaacagactatgagcatgagtggtttctcttcctctacggcgctgccgcaacgcgtcctgtataggcccaacccacggcgggtagtgaaagtgcggtgctctccacgacgttgcgatgggatacgtagggtgtaacatactccactagagtaaaagcgcccctatacttgtgtgttcatgttataagaaccactggagtagacacatacattaccccccgcaggacaatagagagtcagttcttccttatgttcattatagaggagagatatggctcctcgtgtgccccctcgccactggtagagtccaacttcccccccgtcttggggtgcggactccctccttccacccgccgcgtgcggtcgtatgggctctgcccctcccttcgctacgctcgccgtgaacgtggcctgaacaagggagaaaagaaattcctttttcgtaccgaaacaaaacaca

SEQ ID NO: 700335 - DNA, 1010 bp, Homo sapiens
cgcagctgtggcggtacctggagctgacagagactggcaggcacgtgcgtgcttggagtgccatgcgacgtagacaatggtgcgaagacgcgaaacggcaaattcagcctccgtacgcgtcagagacgaggccatgtcagcgagggaggaagaggacctgtgcctgcacgaggggataggctgggtgcggagacaaaagcagaggaaccgtcaggccgcacgggtcaagacgaccgagccaccagaagacgcgacgaagagttgttccagaagtgagcaaggcgtcacgcaagggccgtcgcggacggtcatggccattcgcttaggatagcgcgtagaccccaatttcgccccgttcccgtcagagcccccgaacgaaggccttttcaagcacaggtaaagattatcggcgttcccggtgggccaaaccagtaaactcgagagaaagcaacagagaaacagaacaagaagaaacacgagtagtaataacaggcacccgaaagtctagcaatacagcagcccacagagcgaacaaacgacagagagagccaagggagcgtgcatcactatgctctgcagaaacaatcgagcactcatcaccgagacagaccacccagtgagggacagaccgcacacatcacttcctaggtaccgacgcgagccagtaactaacagtcgagagagtcaagtgaacccaccacacacgagcgggggtcgaaacctacacaagcgagacacaagagcgcacacaagcggtcaccgtgaatctagaacacagacgagacaacgagacggaaaccttaggaggcgcgaaaccgcaacacgcaatagacgaacaaaccaagacgcaacggatgctagcgcacttgtgtgcaggagatgagaaaactacacgcggcacgacatacaacggagagcgggacaccgacaacactagagtgagcagaccagaacagcacccactctttaacacagctgtggaggcgagggacaaaataccgcataaaaac

SEQ ID NO: 700336 - DNA, 218 bp, Homo sapiens
gataagagtgtattttggggatacacgttgagtatcccttatctgaaatgcttggaaccagaggtattttggatttcagtttttttcagattttggaatacccgtatttgcattatactggttgggcatcctggaccagaaatctgaaatgttccagttagtattcctttgagtttcaagttgtaaaatttggagcattgtcgagtttggatgctcaa

SEQ ID NO: 700337 - DNA, 1594 bp, Homo sapiens
  misc_feature (1)..(1): n is a, c, g, or t
  misc_feature (138)..(138): n is a, c, g, or t
nttatagacaccacggcccgttctcttttttggtggcaccgccccctgcagtggtctctccccctgtggtgcactcccaaatcgtacgacccgtggtggtgtttacacccctcctccatattagagagagccgcctcntgggggggctcatgattttctcttacctcctttctccgtggaattttttatcccccttactgtgccccctcgcggggcgcccggtggtgttccccgcaagtgtgttcttccacaccgggtgggatgactcatgcggttgtgtgtcgccctctctgttggccccgctatatttttttgtggggtgggcaacccccttcatttagggacaccgcaagatggttgggttcacccacaacataaagcccagagctcttgtgtgtaacacctgcggttccccgtggatattttttcccccccgcgaattttggtgttggtgctttctgtccctttttagtagcccgccaatacagacgtggggggtaaaatttcagggtggtgcgctcccacaacatagtcccgactagtggggccccaccgcgagagacgctgtcggggtgttttttgctgtccccccagacaaaaccatgtgattgtgtgttggaacccccctcctctgcgtggggatgaagccccccttcttttcgtggacgacggatatattctcctcgtctggtctttcgtcgaacgcacaccacgagatggctctggtcaaagagcttcgtatatttatcgctgcgcgcacgattaattatagtgtgctttctcgcggtgaatcaacaaaacggcggggtaggagttttcttcgtacagggtgtcccacacaactttgtaaacaccccttggcgccgcacagagattttctcgcctcatagtcgtctcgccctccgcgggtgtatactttctcttctaaaacgcgcctttgtattgtaggtaaaaggggagacctcccctccgcggcttttctttattttctaaaagggcacatacgcccccctcttacttgacggcacgcgcgctgggttacccaccactcttggggggttctctctcgagtattagtgggcccaaaaatgatagacccttgggagtatacaccatcctcttggggcgcctgcaaagaatatagagcgagagatttttcttatagagagaggaaaccccctcgccacagaaccccacgggtttttcaccagactggcgcttgtggccacacaatccactactcacacacacacgctctgcgctgttagatataccccccacgcgcccactacttcacgggtctccccacaagacacggtggatgaaacattcccgcttccttcaactgtgtcgccccctcggagtttcccacaaagcgaccacttcgaatttttcttctgcggctctcttccctaacgcggggtggccgccccgcggcccgccgttgaaagaaggaaagaattccccaaaatgggccacaggtggggctgtgggctggaaaccacacaggaggaggattaaatccccccgtccctcctgggttggtggaattgttttgtttttctccccaaataacaggatccgcccttttcca

SEQ ID NO: 700338 - DNA, 161 bp, Homo sapiens
tctgaggatcccggggctcagttgatcctcaaggatacagatccaccgggatgatgctctccggagccaggaggacctgaaggaccagcgggctatggtggagcgcagagccaaccggctgcaggctgagatcgaggagctgcgggccactcgggaacaga

SEQ ID NO: 700339 - DNA, 130 bp, Homo sapiens
cttgatgacacaggagatggagaagtcgtcacaattgagaaaacatatttaataaatcattgtcaatatttgtataactgtttcaagccctattctttgttgatatgcctccacagtttatataggttaa

SEQ ID NO: 700340 - DNA, 770 bp, Homo sapiens
ggcgctgctcgcagctcgcaggcgccgcgtaagcctgtctgccaccgccgccagcccgtgcgccctcgtgcgctgtaccctgccgctgctcccatccccgcccgccgtgccaggggtgctgccgctcgtgcctgccctggacaggtgtccctgctgcggctccgcggcgatggccaccaagatctgacaaagatggcttgcctgggcggtgtacaacctggtgcgcgacgactgggctcggccgtcatctgtgagttgacttttaaatatagacggtccaccatcgtccccggcgagcagggagccggagtaccagcacttcatccagcatgtgcacagatgacgtcctggttgtttgccttcgtgctgcttcaccaccggggatgccatgaagcaagagggtccaagttttgccctcatcacgtgatcgggtgagaacgtcagcgggctgcatcgcgccaaaaccgtggatggacaatgaccctgggtgaaggaggtcggaacagaaatttcggctaaggcagtttgtagattcagtggaatcgggaaggcagctggcaaggcaaagctttccataccaagagcggacagattgaaacaaaggcggtggtggaatacaaaatcacgaaacccagaataggaagtaacaccaagccaccctgacaagacaacaaccttgcaaaaaggtaatcgtgcctgattccccgagaggagaggaccgccgactcagataattaaccaaaaagaccaacaggaacaaaagaagccta

SEQ ID NO: 700341 - DNA, 853 bp, Homo sapiens
gagagcccgctagtcgtccaggagcctagtagcgcagaggggggcacccagccataacaaggagggttgtgggggccacgccgcacacaccgataaaacgtgtgccggaagacaccacacagggggggggggcactttaaacaaccgtggagcacacattgcaggcaagcacacaaggagagttgtaaacacagggggcactgcccacgtgtgccacacgccacgcgaggatgattgttcgaggccccgctgtctctccaccaaagagaggtctttccccttctctgtgtgccaacctggtgttgatacacacctatcgcacagagggggggcgccgccctgttgcccacacatctagagggtcagctttggagctcaccgaatggggcctctgacacacagttttcccaccgaccaacgtgggcgccgcgggaccacacccgttcccacttcttgtggggcttggttccctcggatgtctttggcgcctgcgcctcttcccaaaccccttctcccgaggggctacgcgccacaagggtcccaccggggacacctccctccaacaggaggaagacagccacacccctgggggcgccagctgggtctgccacagaagaggtgggaagacttcttagctgtcttggtgcgcgcccacttgaggcgcgccatcgagacacccccggatccccagaagcgattctcccaggcaactccctcccaccaaagtacttttgcctgaccccaaatgggggcctcaccccccaagggtagggcccccaatatttttttataatattttttgtttgatctacttttaggagggtactcttttaaataacatgggccctgatta

SEQ ID NO: 700342 - DNA, 185 bp, Homo sapiens
accagcttccaccccacggggcccgggcacagttctaccagctcaggaagcagctcccacccttggggccagggcacagttctaccagctcaggaggcagctcccaccctaaggggcccgggcacagttctaccagctcaggaggcagctcccaccccacggggcccgggcacagttctaccagc

SEQ ID NO: 700343 - DNA, 216 bp, Homo sapiens
ttaatgcccccctggccccccttccctttaatttttaaaagaacaggatattttttttttcctagagccctcagatgagaggggaccggatttttttttgcccgtttcccattccccaaagacctctttctttggggggccaaggggggggggtccctttaaccccggggtttgacctccacctgggcaacatgggggccccccgtttttttcgga

SEQ ID NO: 700344 - DNA, 862 bp, Homo sapiens
  misc_feature (565)..(565): n is a, c, g, or t
  misc_feature (580)..(580): n is a, c, g, or t
caagacccatggagaattcaggagcgatgctgactatcaattaccaactattgcggtgtaatgtagacttgttatagataattcagctaggactgacatttatgaatgagcaaggagaataccctccaggtaacttctgcttggcaggtttaattttaaatttaatttgacggaggacatgtatgcccaggactctatagagctactaacaacatctggtatccagtttaaagaacatgaggaggaaggagagttgaagacccagtactttgcagaactgtcttatgagttctggaggtggtcctctgggaaggggtccaatggttgtcatgtcagtagcggttagcgacgtttggctacttaagtcaacacatcctaaccaagcatctaacttgcctgacatgaagaacttgacttcttttgagatccttcgattgtgattttcctgtcatttatgagtgtgaagtacctcatgaagagctgcgatatctcaataggtggacttacaggaggtggcagaaccgttagagtctgctaacggataggaatcacaacattcaggcanggatctgagttcatngctcacaggagctggctcttttcagaatgagagaactgtcttttgacgcaccatatgatgatgccactattgtgctcattctgtatgggcatgggttttggttcatcctatgtactgaaatggcccggtatgcttggacgaggagccacacgcgcctgcacgcacaggccgttataaatcgaggtaacaatgctgcttattggtgaactggagacctcgaaaaagagacctttcccctatggcattggtggcctcgacataccgccttagttataaaaaagc

SEQ ID NO: 700345 - DNA, 448 bp, Homo sapiens
  misc_feature (333)..(333): n is a, c, g, or t
gccccccccagactagggctagtgagagcaggcgtaatgagcagactatacggcgtaagtacgagctggtgggaatcggccgaggcatctcgcctctgtcttccgcgtcgcggcgcgtctctgcgtcgcatggaagagagatcgcgcgctgtcatgacatggctcggcatgtgcaagctgttgctggggacgaagctcccgagccggtttcttccatcgtcgggcgccagacacaggcgtctggtgggatgggcgaaggactctacgtgggcgacgaggccagagcaagcgtggcatcctgaccctgaagtaccccaatttgagcattggcanttccggtcaccaaactgggacgacatggagaagatctggcaccacaccttctacaacgagctgcgcgtggcccggaggagcaccagtggtggtgactgagccccctgaacccagg

SEQ ID NO: 700346 - DNA, 698 bp, Homo sapiens
tagcagctacccaggcttccctgtgagtcggccccacggatcatgcggctggtggcctgaatgcagcctgctccagtggcccggtgcaggcgagctgtggctgcctgcatggtgacagtggccactcctgtgttcatgccagtggtgccgcaggccaccatgaagggcatcacgacctgaacatgctggactgctctggtgttgccgcatctgcctgggcaatacctaccatctgggtctaagtgccggttgaccctgagctgatccagaaagccaactggtctccactggcttcattgaatttggcctcataatctgctaactggacagctggctggtttccaggattggtgtctgcatggttgtctactgtcctgaggttgactgtgaggcagggctgtcctgacttcctgcatccacccgtacagacgtgcaaagtggaggaacccattgcatgaagcacctgggaggaaagtccagtagcaggagtccacgacatgctggcttggggctctggtgacatctatcattgccagcttgagactgaccgtaggattagacaatgtacatgttgcacttgtgtgccacgttgtgcgagtgcagtgccattgtaccaggtccaatcccgcttgggctggacctaggtgcacttgcaagtcccatcaggcgtgccggaacaagcaggaacctccttcgac

SEQ ID NO: 700347 - DNA, 108 bp, Homo sapiens
gccatagataatttggaaagtggaaagccattccaatctcgttgggtaaacaattaactaagacttacatttataacaaaggctccagaactggccaatccaatgggg

SEQ ID NO: 700348 - DNA, 667 bp, Homo sapiens
caactcgcatgaagtacgccctcgaatacagtattctatcctatctgttctctgtgagatacacaatatgcttcacaacacacatccttatcgactatgccatactagttagtatgctcaccagataacgcgatatttagtctcatcactttgaatacaaagtgcgctcattgtattcccatgatccggtctacgactgatatcgtcgatctggtaccatgagtgtacatatgggatctgcttagaattatcatctaatctcaatcactttgtctcgtaatctgtataagacatacatactcattactatcgccagttctctaacaggtcatgatgacagcaacgactgagctcaatgagctccatcggtatcggtattccgacgacacgcctctctgcgtgctacctcgttgtatatgcgagatgtgtatcgggcttttgctgactgtaccatatatgcacttatctgatgagccgcgatttgactattcagataacgaatatatttcgtcacctagtcactaaaatcacatatatcttctattgtactaattcttgattatgctttcaaagttcctcgctcagatgttgatctcgacgatactttataccatagcaagaagttaccttatacattacatattcggtcaattcactgccataagag

SEQ ID NO: 700349 - DNA, 569 bp, Homo sapiens
gcacggcaccatggaaatgtagctgaacgtctccagtttccttcttgggcaacttctgtattatgcacgtgaagccttcccggagccagcgagcatatgctgcgagtgaggacctttctatcttacattatggctgggaatcttactctttcatctgataccttgttcagatttcaaaatagttgtagccttatcctggtttacagatgtgaaatttcacagagatttactgacttctcctagatagtcttatgaactgtgctttaaagcatgtgataggatgctgtacggttagttttgtgaaaacagtccctttctcctaggtaatgagtaggctgtcataactttagttctatgcatactgcatctttacatgctatcatgtacatttagatgatggccttgatttttttaaatctgtgtgtgtgtgtgtaaatgccaataagaccactgctttcatccatgtagcttaacgtgtatgtggtccacgacatgggagattctaatttactactcatatatgcgatgcgctatattagcttaataagcaatatatatggtttaaacag

SEQ ID NO: 700350 - DNA, 287 bp, Homo sapiens
ccttgcttctgcgtcagtctgaggatcccctccgaaagctagtacccaaatacaaaaaattagctggggtgtagtggcaggcgcctgtagtcccagctacttgggaggctgaggcaggagaatggcgtgaacccgggaggcagagcttgcagtgagccgagatcatgccactgcactccagcgtgggcaacagagtgtgactctgtctcaaaaacaaaaatgaggtcttggcctggcgcagtggctcacacctgtaaccccagcactttgggtactacgctttggca

SEQ ID NO: 700351 - DNA, 589 bp, Homo sapiens
ctgttttatcaaaatcgcgtgcggggcctcggtacttttactatagaggattctctactatgggtgccttactttctgctgagagtattcatctttttccatccccatcagacctttgaattccacacttacatcaccttccatggctgccttttactcctcattagttttagcggggggcgggattcattcttcagtccatattggagctctactctagctaacgctctcgaccgccaagatgcagttcacataagcacagcacagctttgtcatacgaacaatgccctgctgccataccaaaactaacctcatgagagattcagagatcttgcaccttctggtgccctatacgccacatacattgagtaactactggcaacatgtgacaatctttacctccacatgttagctgccatttgttcactctgacttgacctatcactacttattattccctgaaccctaactccaggactgcttcctgcgaacaagttaccgactcaaacacttattgtgcatatcaataactacttgtggcaggaggccttttcctacaaatgtacctcttctatttagccacactttt

SEQ ID NO: 700352 - DNA, 360 bp, Homo sapiens
tacagagtgaatgtgaggtgtactccatggccatcctgcttcgtgaagaaggcttgctggaacgcaccatcggctacgccacggacatcaaccccgcgtcgctggacaaagccaagcagggcatcttttccctggagaacgtgcgcgcctacaccgccaattatcagcaggccggcgggcaacgttcatttgccgactactacacagcggcttacgattacgcgatcttcgacaagacattgcgcgagaacgtgacctttgccgaccacagcctggcaaccgacagcgtattctcagaaactcaattaatttcatgtcgtaacgtattgatttatttcaataaaaaattgcaagatcgag

SEQ ID NO: 700353 - DNA, 191 bp, Homo sapiens
ttttttttaaaggaaaacccccctttttttttttggcttttttaaaggggggtttaggggggcccggggaacgttacatgactcgttgagaaaggtgggggatttcctcccccccctttgggggttgaagaaaaacaggtttttttaaaaagagggggtttctttgaagaaaagaaaaaaccccccgttta

SEQ ID NO: 700354 - DNA, 758 bp, Homo sapiens
  misc_feature (666)..(666): n is a, c, g, or t
ttgtggggaggcctcaggaaaactacaatcatggcggaaggtgatgggggagccagcacttcacatggccaggagcagcaggaagtggaagaggtgctacacacttttaaacagccacatctcatgagaactcactatctccacaacagcaccaagagggatggtgttaaaccatgagaaaccagccccatgatccaatcacctcctaccaagctccatcttcaacaatgggaattacagttcaacgtgaaatttgagcaaagacacagattgaaaccataccagccatagatgggtgctgcacagccagggctttccgtttggagctgcccattaaatacccagttgctgtgcccattcactggcaggccaattaatactttctaatataatttaataaacccttaactttgtgagtggccaaatggctactactactcagttttcaagactcagttccaatatgcagatacagttgtgaaagaatggagaaaactgttgagattagtttatactgggaaaggagagtaagttggggtgatcatgtacagggacttttcacctgtataacctcctatggctttttgaagtatcatacaatatatagtgtattaatcgatcataaaaagacatttcacaaagttaaaatatatggggagtgtccanccttactgatatataggatttaaaattaacctaaaatgaccttgttaatgatagggcaaaaagcccttatatagatatacaattaatatttc

SEQ ID NO: 700355 - DNA, 133 bp, Homo sapiens
gaagatgaagaagatagaaaccgacctggattactccggtcttctgagccctgtcccctcgtgtatctccagggtctattcccagcacctttccactttccttcctgggatcactgtgggtcctgtgcgcaag

SEQ ID NO: 700356 - DNA, 957 bp, Homo sapiens
ggccccgctgcgccggccgagtcgctgagccgcggctgccggacgggacgggaccggctagtgctggtgctgcgccccccgggccccgccgtgggcattgtgcgcactggccctgggcgctgctgctgcctctgctggcccagtggctcctgcgcgcctgcccctggatgcttggcccccgctgcccttcacgctgcccctccgggtggcctgctggcacagaaccgcgtagttgcgcccacccctgggacccgggaccccttgtcggagctgccacgtccgacgtgtcttgtgcgctcgccctgtgagccttgcccttggcgttcccctgctgggcgccctgcaacattctttggccaatggtatgagcaacctgcagggtgggacttctggccggcggtcttactaccttggagaatgctgatcggtgacccccccggagaagctacagatttctcgtatgacactggaagcagtaaacttttgccgtggcaggaaaccccgcactcctacattaaacaccgtactttgacacagaggaggtctagccaacattaccgttccaacgggcctttgacgttcaccagtgaagtaccacacaagggaaccttggaccggcgcttcgactgggggaagacctcgtcaccatccccaaaggcttcaatacttctttacttgtcaacatttgccactatctttgaactcagagaattcctcttggcctgggattaaactggaactggaactactttgtgctagccttatgccaagactttgccaagccatcaagtactatggagaccttctttgacttccctggtgacacaagcaagattcccaataggtttcttcctgcagatgttctgagccggatgccagttgctggatctgggaccacggaggtagcatagtttgggtggattgacccagtctgtataaggaacatctgataaccca

SEQ ID NO: 700357 - DNA, 127 bp, Homo sapiens
cgagagccaccatcctgtagacctgacagtggcatgcaagatacacatttctttgctgtaccttgtctactgctttatatccccttgtgtgctgtcgagtttggggtatcagacgaactgccgcagt

SEQ ID NO: 700358 - DNA, 409 bp, Homo sapiens
gtcttcggtctttgtgtattgtggtacgagcagagaattcgcattgagaaaacgtgggttcagatcctggttctgtcacctcctagttcaatgactttgggcaagctatttagcctctttgagtcttgagttccttatcagtccctggcccacctttcctcacagggtagtttagaaagtgtaggccagatgactaacaagacaggcatgtggagatgcagagactgtactaacacaaggtgttttaactagaaaactcgaacagggtcagacctttgagcactccctgtcatagctggaaccatagtgggacaggcacgtggatagatgtacactgaagacacttccaggtcaaagaggccacttgcctggcctgggctgagccctcaagataaaggggattggtctg

SEQ ID NO: 700359 - DNA, 364 bp, Homo sapiens
  misc_feature (19)..(19): n is a, c, g, or t
  misc_feature (356)..(356): n is a, c, g, or t
ggatttcaaccagatgagnagtagacaagaaagaaaaagaaaacttcagaacaatattcattaaactaaaactgaatttatttcttttggtggaaaatcatcagaaaaaacaaatttaaaagttaaattcaaattgaaattatgttttttgtataaagtaatccattctttagtgtgacaaagatccaaagatatgtgtgtgtgtgtgtgtgtgtgtgtgtgtgtgtgtgtgtgtgtgtgtacatgagcgtacgatcgtacatgagtcagttttctgtattcatagtcagattggtcacaagatattccttgatttcaaattcacagaagcttaagcctctttttttaaaaaggcngtgggggt

SEQ ID NO: 700360 - DNA, 936 bp, Homo sapiens
tgcgcggccactgtctcttcgccagtaggtggtgaatggcgtcctgtgctcggagctgtagactgaggacgatgaggaggaggaggagggttcggtagggagacgcccgaagacagagcaggtgcgtctgcatgtctggcgcggaaagcagggaagttgccgagctcctatcgaaaaggacgagagacaatacaacgatcgtgtttgggaaagtttccttctgactagaacacaatatccggtgcatcctaacgtttaatatagttggcataatagcgaaataatctgcgagatagccatctcgtggtccatcgattgtggatgtaatggacagttcgcgaggagtcatgggagcaggcatagttaggttagtagcgtaaagacgtcgtggactgccatcggtgtagcaacgaacaagacactacacatctgatgcctccatcagcagggccttcctgctgtgtttttactcattctaacaaatccaatttcccctcgggtgttctctcatctgatcagtagcagctctgacctagtgattggcatgaaggcatcaaagccaaggaagtcacgtggggcctggtaaaaaggttggagggactcttggatccaacgggaaaggaaaccaatgacgagcattacaatactttcatcaactaatggatacgagcgatggttacccggatctattaatagagcctcatgatatccacgcggaaagctcttctcttttctccatatttcctgaggagccctaaaaacacagaatttcataagactcggcggttgtttggtccatttgctagaaccaaccgaatatatgtaactagggaccttacctgcagagagttctaaggctaatgtccaagttttgggaaaatccccggcaattgctggaacttgtggttatacttggatgtcgcatggcacatgcgc

SEQ ID NO: 700361 - DNA, 211 bp, Homo sapiens
ggacaggaaaagaatggtattaagctgattctcagcaacaagtgctttgggggatagcagaaagtttctgaacatgacagtgttgagagctaagcctgcataatgcaattagctgtctacgttaccaccaaaggcagaaacagtaaagtgccctgcctggaataggctctcaggtttaacttgcacaactgcacaagcttgtggagatggt

SEQ ID NO: 700362 - DNA, 411 bp, Homo sapiens
gaaacaggcaatgacctgggaactatttctgaacacccctaggtttcccgtgtatgccctttcctttcacatttggacccctttgtgtgctgaccactgggctgtttcacatggacataacataaaaaagacaggccaggtgcattggctcatgcctgtaatcacagcactttgggaggccgaggtaggcgaatcgcttgaggccgggagttcaagatctgcctggccagcatgagtaaaccccgtctctaccaaaaatatgaaattagctgggtgcggtgatgcacacctttgatcccagctatctcaggaggctgaggctggagaatcccttgagcccgggaggcagagactgcagtgagccgagatcgcgccatctgcactccagcctgggtgagagtgagactctta

SEQ ID NO: 700363 - DNA, 326 bp, Homo sapiens
tgtggtttgaacagttgtcccctccaagtgtcatggtgaaatttaatctccaatatgggcgtattgagaggtggggcctataggaggtgaatgggtcatgatggctctgctctcatgaatggattaatccattaacaggttatcgcaggagtgggaatggtgaataaagaggaaatgagacttaagctagcctccttgccatgtgatactctgcaccaccttgagactctgcagagagtacccaccaacaaggaagctctcaccagatgcgcccccttgaccttggacttctcgtcgacgcggccgcgaatttagtagtagtaggc

SEQ ID NO: 700364 - DNA, 112 bp, Homo sapiens
cagtggtgatctagaactcctgatctcaagtgatcaccgccttgcctcccagagtgctgagattgcaggcgttagctagcgttgcacagcatggagttaatactttctagaa

SEQ ID NO: 700365 - DNA, 483 bp, Homo sapiens
  misc_feature (36)..(36): n is a, c, g, or t
  misc_feature (69)..(69): n is a, c, g, or t
  misc_feature (337)..(337): n is a, c, g, or t
tcgaacaaatggaagaatgcggtgatcatagaccanagacacacagataattaaccccatgtgtccacncaggccaaagttcttcctgataccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaaattgtttttatatcaagaaggtttccaaagcaaatttgcaatattttcaaaacaagttntagatggccattcccccataaggaaaaaaaaaacagcattcttttttcaatatctgtcaattcagatgtcattaaaataaatggatgagtcacagaggagctatcagatgctttcatgactaccataatccaaaaaaaaaaacaaa

SEQ ID NO: 700366 - DNA, 167 bp, Homo sapiens
gtcttttcccctcaaattccccggaactcccctagcgtcatcatatcgttgcagcgcttgggcacagatgcacatacctccacagcttgctctagatctgcagtatccatcccagccctattgtaatacttgagaaaatccttgagcagcatctgcgttccacttga

SEQ ID NO: 700367 - DNA, 768 bp, Homo sapiens
cggcacgagggagattgtgcgatctctgcgcgctggggcccctggattgtttcgctaccggcgcggaggaacgccgtgcatgggcctaaaggccacggaggtggaggagcagaacctgcagggccgaccttgagcccaagtactgaaagccctgaatcaccactgtccagaatctggacctatagagcgggatcccaaggctacaaagcaggagctgaggaagattttgcaggcacaggaaactttttaccagcaggtgaagcagctgccagaggcttctgcggattaggcctagaagctgcaggaacttgaacaagaggatggagaaccctttctggctgtcatggaaaagcggctatttgagtacttgagtcagatggagaaagcactgcctacaccgcaagcacagcagctacacgatgtgctgagatggaagcaacctggagtctctatcacctcttctcttgcctggagacaatatgaggtggacatggggtggatgcttccagagagaaatgtaactgactcagagaacctgggtgagcccatggaacagaaaccccctcagcaacaaagactaggactccacaatcccctgccaaaagccaagccctggcacacatctgcctcagggaccatctttaaggacgcacccagaacctctagctggccgagacttctggccccactagggcgacgaagagctcagggccaatggggctccactaggggaggcccggagcggcccacagccgcagtttcctatgg

SEQ ID NO: 700368 - DNA, 743 bp, Homo sapiens
  misc_feature (525)..(525): n is a, c, g, or t
gacagtatgaaatggaaggcggcaagaacttcccggcactgacggccggtccgaatcccggcgccttatcaaaccgacagtgacagcgtcaccccacccgccgacggcgtcatcctcagcggtggcaagaccgatgcccgtgactgcatcaacttcacccacgaggaaatggccaagaaacttggccgcgccttcacctggccgttgctcaatgtcgagtcgggtcagaccttcaaggtcacctgggcatacaccgcgccgcacaccacccgtggctatcgctggctgatcaccaaggatggctgggatccgaaacagcgcatcacccgcgcacagctggaagcccagccgttcgctgaagacttctatgcccaggtgccgtactacagccatgcaggcgaactgaaggccaaggtcgatcatgaagtgaaactgccgacccacaaaaagggccagcatgtgattgtgttgatgtggatcgtcgccaacaccggcaacgccttctatcaagccttcgatgtgganttcaaataagcccgcgccgttaaacccacacgttctgaaggattagaacatgtcaagattgacttacctcactgcaatcgccgctcaacgatgccgcttcgccgatgccgagcatcgccggcaaaaagatcctcatgggcttctggcacaactggcctgccggcccgagcgatggctaccagcgtggccagttcgccaatatcagcctggtggatgtg

SEQ ID NO: 700369 - DNA, 136 bp, Homo sapiens
tccactgcaaagctaactatgcaagacagacgatcatgcaggtgtgggtgtcctgaatgatgtgctcattatcttgttcacgcctttatggatgtcagactagtatagatggatctagaaatgttatacctggtga

SEQ ID NO: 700370 - DNA, 313 bp, Homo sapiens
aggatcctccacactagtccaagataagtgtatacccaccatgaggtagctaattacatattctcctttaagagtataagaccacttttttaagtggggaaaaaactccagcttgccagtttaagaaaacttctaaaagtaccgaccacttgggccctgggggacccccatgttccacgaggcaaattccaaaagtcttttaaaccaaaagtatgggcctggcggtggctcgcgcctataatcccaggacttcgggaggcccatgcaggtggaccacctgaggtgggagaatcctttgagcccgagagtttaa

SEQ ID NO: 700371 - DNA, 339 bp, Homo sapiens
  misc_feature (65)..(65): n is a, c, g, or t
tacaagagggcgggcgaagaggtatttacgctgatcaggaccacctcctcttcaaccgtctctgnacagaacttctatgtggcgaaaagtctcgccgctctttacccggaaacaggttggggagatgacacgcagaaaatcatacgcaaccgcatcggggagagccgcggccagttctactttgacgtacaggaaggctccaactgggcccttcagcgcgaacagcaacgcttgcgcgaagagcggcgagtgcagcagcagatggcagaactccactctcgggtgcttgagcgctatgagcagctgaaggcgggcatgaaggactacgaaggcagggag

SEQ ID NO: 700372 - DNA, 456 bp, Homo sapiens
caggccgcccgccgggatgcatgtgggccgtgggccggcggtgggctgtgggcctgcgctgcgtcctgtgctgtcgcagcgtgtgcttgacccagtgtcgtcttgtgctctgtgctgggtactgcatgatgcttctgtctatccatgctgctgaatgatgatatgctgcatgttgtgctgctggcatgtactgctgtgtgcttgtgaccactgatgcttgtgccttcatctctgtacttgatctgttggatgcttgcggcggtgctgcactccatgtgccactgttgcttggccctgactgatgtgatgcttgcaggttggtgttgttctgttgaaattgctgtggttggcttggattgtgtgctgccaatagtagccattcttgcactgcctctgctagtcctgagtattgttgcttgctacttcggtgcacctgccattgtggcttccctgctg

SEQ ID NO: 700373 - DNA, 575 bp, Homo sapiens
tgcctcctacaggcagcaccacagtacactgggttgttgctagtggcccagcccacggatgtggtaaaagcgtccgattccaagctcaggcccgggttgaggtggtcgggagatagcagagcaccgtcaatgcctacaagaccatttgcccgagaggagggtaccggggcctcttgaaagtgacctctcccagtgttgctcgtaatgcccattgtcaactgtgctgagctggtgacctatgaccttcatcaaggatgccctcctgaaagccaacctcatgacagatgacctcccttgcaatttcacttctgcctttggggcgggcttctgcaccagtgtcatcggctcccctgtagacgtggtcaagacgagatacatgaactctgccctgggccagtacagtagcgctgtgcactgtgcccttaccattgctccagaaggaggggccctgagccttctacgaggggttcatgccctcctttctccgcttgggtccttggacgtggtgatgtcgtcacctatagcagttgaacgagcctcatgctgctgacttccgagaggtccttctgagctct

SEQ ID NO: 700374 - DNA, 158 bp, Homo sapiens
tccctccttttcacggacacctatctgaggtacaggctggggctgccaccaggtgatgtcccaccacagtccctcacctcccgacctccacatgccagaaccaatttccactcaaccatgacctcacccctccttggtttctccctcgatctgtggcc

SEQ ID NO: 700375 - DNA, 682 bp, Homo sapiens
  misc_feature (97)..(97): n is a, c, g, or t
tcaacttttcaagtatagcccatatgtcctaacaggcaccctttttcgtgtgaaagatcatctatttggaggtctctgcccaaaaacacaaacccancaaagcaaccagagcctccttaccctagctcagaagtatagccaaaaagaacacaggttagcggtaaaaatgtatgtttaaatgaagttttgttttttttcccccacttcatattgattctcttctcacatgtcaatataaggtggtacccatggccaacaacattctctctcacctatcatactaatgccatataagtagtagtgtttgtgttttccagagtggggaaatatatacagctcaaaaaaacaaaaatatatctagcatctatctccttgccagttcccttgactctctgacctttaagtcccaaggttctaagtatccaatgaataagaaacctccgtgtctcaaacccaacagaatatgtttttttctggtttgattaaggcttcgaatttggacacataaatcctctcagtaatacttagtaattcatgaagttacggcttgtgtaaccttgcagaatatttacctttaggagattataaatcctaacatgcccataggggccttctgcttttattcctacatacaacacatacaacatgtgtgtttttaaacacaatgcacataggacaggtg

SEQ ID NO: 700376 - DNA, 168 bp, Homo sapiens
atacggtctagtatatattagtctgttttcacacgcctataaagacctacctgagtaattccagcactctgggaggccaaggcgggcggatcacctgaggtcaggagttcaagaccagccgcgccaacattgcttgctttcagtagttgctttcagtccttatctcag

SEQ ID NO: 700377 - DNA, 394 bp, Homo sapiens
gcctgttacagatgcacatcatgcaaatgtggttagtgattgatatggtatggctgtgtccctacccagatctcatctggaattcgcaagtgttgctggagggaactggagggaggtaattgaatcataggggcaggtttttcctgtgctgttctcatgatagtgagtaagtctcatgagatctgatggctttataagtcagagtttccctgcacaagctctctctctttgcctgctcccatccatgtaaggtgtgacttgctcctccttgccctccaccatgattgtgaggtctccccagccgtgtggaactctaagtccattaaacttctttcttttgtaaattgcccagtctcggatatgtctttatcagcagcatgaaaacggactaatg

SEQ ID NO: 700378 - DNA, 249 bp, Homo sapiens
ccatgcctgacggtgggcacatcgatggttccagtgagtcatgattgtgacacatgctttccgagcctgggggacagagtgagaccctgtctcaaaaaaaaaaaaaaaaaaaattaaaaaaaaatgtacagggaatacggacttaccccccacctaaattctatattaaaaatcttgcaatctcgtgggtttaataacattattctacccattcacacaattctatttctcaaaaggttatttccaagg

SEQ ID NO: 700379 - DNA, 838 bp, Homo sapiens
gtgggcggcaggacgcaccgcggacccggagagggcggacgagcaggcgccggcgcgcatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaatccggcagatattctctgttatggtaaatccagcgtattagaaaatagagacggtagaagtaattttctttacaagtcattgttcagaaaactgggtagacattaccttagtttgctgagaggatattaaaatctatatgcatc

SEQ ID NO: 700380 - DNA, 189 bp, Homo sapiens
tttagtgagggagagatttggtatactattgagatgggggctagtttttgtcatgtgagaagaagcatggccggatgtcagaggggtgccttaggcaacctctgggactcagaagtgaaatggggctattcctatttttcttgctatagcctttatgatttttaatgattattattgattggtacctat

SEQ ID NO: 700381 - DNA, 1245 bp, Homo sapiens
aagaccttctgcactgtccatctaaggatgcaattgaagctcattttatgtcatgtatgaaagaagctgatgctttaaaacataaaagtcaagtaatcaatgcaaatgcagaaaaaagatcacaagcaactctggcatgggattgcacaacatgacagcatttgcacccagtttatgggccatcaatcggaaactcatggcaatatcctgcagaagaaaatggatttcgttatatcccctttagaatatatcaggacaacgacctgacaaggacctttcattcaggaagctgtatcggtcctgtggctgcagatggacaggtggcaccaccactaggcagacatctcctacaaagaaagttctggtcctttctggctattggatcctgacagaattgggggcacaaaaaagaacttcacgttgacttgatctccatggcacactctggaacgcccaaatggttgggaaaacacaccctacatggcagcgcggcgtgtgaagtgtgacaacattcttgtgaggctaaaccgggaactatagtattcaccatcatcaatcatacgtcacgacatctacattcacacaacaggccaaaccaggacttgggacacagagatccacacacacattgggcctgggaacagacaagcaacgacagatccctataacaaggggggcacataacaacaaaaagccagagtcacaccccttgacgggcccaaacaacagagcttaggaggcgaaaggacacacaccgtggacacacaaaacacgacatccgaaagacaatgaacgcccaaaccgagacaacacaaccaccacgaccagacaataaagggaacaagcgaccgcgggcaccccacagagagcaatcaacactgcgcgacttcccccaccaactggccaaaacgaataaaaccaacaacgaggagaaacacgagaagacattagagagccaccagcaagggacatcaagaaaaaaaaaacgaagccgaacccataggcacataaaagcaggcacagaaggcgccaccaacaacactcgataagaagcgaaggagactagccgaggacgagctaaacccaatgagggaagaggactcacagaacaagcacagaagcacgacacagcacatcacaaaacgcacgaccagagacaaaccagtagttaacgagcaacagccaacacactgcaggttgaacaaaaagaataaggatagctcgtttatcatgtacatatgcaga

SEQ ID NO: 700382 - DNA, 735 bp, Homo sapiens
agacgggcttcccaggaatgagggggacagatgggctccccaggataaggggggacagaagaccccaggcctgaggaccaggcctgccccctggcaccaccagacaccaggagggcactgctgctcttaattgaaagtcttggtgcaggtgagggcgtggaggattcctgggggaagcttcgtgctgcaaggtggacaaagacagataacaagagaaaaacagaagcttaatagcatgtataccttggtctgcaagggacggactcgggacaggctatgtcgcaaaggcgtggcttggagctcagccttaaagaccatgttcgacggaaacaaagagaaagagtgtgtggggaggggcccaagaaattaccccaaactggggtcaggccttctccatggatgagcgtctccggtgacttacaggcggccttctggcccagagagggggcaccctggtgagcgcagatgcctgtacggcatgtgactttctctcatagaacagcagcttccactcttgtcatcagaatttctcctgtggttgcagtttctcaaaataagcagctcaacataatgcttatgccaaagaggccatataaggggtggcatattctggtctgctctacgtggaagcggacagaaaccctggggcagaggccagggacggggagccgggaccgacttcacagttcccagaaccgagcaagggaaacctgaggccgagcctctggagccttg

SEQ ID NO: 700383 - DNA, 184 bp, Homo sapiens
tgtgtacatacaaggcatagtaaacgtgtatttaaaacttgtttcaatgtcgcacatggcttaagagtttgaatcagtaacgtaaagttacgagagtaaaatcatatgaaggccacacagttaaactgacaggacagtctaacagtgctgtgccgccgctcctgccatagctcttaccccatct

SEQ ID NO: 700384 - DNA, 758 bp, Homo sapiens
acagggctgggtttgcccgttcccggattttctccgcgggtattgttcgtttggggccccccgccgcttcccgcggtatttttctcgccctctctttcccacaacgcttgttgctccccctccggcacctctcgcgggggaactttctatttctgtcggggattccctcccccctcctcggtggtgatagagcccccccctcctccccaaggagccactcttttggtattataaaccggcgctttgaaaccatagagaagtggggcaagagtgtttctcatccgcaagactgtgttcactagcacgatctacccggtggcccccccttggaataataagatttgtgcacaccaccgccccgggtcgccgcgccatacattttgttcccccccccccgagagatttaaaaagaagaatctccacatttcttttaaagagaacaaacagcgtttctcacacggcgcctttttcgcaccagttttttcttagagggcgcccacaaatataagatttcgggaatatagggaataaagcctctatagtttgtttatcacccccgcgcacccctcctccaccagagagtttgtgaaaaaagtttttccaacacaataattttggttttaccagaaaaaatctttttgtgtataaaaatacttttttaaaagtgtttttttaaaccccttaaaggttttttttttccccccaagaacccacccaaagtgggtttgtgtttccaaaaaattttggggaaaatccca

SEQ ID NO: 700385 - DNA, 301 bp, Homo sapiens
gggttcgcccccgggtccgcccccgggtccgaaaattttttgtccttttttcaatttgaaccattccggtttttttgccccaaagtttgaaaattttttttgttacgcggtttaggattcgtttgaaattgttccttttcccctttttagccccaatttaggttttgtttattggcaccaataaagttgccctttttttttttttttagcctccatccccaaggtttttttttttaacttttggccccttttttttcccttttttttttttttttaaaaataaatataataaaaaatttta

SEQ ID NO: 700386 - DNA, 511 bp, Homo sapiens
gcgtaactacagactcatgagaaaccacggaaatggcccgaattgtgcttacgtgtgaaaatactgatactgtgagttcaacagagctgtttttcaagccaggatgcagaatgagaaatactacttgaaatgacggcctctaaggttgtggcttttgaagtcaagtcattcagtttgtgattagtgtataaaaccctgaaaatagttactacagaataaagaacaataagctcaaagtacatgtcacacatataatagacaccaacatcatgacccgtgggtatggttagggcaacacactaattttgggattagacgtgaacactgaaaacggatgtttcacattcaatatcctagtctgaaacacctatgtaaaggacagcacagtccttcaaaggaagaaaactatgtacagcttaatttaacagtggaagtaaactaacccttgagtactgcctaatggctgaccatctatttgaattactaatatctatatatctatacattgtcg

SEQ ID NO: 700387 - DNA, 209 bp, Homo sapiens
  misc_feature (1)..(1): n is a, c, g, or t
  misc_feature (9)..(9): n is a, c, g, or t
  misc_feature (14)..(14): n is a, c, g, or t
nacccaggnacccncctccttttcgtaacactggtccccccggtcagcccatctagccctgtccttcattcctcacgccatctcggtgcccatcttgagggctggaacggccctgggtgcctgcccctcactgtgcaactctgggagcagcccggcaggttggggcgtcttccaaaacctctcccttctggagccactctgcactgcgg

SEQ ID NO: 700388 - DNA, 117 bp, Homo sapiens
ggtgcctattatcctcagtgtatccatgttccctcccagaggatacaccagttctcatggagtgagcactcagtctctcttctctccagcttagacactggaccagcttgagacacg

SEQ ID NO: 700389 - DNA, 366 bp, Homo sapiens
ctcagatggcttagatgcccagtgtgggcaaccacagtcttcaatagatgctatccggaaacatctcatgctcaagacagttctgtttgttgcccaccagttacagtacctggttgactgtgatgaagtgatcttcattgaaagagggctgtattacggaaagaggtgcccattaggacctgattactttatatggtgactatgctaccatttttaataatctgttgctgggtagatactaccgacagttgagatcaattcaaaaaaggaaaccagtggttcacagaagaagtcacaagacaagggtcctaaaacaggatcagtaaagaaggaaaaagcagtaaagccagaggaagggcagcttgt

SEQ ID NO: 700390 - DNA, 936 bp, Homo sapiens
tcgggcgtgtggctgctctggtggtcggccactgggtgacgcaggagggtgcagcgtcgtgggggttctcggcctgctgcgcagagtctcacgcaattggggaagggtgcgacatggagaaccctctgtgctgtgggccccccttattctgcggggtgaaacagcgtggcgcttttggtgctctggtgcgaggatatatgagagtaagtcctggcgagaaagagaaagaagcgccggggaacggtcatggggtatgggatagaatggccgtgggtgcgagcctatggtcgtgagtgccggtgtatcgattggcgcggcgcaaggtcttgttgttcgtagccaggggggaagcatctggttatatggtatgggctccgagtcaggggagaaggtacataggaaggggtcaggctatgtgcttgtgtgactaggtgcgcttgtgttatgagtgtggaggcgggtggttgagcccgcgtagccagccgtgtggttgtgtgaggaggttcttggcgggccacggtttcgtgattgtagtgctgcgggactgcgcgggcgttggtgacgatggcgcctgggaggggaacttctatttatgtgggagtcccccaccagttcgttagtcctggtacaaaataaaaggctggttgtgtaagggcgaggtcatagtatggttggttggccgccaccgaagtttggctaccgtgtcattgggtcacgtcgacgaccacgagtgggtgggaatgatgttacgcgagcctatgggtgtagttgtactgctcgtattcagttgcgatgagtaagccgccccggggggcggtagatacggggtgtaggcactaggatatgtagcttgcctggccgccccacgcgccggttcatgttctggcgcgcggtcgtccgggttgagaccaagtgggataattttaaacaacccac

SEQ ID NO: 700391 - DNA, 132 bp, Homo sapiens
acgtattcaggatggttcatcattatatagagaggaggtgagcccaacagttgtggtgttgccttccctctgtaagggtctaggccatttggttgccatggcaatgggcttgatgtaccatggagacttgtg

SEQ ID NO: 700392 - DNA, 212 bp, Homo sapiens
aggctccagcaaacgatattaggaggtcagcacggtgctcacgtatcgacggaacttgtacagtggaggcatgcaccgaattggtgaatacacgtcgaccaggctccatgtaaacgatcattgggaggtcagcacggtgctcacagtaatcgaaggaacttgtccagggaggcatgcaccgcagtggtgaataccacgtcgagctgcaggcc

SEQ ID NO: 700393 - DNA, 109 bp, Homo sapiens
acggccgtgtattactgtactagaggggattacgatttttggagtggtcattaccgccccttaggccaacccacctactactttgactactggagccagggaaccctgg

SEQ ID NO: 700394 - DNA, 571 bp, Homo sapiens
  misc_feature (17)..(17): n is a, c, g, or t
  misc_feature (490)..(490): n is a, c, g, or t
acaaggggtcatattgncttgtttcgtgaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtttcggcggtggtgcgtacactctcaagttggttgaaaagaggactccatgttgatctctggttccccgtgcttaccaaatacctaggcctcttggatgaaaggttaaaacattcctggtatctatttccgccagtggtaagtccctatcttttcagaaattttggatgtgcaggggtcatggagtttccgtttttgctgcggtctaccccgcgagaggccacccctctatttctgggctttttactaaaagcgctatttgctatttgcccctgtgcggaatttgtgccatccagcggtctcctttcagacgggcgtgnggagacagagagaacccaacaccgccgttctgtgaacacctctttgtcctccttcccttgctgggtacggcctttcaattg

SEQ ID NO: 700395 - DNA, 355 bp, Homo sapiens
ccgccccgccctgggcccccggcccccctccctggggacaaagttacaccccctcatccttccgcccacagttcaggttacccaacagcagtccctgttacagactgccccatacaccctcggtttccccctcccctgtggggtttgggtccgttccatttgggttttttactttacaggggcaggtccgcctcccctccctttgtatggagttccatccagggggtttccccccctgctcccgtccttaggcctcctgaccctggcgttttgatacccccccccaagatttttgttttttttattattattattgataataatttttttaatttttttttgttattaattttta

SEQ ID NO: 700396 - DNA, 213 bp, Homo sapiens
  misc_feature (97)..(97): n is a, c, g, or t
  misc_feature (158)..(159): n is a, c, g, or t
gtctgttactgctctctcagcttatcaataacttgcatttaagggttgtattggcattttaactaaaatgtgcatcatgatggaaggtgcagacttnttttgaaagttttccgagaggaggggtctatagaccatttgtcagaaaatcagatcagccnnctcaaagaatgggggtctgtggggctagttaaatagaaataacttttaaatatc

SEQ ID NO: 700397 - DNA, 386 bp, Homo sapiens
agacacttgactccatggacttctctgcaattctgttctgtgtaggactgcctagtgcctagccttcttgtgatgttccttgcttatgtcttgtctccccatttgatttggagggtcctgggcagggaccactgggctgggctctagtaggccccctgtaaagacctgttgagtaattagaagagacagtggccccatctgggtgaatcctgaatttaatcaatttcctggatccttgtttattttgcaagtaggataagaatgtcattgaaatcctatcatgtagtcatggaagggctaatacagtcagtgtactgctactcactaagcatgctgtttagctcagcggttttttgttttgttttgataacaagactgtctcgatg

SEQ ID NO: 700398 - DNA, 492 bp, Homo sapiens
ttcaaattctttctgggaaagtctagctcaccaaagaaaaagatcaagttgaagaaaagtaaaaatgtagcaactgaaggaaccagtacccagaaagaatttgaagtgaaagatcctgagctggaggcccagggagatgacatggttggtgatgatccggaggctggggagaatgacatcggaagatccgtggtccagaagctggtcctaatatagatgaagaacaaagtggagtgcgaaacagagggcttggtagtcgttctcataaactactgctgccaagggtgcccaaaaaagcgaagacatggattcctgaagttcatgatcagaaagcagatgtgtcagcttggaaggacctgtttgttcccagggcggttctccgagcactcagctttctagggttctctggagccacaccaatccaagccctgaccttgggacctgccatccgtgacaaactggacatccttggggctagtgagacaggaagtg

SEQ ID NO: 700399 - DNA, 176 bp, Homo sapiens
  misc_feature (125)..(125): n is a, c, g, or t
aagctcggtacccggtagactgtcatcacagaagaggtgaagatgcctctcaaaagacatgtgccacagaaatagatagaagggaaacttctctcttctcctttgcctcctcttcgcgtcaccangcgcagggcgcttctcttaggggtggtgagaaggatcttcgagaaatcgtg

SEQ ID NO: 700400 - DNA, 884 bp, Homo sapiens
  misc_feature (5)..(5): n is a, c, g, or t
  misc_feature (87)..(87): n is a, c, g, or t
  misc_feature (91)..(91): n is a, c, g, or t
  misc_feature (96)..(96): n is a, c, g, or t
  misc_feature (111)..(111): n is a, c, g, or t
  misc_feature (123)..(123): n is a, c, g, or t
  misc_feature (160)..(160): n is a, c, g, or t
  misc_feature (164)..(166): n is a, c, g, or t
  misc_feature (185)..(185): n is a, c, g, or t
  misc_feature (188)..(189): n is a, c, g, or t
  misc_feature (191)..(192): n is a, c, g, or t
  misc_feature (207)..(207): n is a, c, g, or t
  misc_feature (221)..(221): n is a, c, g, or t
  misc_feature (223)..(223): n is a, c, g, or t
  misc_feature (245)..(245): n is a, c, g, or t
  misc_feature (248)..(248): n is a, c, g, or t
  misc_feature (261)..(261): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (290)..(290): n is a, c, g, or t
  misc_feature (325)..(325): n is a, c, g, or t
  misc_feature (330)..(330): n is a, c, g, or t
  misc_feature (340)..(342): n is a, c, g, or t
  misc_feature (344)..(345): n is a, c, g, or t
  misc_feature (365)..(365): n is a, c, g, or t
  misc_feature (367)..(367): n is a, c, g, or t
  misc_feature (374)..(374): n is a, c, g, or t
  misc_feature (384)..(384): n is a, c, g, or t
  misc_feature (392)..(392): n is a, c, g, or t
  misc_feature (394)..(395): n is a, c, g, or t
  misc_feature (401)..(401): n is a, c, g, or t
  misc_feature (403)..(403): n is a, c, g, or t
  misc_feature (419)..(419): n is a, c, g, or t
  misc_feature (475)..(475): n is a, c, g, or t
  misc_feature (507)..(508): n is a, c, g, or t
  misc_feature (654)..(654): n is a, c, g, or t
  misc_feature (684)..(684): n is a, c, g, or t
  misc_feature (798)..(798): n is a, c, g, or t
  misc_feature (875)..(875): n is a, c, g, or t
ccttntttagaccatcacacaggcaggagtggcccagacagacaagtagatagacagacagtacagagggacaagaaaacaaccaantggnttagnggccctaggccaggntcagcagctgtntccaggcttcagctccagctctgctctggggaactgntgtnnnagaaaaactggccggggcntcnntnnttacagggctccttntcctcatgccctantntccctcatccagcctgttgggntcnttggcaggtgganttcccagggntntggntggctgggctgantgagcagaggatcgaggctcttggagactccctgnggagntggaggcctnnntnntttggggttagcagcagcantngggggantctggtcaanttccaggntnnggccantnctcagcagggcccctntttccagggcaggccctccacctgcccaccacaccaacatggtgcaataaataaantttcaagtagtaagtcagtttcaagcaggagnnctgcaggttggcagaaaggcagggactgagaaagataagcctccagccacccaccatatctgctcagtgggctcaagcggtcgcaagtctgtcttgtgcactggagtgggtgtctggccctgatgtccacatgagcactccccgcngacttcaagcccctcacaccagcgccagancctgctcggtggggcagaagcagggcaacatggtgcccacagcgtccacgatggctgccaggtgctcgttctgcgcctgaggcccacagagctgcatgaagtctgccagacgcngcaagttttcaaggttgtggccggagaagccccggcaggccaggatctgcgtggcaatggcctcttcaggcgcgggnccaggtaac

SEQ ID NO: 700401 - DNA, 316 bp, Homo sapiens
tttggctagggatctagttctcgccatcgtccgccattcctggcaatacgacctgcgcataccggtcatttcgtcggtgctgccagatggccaaggaatcgatacgaaagatctcatagccatcgtcagcgccaccacagaatacgtgtatgggtaggctaatcccacatccaatagacccatgtattctggaaacgagaccatgtgcctcgcaagttgatcaagccaactgagcgtcgcagagaaccgggcatgggctgggaaggtgattttgcctaggctgtacccgaggcagccgataaacaaggggaggggt

SEQ ID NO: 700402 - DNA, 268 bp, Homo sapiens
  misc_feature (34)..(34): n is a, c, g, or t
  misc_feature (116)..(116): n is a, c, g, or t
  misc_feature (190)..(190): n is a, c, g, or t
  misc_feature (248)..(248): n is a, c, g, or t
gaggaaggcggtggggaggtgctacatacttttnaacaactggatcttgtgagaactcactatcacaagaacagcaagggggaattctgcgccctgatccaagtcacctcccaccnaggctcctcctccaacagtggggattacaattcgacatgagatttgagtggggacacagatccaaaccatatcngtgtcattaaaacaatagttgccctgctaacttttttaatcccctgtaactctaaatnaaataatgatgtgaacataa

SEQ ID NO: 700403 - DNA, 120 bp, Homo sapiens
tcagtcaccgtaacattatgggccttggttttacctattaagtagacatgttaatacttttcatgtcaactaaggatattaaatgagatagtgtgtgaaagctcttaaaacagggacagg

SEQ ID NO: 700404 - DNA, 163 bp, Homo sapiens
aagcggatgtcggatccgcggatcttgacgaaggtgcggaaacgcttgagcttttccgggtcggacaggccgttggcccattcgcattcatagcggtccaccaccagctgcatctgcgcctccagttcggcgcccagtcccaggctgtcatcgatgaccacgg

SEQ ID NO: 700405 - DNA, 504 bp, Homo sapiens
gagctctctcgtgtggggtttcaatcaagtactcagtgtcaggttcttgccatgtaaagtcacatgcagtctttttattcacctcgaccggccatcatactcttcaggagtatgtgtccattctggctctgctgacaggcatgagctagtcaataatcgggaagtatggtaaattcaattgagcagtcctgggcatattcactgtggggggtatttccatctgccattctcctgtgacggagcattattcccctgagggaatgcgcagaccaagaggccttgcctagtcccaaaggtgtgtcatgggctccagctgcgaatcacagactcatagaatcatggggctgagagtgggtttaactgccctcagagtggcccttgtcaaatccaagtctgagttctcaacttttagctaatccaaaacagttgtcctattttcatcagggcaagggtcaggcccgatgttcaacgcaggcaaagcgtgcatccttggtgtcctcttac

SEQ ID NO: 700406 - DNA, 341 bp, Homo sapiens
gttgctcaataatatgcacctctgataagtgttgattagaaatgtgctcatgtgtttagacagtgctttggtatacagttggatgttcatcctggggtgagtgaatcatagtgtgttagaattcctgctagcatagaggctcacatgtccatttgaagatagggaacagttctctatagaatgtgaccggaccatgactgaccaatatacaaatttcagtaggaataatttggcgtatatcgcacaagatcattatcacatattcaaaataaataccctgtttgttaggtaattctgaaattgtcatttctattttggagttacaaataataagccctgag

SEQ ID NO: 700407 - DNA, 542 bp, Homo sapiens
  misc_feature (35)..(35): n is a, c, g, or t
tgtttcaatctcctcgcattctctcccgattactnagtagttctaatgttggcaacagtaatggtactctatagggttcatatctttcatctgctaatcatccaccacaaacgcccagcgccactcctgcccagaaactgggtaaggctgctgccactgaggacagccctgaaaatgcctcgaggggacagctgaactgtgcactcatccattttctgtttatttttggttggttttaataatttttggcactaattaattttcaccatgcagatgcaaatggacaacaagcacatgaaaaaggctgaacatcaccatcatcaggaaaatgcaacagaaaccccaatgcggggccgggtgtgtccagtctgaccaccacggtaaaaccttgtctctactaaaaacataaaaactaaccaggcatgatggtgggcgcctgtaatcccagctactcaggaggctgaggcagggacaatcacttgaacccggaggcggaggtagcagtcagctgagatggacccatgtaccccagcctgggagac

SEQ ID NO: 700408 - DNA, 624 bp, Homo sapiens
ataaccctcaacacccactccctcttagccaatatggtgcctatggccatactagtctttgccgcctgcgaaagcacggtgggcctagccctactaggtctcaatctccaacacatatggcctagagctacgtacataaccctaaagcctactccaatgctaaaactaatcgtcccaaaagttatattacgtaccactgacagtgactttccaaaaaacaccataattgtgaatcaaccacaagcacccacagtccgtagattattagcattcatccctctgctatttttgtaaccaaattcaagcaagcaacctatttagctgttccccaaccttttcctcggacccccataacaacccgcctcctaatagctaactacgctgactccttacccctcgtgacaatccggcctgcttcattctcacaatgagaacaaagtagccccacatctcaatcatataccaagatctctccctcaattgaaaccgtcaaggcctttctcactcactctgctcaatctttatccatcatagcaggcagtttgaggtgggattacaccaaacccagctaacgcaaaaattcttagcaatactcctccaattgacccacataggaatgaacta

SEQ ID NO: 700409 - DNA, 158 bp, Homo sapiens
cgaatacatcagtatagactaatctcaggtacaacaccagcagcctttaccttatatttaaaagtcccaaatagcactcgaatgatactgagaaggccacatttgcttttatcataaaataagaggaagaggaaaggcagtgtttaactgttctgacc

SEQ ID NO: 700410 - DNA, 501 bp, Homo sapiens
actcactcatatttcccacacctagtggtcagaggagggaggggcacagtgaagaacgcagcccaccacctttgcgggaatgccgcgtatagtggccgacatgtggtgccagcatcgcgctaactatgacataatctgtatcttgccagcggagctgtgaccccaggttactgcaactacctgactgctactctcttctgatgtgctgctccttccagacagagcctttcccttataccgtgaccccctgtgctgaccccattgtgtgaatgtgcacatgccacctccctatctatgaggccatactgtgtatgaaacaggatcttcagggctagccttaatctgcgcatcaatctggtagggtgggggcccccgagccaccgtacctacgtctacggagcccgtacttcagtattgcgtgtgtaacaagagctacggctgttggctcttcaagacacgaatgcctggctgcgtgagatatattggtgcttgcttagtgtc

SEQ ID NO: 700411 - DNA, 373 bp, Homo sapiens
tcgggccgagggctggagcaccgtcggcgtgccgctcagggtgcacgtctttgggtcgagatgcaggcccgcgggaagtgccggttgcgcctggcagctggtcacgttggcgccggaaataggagtgatgggcgagatgggcacgccgatgtcgaggctcacggcgatcgtgggcgtggtttgaatcgtctgcaccgtcgtcgtcgtgtcgccgcccgaacagcccgcgagcagagcggcggtgaggagaataaaggaaaacgatttataaatgggcgtgcgaatcatccgaggggcaatgcaacgcccgtaccgtcgcggaaacagcgtaatatcggcggccaaagggcgcggcggcgccagctgagctaag

SEQ ID NO: 700412 - DNA, 198 bp, Homo sapiens
ttttttctgaggggtgtacattttattggaaaccttaaaccttaaatactgttcagaaataatatatcttcaatcaaggctctttgtgcagcctacacagaaaaatgagctttttgggtaggggcaaggagagagacagtacagaggacaaagaccctcacgatgagctcttcagccagcttatcagcttttgccacc

SEQ ID NO: 700413 - DNA, 151 bp, Homo sapiens
cttagaggatccgggatgaggatctggcttcaattacttggtcaagggaaacaactgcatatccagcaatctgtggggtagctggtgggctggaagaggagccatctatgaatagttgatcatcggggttggagtgacgttccctcatccg

SEQ ID NO: 700414 - DNA, 647 bp, Homo sapiens
tataattttaaatggatcaaaacaaagcttctaaaaccgcagttcctgggaaaaaccactggttctggcctgtctggttatctctcttcaaatcttgaccttggccctcccgttcgggccatgcgttttaagagcaggactcctcgtgaagacatctccttatgtgacgacagttttggctccaaggggatttctccacagaagtcacctgtgtgggcatttagggtgatgtgtagttataccactttcacaaaagatttttactcttggactcctctgtggcgagatcttcttctttgcccatgtgtgcagctgtccacttgtgcggggggtagcgggctccaattcacagcccaccaagagcatgtggctgtcagggcgcgactcgtgaggggtgccatcactcaaggtgttctctcaccgatgaacgagacttgtggcgtcccggagataagcgttcacagccgagtgacagagcgaccactcttcccgaggttttcatggaatcttgcccatttcgggcgagcgaacccaccgcggggcggcagggctgaggcggacggacggcggcggcggtctatggaacgcccaagaggagtctctgtccgcgcgggcggccctggagaccgaggggctgcgcttcctga

SEQ ID NO: 700415 - DNA, 142 bp, Homo sapiens
  misc_feature (136)..(136): n is a, c, g, or t
agctggtacgggcattgggactctgcaggagcaggccaacgacggcacgccatatccatcggggacagcatctttgtgggagacgcagccggacgcccggcccactgggccccgggcggaagaagaaagacttctncctgcg

SEQ ID NO: 700416 - DNA, 273 bp, Homo sapiens
ttgaaggggacggacccaccggagcccattgaggcagcgtgtggccagggctcgtacacagccagctgcgcgcccggagcagacaaaggacaggtccccaacctgagacgccggagggcggggacaggggaaaacaaaggtgccggcacctcccaggaaccgtacttcagctacgctggggccaccaagtgcccgagagacggggctggagacgaggctcacagcagagagagcacagtgagagaggaccggccagacgaggctgaaagggac

SEQ ID NO: 700417 - DNA, 861 bp, Homo sapiens
aacttccccttgattcccaccttcccagactcacctagcccatcttccagcctcaacatatagagatgttagtgcaaggtcctgggctctaggtgatcatttcataagtcctttgaacagataaagaacacacagtaggtgttcgtatggtgtgtatctatataaggtacaccccaacaacgaacatttatatgtgtaagttcagacaacatattggcaattcagggtggttgtaagtatgttagcaacatgcaagtgcctgctcgtcttaaacgcgattgacttgttataatgaagaagttgcatgtgctccagctaagccttatgaggtttgtctcatttgttaggtatatggctttgtgaatcatgtaaaagtgaacacattagtgtggtgttgcgattgtgtagttgacaggttcgttctgttgctaagtaaagatgctgctgaaattaagaagaaaataaaaacaagaaagaataagaaaataagtgggggggggggccccgtaagacagtgtccccgcaagaggcgggcccatagtgcttcggcacggcccacgcggactcttcgggcggcaacaaggaggcggcccctagatcaacggttgcgtgagcgcacttatcacaggccagagggtgacgtccggcccacgggggctcctgtgaacaacccggggagaacgcaccttggagcgcaagagcagcggagaaggccccgtggggagaacaccacggcgagaagaagagaggccgaataggaatcctggagagggggggaggagacagcaactcagggggcgccaccaactgtcccgctgacaaggcttgcctttaagaggccccttacgggactagaaaata

SEQ ID NO: 700418 - DNA, 136 bp, Homo sapiens
ccctagtacttcctgtaacctgggactataggcattccagtcacacctggtctaatgtgtgtctatttaatagatatggggttttgccatgttggccaggctggtcttcaacacctgggctcaagcaatctgtcca

SEQ ID NO: 700419 - DNA, 112 bp, Homo sapiens
atggcatgtggtgaggacaggaaatataaggttaggtctgatagaacaaacatcaggactgaactccagagatgccaatgcatagaactggcgagtcagggtaggcggaatc

SEQ ID NO: 700420 - DNA, 182 bp, Homo sapiens
  misc_feature (77)..(77): n is a, c, g, or t
ctagaggattccaaatctctcattgcgcctctagagtagctgttctgtatcgataaaccgatcaactcacactcttntcagcctatataccgcatcttcagcaagacctgatgaaggctacaaagtaagcgcaagtaccacgtaaagacgttaggtcaaggtgcagccgcaatgagagattt

SEQ ID NO: 700421 - DNA, 662 bp, Homo sapiens
  misc_feature (229)..(229): n is a, c, g, or t
  misc_feature (312)..(312): n is a, c, g, or t
  misc_feature (360)..(360): n is a, c, g, or t
  misc_feature (465)..(465): n is a, c, g, or t
gggaaaaagaagcggggaattctgtttttttagggcttggcgtggcccctgtcagccccagaataaggttgaattatggccagatatcggggccttttgtctctccggcccggagggaacactgggggttttggggcttcctccaactcccccttgccagcaacaaaggaagaagttgctccctgcacgggatatcaaagctctgtttgtgtgtgaggaggagaaaaanctgcctcggaagggggtttccctcaagaatggggataaaaaaggcagctgttaaaaaaatgctcaatatgcccccggttatgncaaagtcaaggacttttcaaggggggtccccccccggttcctttgtantgggggggggggtcccttttctgcccccaaaacttgcaagggggattttgggggcccctttatagttcccaaaaaaagttgtttccttcaagttggggtaatcanctggggggtagtggatgtttgcaaaaaccaaaaggggcaaaagcggggtcctgttcccgcccgagatttttccatcaccctttttcaaggggggcccggggtgaaggggaaacccccaaatgggggtttgggttttttataaggggtttcctgctgggcagggggggggggtttaatttaaacagctgggcccccca

SEQ ID NO: 700422 - DNA, 936 bp, Homo sapiens
gcaagacctcatctctgctaaaaattaaaaataaataaattagctgggtgtggtggtgcatgcctgtgatcctagctactcaggaggctgaggtgggaggatcgctagagcccaaaaaaaaaaaaaaaaaaaaaaaaaaaaaaaaaaaaaaaatatacagcgggggggggcccaaaaacacggggggggctggaaaaccccgggaaaggggttaaagggtgtttccccaaaaggggttgggggcccccggggggttccccggggaaaaaaagggggggcaccccccctgtttttgaataagagaggggctgtgtgtcccgagctgtgggcgcacgaaaaatccacaagaggggggaactaagagttactcttctcccgcggacgccctgcgaagaaaaccacaaaacaaaagcgcagcaaaattttaacacgccgaggtgtttcccggcggagttgatgtatattattttcctcccgttttcctccccagaggtgattttaccaacacagccggggcgaagtgggagagcgctgacggcggggacacaccccggcagtgggtggcgaccgcggggggacctcacttgaatgttgttgttcaaccccgcgggggtgcaacctctataacaattgcggggcaattttatttgcgctccccaaagattatactcttgccgccgccttcctaccccgtttgtagtgagtacgggggagaaaggggcccgttgagcgtgtgggcccccgcgcggttcttctgctggaggtgttgcgtgatagcacgccgtgtgtgggatcgccgcgtgttgccgtcgtcacattttgggtggcacgctgtcccccgcaagtattgggttgttgggtgcactgggaaaggcccgcccgtgccgcgggggggggagcgcggggggctccccccccacaggtgcgccatagagg

SEQ ID NO: 700423 - DNA, 388 bp, Homo sapiens
  misc_feature (17)..(17): n is a, c, g, or t
  misc_feature (382)..(382): n is a, c, g, or t
tatatatatatatatanattgttggttggttggttttgttttgggtttttgaagacgggaagtcttgcctctgttgcgcaggctggagtgcaaatgactcgatcttggctgactgcaccctctgcctcccctggttgaagcaattttccctgcctcagcctcctgagtagctgggactgcaggcgtgcaccaccacccccagctaatttttgtatttttagtagagatggggtttcaccatgttagccaggctagtcttgaactcctggcctcagacaatgctcgcctcacgcctgtaatccagcacttagggaggatgaagcgggaggatcgcttgagcccaggagttggagaactgcctgggcaatatagcgagaccccngttaat

SEQ ID NO: 700424 - DNA, 890 bp, Homo sapiens
ggacaacggtacaggacttattcccttttcgctcttacgtcctagttctccccttgtctacaattctgcctccacaatttggcgctttataatagccgtggttttatattcttcccgtgtggtgtatcctccccccctgatgggtgccctctccccccctttaaaaatggtactcctgttacatgctcctacttcacaaaggggcgccccctgtaacttattgcacgatgcttcaactctgtcgctatataacgcggtatctgctctcaacgtcttaatctcgcgggattcctccccggcttctggcccccaccagatagttccccccggttggtactgcatgtcccacttcccttctcaaagcgccacggtggggagaaacaactccaggcgcaccctcctcacggctggtgccgccccccctcggttgccgccccgcttctgttaggtcccccgggtgattccatcggtggttctggggcttctgttggaacagcgcccttctatctcgtggcaataacatctgcgaaatatccgtgctactagtaccgcacacgctgctcctgctctccaccaggattaatgaggcgcgtcagcgtctttttgaaatgtccttgcctactgtggactctcaccccctctgttttcttctcccccacagcggcggcgcgcacacaatgtgttctccatatgccggtgttgttcaagcccccctttttgaacccctagtgtgcgtgaaggccttcacacatacattaattgagaatgggtcgtggctgctcccaaacatgaaaaaggcattacagataagacgcgtgagagataatacaaccacatggctcaaaacggtagacgccccaaacgagtccaaaaaaccgcccaacaaaaca

SEQ ID NO: 700425 - DNA, 911 bp, Homo sapiens
gtttagtcaaaatatattgtatcttaaaaatgtatttagactaagcgtctacatgtattgtgacggaattcctgtccagatctgtgcatcttttacagaattaaaggatttcactaatatatttgctaactgctatcatctagacatctagtgggccatggaatgaaatccgtcatatatcattcagttcaatcccatggcttcgagaatcagatcgatagcatatctattctaagtagaggaatgctttttccttttcttgaaagtgtctctttcaagtagatttcaggcctctagagtcttggcaaccctcacattcaggaatacctttgatcgtccattttcatgctttaagtaatgttctgacttgtttgtattcaattttgtctatatatggatgattaagatgtactttgtattattctttatccatagctttttaccatataaagtatgtattcttagggtcagaactggtgaaagagacaaactcaggccaaaaataattggaaaaggcatattgtggaatctgcattggttaggatgtctaattttcccataaagtactgaagtcaaaatggcttgcccgaggtggaaccagcgaaaaactataaaggtagaactggttaaaaagcagagtgtccggggacggcgtatgcatccaacaggttctggaacctcgtgttgggccgcacccgaagcgaggtgaaacgctctgaagggtgccgaagacctggcggagcacagcgcgcgggcccacaaaaagaccgggccccgggttgcacccatccacggctgcggctcagggccaacaggccaccgacctacccaccccacgggagagaacacgagggataagacagcggaacccgagcacacaacacgccgagaaaacaacaaagacaaaacag

SEQ ID NO: 700426 - DNA, 242 bp, Homo sapiens
agaagtactattggacataaactaccggatactatccacaacatgataatgcacaatttgcaccaaacatgtgaaaaaaaaacacattaaacacaattggactggaagactataggggatgggaaagggaatgagagaacactgagaataaaaggaattaaataaacacgcaacacaggccgcagtgcgttcccagcctcatccctagcactgcagactaaccacttcccccaacaccatca

SEQ ID NO: 700427 - DNA, 459 bp, Homo sapiens
  misc_feature (27)..(27): n is a, c, g, or t
  misc_feature (66)..(66): n is a, c, g, or t
  misc_feature (74)..(74): n is a, c, g, or t
  misc_feature (81)..(81): n is a, c, g, or t
  misc_feature (112)..(112): n is a, c, g, or t
  misc_feature (256)..(256): n is a, c, g, or t
  misc_feature (430)..(430): n is a, c, g, or t
  misc_feature (447)..(447): n is a, c, g, or t
aaaaattatgccaggcaatcgggtttnaagccgttgaccccccaaggcgaccttgcggccaaactnaagtgaanttgaatnaccaagcgtcaacccccggaaaagtcacccnagaccctgggggaaaggccgggccatgggggcttattcgttgggcccagggttttctcaattcgtcgtccagcactcgttttgacgagctgctgcagcaactggaaaagctcccaggcggaatacggcctgaaactgcaggatncctcggctccagcaagcccgcccacgcagcattggcgagctggcggacgcgagcaaggccagcctcaagcaaggcagtgagttgttcgaagagcaggtcgtcatggccgaaaccctcgacgcccatggcaaggcttctacgacgacgtcagcacgttgatggccaagacctccncccgcccgacgaagccnccctgacctttc

SEQ ID NO: 700428 - DNA, 772 bp, Homo sapiens
tgggaagcttggggagaggaggacatgaggaaggatttctgaacaacatgtggggagttcctctatataacaagcacgtctcgaggtcgcataggcatcccaaagtttcacagtccagttgggcgtcaccgacttagggtcactacagggcacattgaacaccttgtcttgctatgaaatcgttccctctcaaattcctcatcaatggcatacagcagccagttcatgaaacatctggaagcataagaacactcagcatgacattgtatctttgtattcttcatgaaaggtgtgcagtcttgtctgttattactagtgtctaatgtcattgattagttgaatcagatggtgtcatgtagtaaggattcttatgagtctctgttttcttaagagatccagagtttctgttgctacatgtgagatagttggcattttaactggcatgtcagttgcacacaagagagatgaagactagagcaaagataatgcaacgcgaggaggagaaaagaaatgcactaagacaagaacatgctcgtcatagaacattgatctgttctcacaggaacacaaacgctgctgggaaatttagacagggagactgtacataattgcgtgaaaatagctatttttttcctaagacattgtcacttcatgactatcttcaagttttgcatactgaccacatttcttaaaacgcatgataccaggcagaatgaaatgaatgcgaatgggcctgtgttattactccagtaccgggttgtgggacattacc

SEQ ID NO: 700429 - DNA, 143 bp, Homo sapiens
tacctcgactgggcgggcacttagaggtggggagcagagatctctttacaacatcaaccatctggtccgcattgaactcttcaatctcttgcactcaaagctgttaagatagttaagcgtgcataagttgcccgccaatcgaa

SEQ ID NO: 700430 - DNA, 195 bp, Homo sapiens
agagctagcaccatgagcttcaataccctgtctctacaaaaaatacaaaaattaactgggcatggtggcatgagcttgtggtcccagtactcaggatgcttatgtgggaggattgcttgagcccagaaggtggaggttgcagtgagccgaggtcacaccattgcacttgggtgaaagaagtgaaaccctgtctca

SEQ ID NO: 700431 - DNA, 240 bp, Homo sapiens
tcttacatatatgaagtgagctgtgtacctgtgagggcgagatttcggcagtgctgtcagcctggaggcctgcgagcctccaggcttcttcgaaaagcgcaagcccgacttcacgaagttccagtagcaggtcggcgatccggattggccgtcatgggaccagctccccggtcggggtgctcagacgatttgctgtgcgttgccaatgccgattgagcgcgaggctcattcatcgcgcaa

SEQ ID NO: 700432 - DNA, 105 bp, Homo sapiens
atctagactgctactagtggtccatcgttctattctgtaaatggctcatagaaggaaatgattttccaggtacagatacctaaatgggtatctatctcacaatgg

SEQ ID NO: 700433 - DNA, 472 bp, Homo sapiens
  misc_feature (225)..(225): n is a, c, g, or t
  misc_feature (425)..(425): n is a, c, g, or t
  misc_feature (431)..(431): n is a, c, g, or t
  misc_feature (435)..(435): n is a, c, g, or t
  misc_feature (444)..(444): n is a, c, g, or t
  misc_feature (457)..(457): n is a, c, g, or t
  misc_feature (466)..(466): n is a, c, g, or t
catgttgcccagactggtctccaattccttggctcaagcgatcctcctgcttcagtctcccaaagtgctggcattacaggtgggagccacggcacccagctgagtatctgatcgccctggtagtatgtacaagagcatgtgatatgggcttaatgtgcagcctccaacttagaatctggagagaatgtgtgaaggaaccaaattcagagttatatgaagtggctncagctgtcaaagttgcagcagtctatcagtgagtgaccacaagtggtggagaacaataaagtgatatcaagagtccagtgacatgacacaagtagtagctttctaagcagtttatctctgtggcatgatcttgactctattatgcctcatttagtttctgcctgttttctaagcttggttctcaagctgcttagtcaatnttgtgngtcnctgatagtntcacaataaatcnccttactgnttaaaa

SEQ ID NO: 700434 - DNA, 282 bp, Homo sapiens
atgggaggatggcttgagcctgggagacaaaggctgcagtgaactgcgatctcgccactacactccagactgggcaacagagcgacaccgtctcaccccaaaaaaaaaaaaaaaaaaattagtatggagatggacatctgtgagggtgaaccaaattggcttcatgtaagttactacatctctgccactttgaagcagcgccatctggtggaagccctggtgaggcaggtaggtgggcatccaaactgtgggccacaggaggcctggaggtggggaggatgc

SEQ ID NO: 700435 - DNA, 395 bp, Homo sapiens
ggcgggtgccctggaatctggggtcccggtggctgtcggggttatgctcggggtttcatgcggaggtgaggcgggtgccctggaatctggggtcccggtggctgtcgggctcatctggatgcgtggccagagggcagaagactccaggagcatttcagagcctcttccaggagtgggacatggacagaaagcgtgtcatcaccacgtctctgaacttcctggactgttctaggaaaaggggcatccagaagccagggacagcccgcaggtggcctgtgaggcagattggcttggcctggatgtcaaagctgtgaggatcccagaacaggctgcctcggggctgggaatagaactgcttgttctgtgaacagccagcgtcattggaaagccccagg

SEQ ID NO: 700436 - DNA, 600 bp, Homo sapiens
cggtaggagctgttaaagacatctacctagttgttgggactgttgacgcatactacaaagcttcttatacgctgcatacacaaagtctaatattaaatgagaaaaaaatggctactacgctgcgatatcctcaaatggggaaactcataaagatttcttggcagagtgggttgatttccttttgacacatcataagactttaacatcctggagcaccacgttcttcatttattccagtttaatgcccccatactggttgaagtccatattggtcggtgatacgcacctatagctcttgcggtaagacgcaaaatctgaattggctcaatctcacggcagttgtttcatgagctaaagggtcccactgacgcaataagtctgcgtggactggtcaataagacacgacacttgcattcgcccaatgggctacgactcaatttctactgttgcccatgggctaatacaccttactgtggagaacattaagcgattctagcactctctctcaggtggatgggtgtaccatggaatgctctatgaccttcatccatgggcattcgtactgagatcactgtattgctcataacgcctggtccccct

SEQ ID NO: 700437 - DNA, 244 bp, Homo sapiens
gggcgaattctggggctgctggaagcttacttgaagacgaggacttttctggtgggcgaacgagtgacaatggctgacaacacaattgtctgcaacctgttgtggctctttaagcaagttctagagccttctttccgcccagcctttccccataaccaacgctggttcctcaactgcaattaaacagccccattccggctgtcttggcgagtgaaactgtgtgagagatggccagtttgatgct

SEQ ID NO: 700438 - DNA, 593 bp, Homo sapiens
agagccttccatgctgctgagcttgggctcccgggaggggcagagattcgaaggccaggcgtagtgaccgaagcacacccgtctgctcctcacacgcggagtgtttaactattgctgagaaggtatttcagagagttatgactcttgctaccaccagagctgggacgggctaaccttccgcaggcactgactatgttgtgggcagtgtgctaactaccatatatgtgtatgttgacatgcatgtgtatagtctaattgaatcccatgaggaagacatttcaagccccattttctagtaaggaggactgaagcagtggaaagggcagagatgatggggtcagcccaggtctgcacagcggacagctggtgaagccaactccaggtatgccttgcccaaagccctggctctgaaacgccattgccaggtggccagagccttctagtagaagccgttaggagtagggcaggcagaagcactcgctcttactatgtatgaggcctggatttagcttctcaatcttggtgttcttacggggtgtctgtgaggagggctgatttcatatttaaattgtataaataagcattgttggata

SEQ ID NO: 700439 - DNA, 130 bp, Homo sapiens
ccgttcgtgtattgaaacttgaaactaggcgtagtaatagatgtttcagtagctcttattttacagtaagattacaaaaatttaggaacatgaggggttactgagagtgggaatcgatgcgcttgagatg

SEQ ID NO: 700440 - DNA, 1544 bp, Homo sapiens
  misc_feature (1252)..(1252): n is a, c, g, or t
  misc_feature (1380)..(1380): n is a, c, g, or t
  misc_feature (1495)..(1495): n is a, c, g, or t
ctcagccccgcttccctttgaaatgaatgttcctggggcgccctctcgtggattttggagctaatcgtctgtgaatgcagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagacccctcatcctgcatcatggacaagaacgcagcacttcagaatgggatcttctgcaactgatcgtctccatgcgccctgctctgcggctgtgtncttatttattgcatgcgtcgcttccacaggggcccctcaagagctgtgactcgggagagctaccttactttgaccaacagcctgcccagtgtggatgtctcttacagagggggcccaaggaatcaccnccccgcttcagtgtaaacaacgtgccttgtccactttgggctccagagtctttcagatgtactaagctgctgacatcatccactgccttctgctgcatcctagacaccctccctnttgttcacagagagggaaggtcgtgggccacacaatgctgtgtgaccct

SEQ ID NO: 700441 - DNA, 140 bp, Homo sapiens
ggtcgtatgagacagcaagcaaagatattgatgaatgtgacattgtgccagacgctcgtaaaggtggcatgagagtgtgtacaacactatggaggatacctctgcctaccgaaaacagcccagattatatgtacaataat

SEQ ID NO: 700442 - DNA, 239 bp, Homo sapiens
ggtcggccggcgcggtgctatgatgctggtactttttgactttttgggtacgacgacggggtttcaccatgttggtcacgctggtctcaaactcccggcctcaagtgatccatccacctcggctcccaaagtgctgggattacaagtgtgggccactgcgctaggcctagtttttttttttttttttttttttgggggggattctttaaaagtcaccgggagggcatgcaagtggggca

SEQ ID NO: 700443 - DNA, 160 bp, Homo sapiens
ccaaacagctgagcaatctgggttgggattttatcacacattatttttaattgatgaaatttccttctgtggtgttttgttctgtttttgttttgcgcgctttttttttggttggttttttagaaaaaggggtgggggagaagaattaaatttagagaaa

SEQ ID NO: 700444 - DNA, 234 bp, Homo sapiens
cagagtattggtctgagagagcactctgggtgtgcacagcagtatgggtgtcacacagagtatgggtgtgagagagcagtatgggtgtgagcagagagtatgggtgtgtagagacagtatggctgtgtgagagcagtaatgggtagtagtggtaggcgggggtccttgtatctgtgcgctcaagcacagtagcaccacaagtaacagcaggtagctatacacggtatcaactag

SEQ ID NO: 700445 - DNA, 207 bp, Homo sapiens
gtgactcagaaacagttactacaatgctggctgtggcggctcacgcatataatcgcatgtgctatgcgagtgccacacggcaggagaagtgcttcagtccaggaggtggcagctccagtgagctatgattgtgccaccgtattccagcctgggccacagagcaagaccccctcacttcacaatacaatgctgggggtaccgagctcg

SEQ ID NO: 700446 - DNA, 1212 bp, Homo sapiens
  misc_feature (577)..(577): n is a, c, g, or t
  misc_feature (582)..(582): n is a, c, g, or t
  misc_feature (596)..(597): n is a, c, g, or t
  misc_feature (608)..(608): n is a, c, g, or t
  misc_feature (645)..(645): n is a, c, g, or t
gagatgtcgctgctgcgtgtcgctgcgcgtgttcctggtcgcgcggaccgggagctacccggctgggtctcttctgcgtcagtacgccccagccaaggcacacattttatgctgggccccgtctgtctgcctcggcctccagcaaggagctcctcatgaagctgcggcggaaaacagtgctactcctttgtaaattgcaagaaagctctggagacttgtggcggtggacctcaaacagtgcagagatctggctccacaaggaggcccagaagggaaggtgctggcagctaaagactgccatagctccgtaggtgagtgaagactcaatagaagtgcctgcattgggctcgttgcagtgaatggaaacactaactgtattagtagagtgtacaactgtgagcacagattttgtatctagaaactttagaaatttcaacttgttggtaccagtgaagtaggcccgttggtaccatcgatgcgattgtcagaccctaaacggatcaagcctctgcatacagtagaggtttcttgaattcctctgagctttctggacttccagctgggcctgacagagaangctcnactcacaggatcanntggctttagcnattggaaaactgggagaaaacctgattcttaaacganctgcatgggtgaaggtgccctctgggtttctaccttggctcttatgtccccggagccatcccgagtccctcccttcacccagctggtgctggggaagtatggggccctggtcattctgtgagaccgtcttgcaccagaacacccaccccttgaagaccgttggcccccccccttgggccacgccatgtggtgggccatggccccccctcgtcttgttggcctcctggaccgatgacccctgggggagagcccagagactaagatgctgtccccagcccgtatttgctggatcccctcccattaccttgggcgccagtatgtgccagcctccgggggtttccggtagtagactttgtcccggtttgaatgtggagaaggtgaagaggccacgccagaaactgaataggttcccagagacttttggccccggaggaatatttacttttagctctggaccatccattcaccaaaaaggaatatttccccaaacctcttccagaccgagaatgcctgggtaaaattattaaatagttgtataataaaaataattttttccttgtttgcgta

SEQ ID NO: 700447 - DNA, 537 bp, Homo sapiens
ggtatctagagatcctagctggcgcagtcactgtcttggagtacataatacttttgctacttactagttgcgtacaatctatctgtgatcattgatttctaggtatttagcattttatgttgaggtggttcatttctattatcacagagaatattttaacaatcaaaatcacctgttcctttttgagctttatttcctgtctgactggttgattttcttgatactttttcatttttacttctgtccagatgaacatttccaaaactcgttccaattgttgatcttccaacagatggatttacaccctcagaaaggtcattttccatgttaaagaaacacacaaaggctttgatgctaaattaacattattccaattatccttgcttatcatgtagtcatcttttataagtacaagcaaattgggatctaattaaagtttgcttcatcttaattttctctcttgcattgacacacagatgcgttctcttaggggttcatcgaattttcacctgtgtgggacactaaaaagtgtacatc

SEQ ID NO: 700448 - DNA, 290 bp, Homo sapiens
gactcgtctatgatcatcttctagagctcaacctgacagatatgctagctgcttcatgctggtcttcatacatcgttgttgaatgttaaaaatcctggcggcattgtacaagggtttccttttctctacatcctcaccagcatttgttattgcctgacttttggataaaagccattttaacgggggtgagatgatatctcattgtagttttgatttgcatttctctgataatcaatgatggtgagcaccttttcatatacctatttgacatttgtatgtattcttttgag

SEQ ID NO: 700449 - DNA, 239 bp, Homo sapiens
  misc_feature (221)..(221): n is a, c, g, or t
agacggatttgagatggggtttcaccacgttggccaggctggtctcgaactcctggcctcaggtcatccacccacctcagcctcccaaagtgctgggatgacaggcgtgacacccgtacccagcctcggtgaaaacctcagaggcaggcagcatattccctgccgagccggtagtggcgcagtcagataagcattaactaaatcacagctccctctccccntcagaatctttatctaga

SEQ ID NO: 700450 - DNA, 624 bp, Homo sapiens
atgacgggccaagccgcctgggggacggaggcgccatcagtgatcgcccgtccccaggcgggccccatccgcaccctggtgtccccgtggttacccagacctgcacgaacacgcggctgtcggacgggacactcgagcggccccgggcgggaggaaagacgatccgtctgtgtcggacatgttcaggcgtgaagaggggtcgtgcagcagccaggggccggtgttgccgcggggaacgggtgacgcatggcaggggcgggcgaaggtcggccaagaggagagaaaacgcgcagccatgcacccattagtgccatccgggaaaatgtgacccgagcaccatcagcgcacacgagcggcgaccgttatgaaaaaagggaatgccgattgcaggacgggcgcgatacaacacgctatgactgggactacgaagacaaaatacacacaccaaaaggagcacgaattacaacacgggagaaaacaccaggggaacacggaccaagacacccgcaacatgaagaccagatacacaaaccatgagacgccatagaagtaaccactgcgaagactggataaggccctccactgaggcagaacaaggcaaccgacacctaccaccaagggtaa

SEQ ID NO: 700451 - DNA, 879 bp, Homo sapiens
  misc_feature (429)..(429): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (439)..(439): n is a, c, g, or t
  misc_feature (446)..(446): n is a, c, g, or t
  misc_feature (455)..(455): n is a, c, g, or t
tgtccaaataaatggattgttgccaagccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttgggttggctggattcagtaataaatatgtaaggcctttcgttttttgaagagaatanaaananananaagaaancaacaaagnagaaaatgatgctgatcatatacacatgaataaaatacaaaagaattatactacaggcacatatatggccaaagctcagtgggggaccttccttgggagcagaaggtagaatccgtataacaaagctactgacaagctctggaactacattcttaatgccgatggtcctggtccccttgaactaccaagcagtggctctgggatatatcgatgagtacatctaccagttacagtcaattcagatcagtacgatgtaagactgccaagaaagtcagaaggaggagatgactactatcgaccagatcccaaatctggaacgtcatagagcactacaatggcctaacatcccctggtagacaaatccagcacctccaacagacagttgggaagtatacacaagcggaaggtgaccatgaaaagagag

SEQ ID NO: 700452 - DNA, 924 bp, Homo sapiens
  misc_feature (29)..(29): n is a, c, g, or t
gtctgagcggggatgtagaggcggcggcngcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctcctgcccgcgagccgcgctcagctcgggggtgattagttgctttttgttgttttttaatttgggccgcggggagggggaggaggggcaggtgctgcaggctccccccctccccggctcgggccagccgacaaggacaggcgcgactcgggcataccggacccgggcactgctggcggatgagagcggagctgcacacagggcggatggtgcccagagcggagcgcagatcaccatgacaccgaacactaccccctcggactacgcggagacggacggcggtggcggcttggacgactcggagagccgagtgaagacattgaccacctggacacctgacgcatgtgccatgcagcctgagcagcgaggcacaccaggcaattctacgtggtacggcgaggcgacaagcaacggggccaaggagtacccagggaccatggtgggaccaccacaacggagcaaggagagacagggacatcccaccaatcaatagcacgactgcgaccgacatgacgggcccatccggggcaccaccacccaaggcggtacagaagccccataccgagaacagaggtgggacatcccccaaggagcattgcaggcgcacaccaacagacacaaacgacagaccaacgccacacacaactgagccacacccgcgacggcgcaaggacggagcagacaccgatagaggccccaagcaaggaccacggaaacaccaagagaacgaaccaaacaa

SEQ ID NO: 700453 - DNA, 969 bp, Homo sapiens
tgtccaaataaatggattgttgccaagccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttgggttggctggattcagtaataaatatgtaaggcctttctatgtttaaatgctcgatacagtctttagacagaaatgcaacaaagattgcacacgaaagctcagcagagagtcggagggctgcgtgtgtggtaaacctgagtgccacagaatgaaaacccttgtacctcacgtattgtgccaatcaccctttctggcagtgaatgtcctcacggaacacagctgaggaagttgggggcagttcatggcagaccaaaggtgccagcagcccatggagatctcgtgctgaacacgggcatgagccaacccttcatgcgcctggataaataccctacggctgctcaaaagagctcgagaagacacctgggaggattatcatacagatagacaagatattcaaaaaatccactggctgccttcaaaaaacctttcaggcccaagggtcaagaaggtcggaacgaggaaagaagttgaagctgcgagatccctgagggaagccatccgggaactgggagggcgcatgaccttaaaactcagggcaaggcacttcactgcccaggtccgatccaggggccggaaggacgaacagaagaccgac

SEQ ID NO: 700454 - DNA, 787 bp, Homo sapiens
  misc_feature (29)..(29): n is a, c, g, or t
  misc_feature (279)..(279): n is a, c, g, or t
  misc_feature (288)..(288): n is a, c, g, or t
  misc_feature (297)..(297): n is a, c, g, or t
  misc_feature (306)..(306): n is a, c, g, or t
  misc_feature (311)..(311): n is a, c, g, or t
  misc_feature (315)..(315): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (335)..(335): n is a, c, g, or t
  misc_feature (350)..(350): n is a, c, g, or t
  misc_feature (360)..(360): n is a, c, g, or t
  misc_feature (362)..(362): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (386)..(386): n is a, c, g, or t
  misc_feature (389)..(389): n is a, c, g, or t
  misc_feature (392)..(392): n is a, c, g, or t
  misc_feature (397)..(401): n is a, c, g, or t
  misc_feature (406)..(406): n is a, c, g, or t
  misc_feature (419)..(419): n is a, c, g, or t
  misc_feature (425)..(425): n is a, c, g, or t
  misc_feature (431)..(431): n is a, c, g, or t
  misc_feature (442)..(448): n is a, c, g, or t
  misc_feature (450)..(451): n is a, c, g, or t
  misc_feature (453)..(454): n is a, c, g, or t
  misc_feature (459)..(459): n is a, c, g, or t
  misc_feature (479)..(479): n is a, c, g, or t
  misc_feature (495)..(495): n is a, c, g, or t
  misc_feature (503)..(503): n is a, c, g, or t
  misc_feature (511)..(511): n is a, c, g, or t
  misc_feature (515)..(515): n is a, c, g, or t
  misc_feature (520)..(521): n is a, c, g, or t
  misc_feature (538)..(538): n is a, c, g, or t
  misc_feature (547)..(547): n is a, c, g, or t
  misc_feature (549)..(550): n is a, c, g, or t
  misc_feature (552)..(554): n is a, c, g, or t
  misc_feature (568)..(568): n is a, c, g, or t
  misc_feature (572)..(572): n is a, c, g, or t
  misc_feature (574)..(574): n is a, c, g, or t
  misc_feature (576)..(579): n is a, c, g, or t
  misc_feature (585)..(585): n is a, c, g, or t
  misc_feature (623)..(623): n is a, c, g, or t
  misc_feature (670)..(670): n is a, c, g, or t
  misc_feature (681)..(681): n is a, c, g, or t
  misc_feature (720)..(721): n is a, c, g, or t
  misc_feature (747)..(747): n is a, c, g, or t
  misc_feature (749)..(749): n is a, c, g, or t
  misc_feature (767)..(767): n is a, c, g, or t
  misc_feature (776)..(776): n is a, c, g, or t
gtctgagcggggatgtagaggcggcggcngcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctcctgcccgcgagccgcgctcagctcgggggtgattagttgctttttgttgttttttaatttgggccgcggggacccccaccaccccaacctnattaaccanaaaaaaaanaaaacaatncccantcanctccacctcacnananccanaaccaaaacccaaancatccaccancntcaccncntnaataccaccgccgnaanacncaccnnnnntgaangtttaaacaaaanaaaaanatcaanacaccacaacnnnnnnntnnannattgnaacaataccacacaacactnaacaaatttaaaaatncaaaaatnaaaatctnaatnaaatnncaacacaccaaaaaaancaatatatntnntnnnaacaacccaaaccnaatncnannnncaaaanaccaacttccaaccataaatatcaactcccctatcccnataccaaaaaaatctacacaataccacctccataaaaccatcaaccnccactacaacnacaacaaaaaatccaacacctcccactccaacaactccnnaaaacccaccacaaccacaaaacacncnactcctccctccaccacnaaaaccatnactcccacatc

SEQ ID NO: 700455 - DNA, 1113 bp, Homo sapiens
ccgttttcccaagcactatatattaagtagggaatcttttccccatgcgggtaagtcaggtttatcaaagatcagatggttgtaaatgtgtggtgttatttctgaggcctctgtattgttccattggtctatatatctgtttttgttcagtaccatgctgttttgtttactatagccttgtagtatagttagaggtcaggtagtgtgatgcctccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttgggttggctggattcagtaataaatatgtaaggcctttctatgtttaaatgctcgatacagtctttagacagaaatgcaacaaagattgcacacgaaagctcagcagagagtcggagggctgcgtgtgtggtaaacctgagtgccacagaatgaaaacccttgtacctcacgtattgtgccaatcaccctttctggcagtgaatgtcctcacggaacacagctgaggaagttgggggcagttcatggcagaccaaaggtgccagcagcccatggagatctcgtgctgaacacgggcatgagccaacccttcatgcgcctggataaataccctacggctgctcaaaagagctcgagaagacacctgggaggattatcatacagatagacaagatattcaaaaaatccactggctgccttcaaaaaacctttcaggcccaagggtcaagaaggtcggaacgaggaaagaagttgaagctgcgagatccctgagggaagccatccgggaactgggagggcgcatgaccttaaaactcagggcaaggcacttcactgcccaggtccgatccaggggccggaaggacgaacagaagaccgac

SEQ ID NO: 700456 - DNA, 151 bp, Homo sapiens
caggggtaacaccactgaatcaggaggtggaggttgcagtgagcgagatcacgccattgcactccagcctgggtgacagagcaagactctgtctcaaaaacaaaacaaaacaaacaaaaaaaggccgggcacagtggctcaagcctgtaat

SEQ ID NO: 700457 - DNA, 284 bp, Homo sapiens
agctgggagagtcaaagtcctggtcgtggttgatgagcgaagaagatctggagccggagccctttggagcatgatgttgttagaatctccttgggctgtgtcaccggccactcgtaccctcatgtcggactcagaatacagctttgcaattatattacaaagttcaagtcttcatcaacatcttttttttttgttggagatggagtctcgctcggtagccaggctggaagtgtagtgctgttgatctcagtccacggcaacctctctctccaggggtgcagcag

SEQ ID NO: 700458 - DNA, 428 bp, Homo sapiens
catcatggcggcctggaccaactactttgacctaattgctagaaagagttcccttttacaagatctggcgcagtctttacatttccctgtctaaacccggaaaccgtcatcctgaggctttcttaacatatttcctagttcaaagcaacccatcgttcttgcttacatctgcatttcaaaccagctttaaaaacttaagtggattgattagttctaagttattcttgcccagactttcatatatttccttgactggctactggattatagtattccgaaccctggccagcttaagattagagtagatagcaagaagacttttcttctgcaacagctgttaccgagtttagaagccctttagacttgttccgagggattgtgctcttacaggatagatccctggattcccactctccccaggccagtcg

SEQ ID NO: 700459 - DNA, 696 bp, Homo sapiens
  misc_feature (8)..(8): n is a, c, g, or t
  misc_feature (136)..(136): n is a, c, g, or t
  misc_feature (151)..(151): n is a, c, g, or t
  misc_feature (208)..(208): n is a, c, g, or t
  misc_feature (210)..(210): n is a, c, g, or t
  misc_feature (217)..(217): n is a, c, g, or t
  misc_feature (225)..(225): n is a, c, g, or t
  misc_feature (240)..(240): n is a, c, g, or t
  misc_feature (276)..(276): n is a, c, g, or t
  misc_feature (359)..(359): n is a, c, g, or t
  misc_feature (364)..(364): n is a, c, g, or t
  misc_feature (367)..(367): n is a, c, g, or t
  misc_feature (389)..(389): n is a, c, g, or t
  misc_feature (391)..(391): n is a, c, g, or t
  misc_feature (402)..(402): n is a, c, g, or t
  misc_feature (421)..(421): n is a, c, g, or t
  misc_feature (436)..(436): n is a, c, g, or t
  misc_feature (444)..(444): n is a, c, g, or t
  misc_feature (462)..(462): n is a, c, g, or t
  misc_feature (474)..(474): n is a, c, g, or t
  misc_feature (567)..(568): n is a, c, g, or t
  misc_feature (573)..(573): n is a, c, g, or t
  misc_feature (594)..(594): n is a, c, g, or t
  misc_feature (608)..(608): n is a, c, g, or t
  misc_feature (617)..(618): n is a, c, g, or t
  misc_feature (624)..(624): n is a, c, g, or t
  misc_feature (630)..(630): n is a, c, g, or t
  misc_feature (672)..(672): n is a, c, g, or t
caggggtntgtccaggttgctcttgatggtgttgaggaagttcgtggtgttcaggaagtgttcgttcagctttaaattgctgaggccgtgaatgcagcccgccaggtccttggtcatgggtccactctccaccgtntccacgcacaccttntccagcatttggggaaacctgatgaggttttggttcccatccagcttcccccggtgntncagggcncgtgttcnggcaaagatgttggngatggggttggtgctggtgggccggccttctggtgntcccgatagtggggggtgacggttacactgacggggggttacggttacacttgttttttcacttacggggacgaccacggacnggacngtnactcacgggcaccgggacgcancncgccctggggncacggactgtttgacctgnacactctcccgtacnacgttctntggacggggcacacaccncgccaccccgancgacctctgacggaccctgacgcgacccactgttcactcacctgacgggggggtgggtcactaccacgacccttactctctttgtcgaccgtnngggtnttactacgtgtgttggtgacnccactctccctggnacgactgtnntttganaccggncactcgtacgggttttcacgtactggtgtttctttggtggtnactgtacacgggggaacttttatt

SEQ ID NO: 700460 - DNA, 599 bp, Homo sapiens
gtgacagccgatatatgaagcaatatatacgctaaagagagagagagaccccaatacaataatagctggagacttcaacactccacttacagcacggacagatcattctaacagaaaatcaatgaagaaacagtggacttaatctgcactacagaccaaatggatttaacagatatttataggacatttcatccagcagctgaagaatacacattgttctcgatctcttgacctcatgatccgcccacctcggcctcccaaagtgttgggattacaggtgtgagccactgcgtctggcctatatttgtaattgttatatcttctagcttaattgacccctttatcattatataatgaccttctttgtcttcttctatagttttggtcttgcatctgtttggtctaatacctggtattagacaaaatagttaacatttgcatggaatatttttttccatctctttattttcagtatatgtgtcttgacaagtgaagtgtgtttcttctaggcagcagatcatggggtcttgtgtgtgtgtgtgtgtgtgtgtgtgtgtgtgtgtgtgtgtgtgtgtgttatatccatatacctagtgagt

SEQ ID NO: 700461 - DNA, 710 bp, Homo sapiens
ttgttcctcatcctgcctccttggctcgccgcagccgcctccgcgcgcgcgcctcctccgccgccgcggactccggcagctttatcgccagagtccctgaactctcgctttctttttaagtcccctgcattcggatcaccgtgctgtgcccctaccattagtcgagaacgctagcctgtatgacaaccatgctcgctgaatatcgaccactcatagtgacttaagatggatgaagaaggaagttgtggaagaggcagaaaatggaagagacgcccctgctaacgggaatgctaatgagcgacaacatggggaggcacgaggctgacaatgaggtaccacgaacgaacgaggaagacaggtggcgcgcacggaagacgacggcggacacgaaacaaggtgactggtgaggcacaagcaggatggagactgacgatgaggaacctgactcagctacgggcaagcggtgcagtctgacgactgatgaggagtgacgatgtcgataccaagaagcagaagacctgacgaggtatgactagtacaggcaacatgaaggaaacagttaaactaagaatacaaaaaggccgccgttgacctattcacccgtccacttcccggtctcagaatctaaaggtggtcaccttcgattatgagaggtccgccgtccctccgtgggcagtgcccaccgcagatgacagaggtcatcacaacct

SEQ ID NO: 700462 - DNA, 447 bp, Homo sapiens
  misc_feature (163)..(163): n is a, c, g, or t
cagaaaatgaagctgtaccatccactgcagctcctcactgccactcatgttgctgatccttggcacgaggtggaacttctgctgggctgcctgcactgcggccggggggctgcgcggggtcgccatacccacgccattcccggagctcgggccgggttccctnaagtctcagaacatgccccgggctggcggctccgcgtggtccacggccgctggcttccgactctctttccagattttgaccacatgatgttttactgtcttggccctctactgtgccttcacacagattttttaaacctactttttcagctgttctcagcaatagggttcatctgaattagccagtctaccacaactggatgcacaaccaaagcctaattttggtttttgtttttgttgttgttgttatttttaataaatttataccttgccttgttcaaaaaa

SEQ ID NO: 700463 - DNA, 747 bp, Homo sapiens
  misc_feature (35)..(35): n is a, c, g, or t
  misc_feature (209)..(209): n is a, c, g, or t
  misc_feature (216)..(216): n is a, c, g, or t
tgtcaatctaagaatcctgtggcaaatccaagttnatccacggggtcggggggggctacaaaaaactctaaatacactgagcaatactgaaaaagaaaaataaaggtggagtactcacacttccctaaattcaaaatttaccacaaagctacagtaatcaaaacagggggggactggcataaaagtagatatataggggggggggctanaaatganattccaaaaataaacccaaacatctatgggcaattgaattacaacaagaatactaagataattaaatgtggagacaagaatcaaatagacgcaataaaaaatgataaaggggatatcaccaccggtcccacagaaatacaaactaccatcagagaatactataaacacctctatgcaaataaactagaaaatctggaagaaatgggtaaattcctcaacacacacaccctcccaagggtaaaccaggaagaagtagaatctctgaatagaccaataacagggtctaaaattgagacaaataatagcttaccaaccaaaaaaagggcgggaccagagcggttcacaggtgaattctaccagagggacaaggagggagcgtggaccattccttctgagactattccaatcaacagaaaaagaggggatcctgcctaggtcattgtatggggccagcatcatgctcataccgaaggctgggagagacacaaccaaaaaggggattttagaccaatatccctaataaacatgcgg

SEQ ID NO: 700464 - DNA, 109 bp, Homo sapiens
gtcgacgatttcgtcatttttcaagtcgtcaagtggatttttatcattttccatgattttcagatttcttgccatattccaggtcttacagcgtgcatttctaattttc

SEQ ID NO: 700465 - DNA, 589 bp, Homo sapiens
gggtggggttggtgggtagcgtggcaggcttgggggctgcggctggcacggtccccagtactcacgggtgccacaacgcggatacgggctgccttgggatgtgctgctgttcccccactttgaccactcgagtgtgtactcccccttgtgcttgagcaggtcggacacgctgtctagccggctgcccacgtgcttcaccaggatctcctcgcagggggtccttgggccatgaacccccaccagctgcatgttgttgcctgctttgctgcagtctactgtgaagctgctcttctggcctacgtaggccttgctcagccccaggcccttggccaccaccttgctggcgtcagcaggcccaggacccggggccccatgctggggggcacaggtggccttggtcagagagtctacaaacactgatgatgtctcgtggaggctgtggttgctgacgagacgggggcctgtgactttggccttgaaggggctgcccccaatgtggtaggggccgccgtacttgatggagatgaggtagctgccaggtgccatgggggtataggtgacgcggtagccctcagggcactcctggcaa

SEQ ID NO: 700466 - DNA, 948 bp, Homo sapiens
gatgccccgctgctgactgtgcccgggcttgggccctgcccttccacttgcccagtccttaatgaccaccgagcggctctctgggtcaggcctccactggccactgagccggactcgctcagagcccctggcgatggacgtgccacgcgggcatgcgcccgcctggagcagctcaaaagctcacgtccaggtgatcgcgaggtcagccaagcctggagtgagaagccgcgggtgaggccagataccctcggctgaagacctggagacagatggcgggggaccgggtccaggtggtggacgatggctggagccacagggagcatgggccatgggacagctgagggcagaggccccgctcctctgcagcgagcacccatcaggtgtagcatctgggagacagggaagcgatgggctgggcgggcatccccccggggaaggaacagtgggacgcacttgcagcctgctatgcctctggacccagtggttggtgcacagaggcctctgtaccccgggagctcagatctatcaccagacagaagcttgacatcacatgttaaggccaccaagatgactggcagccaaggcccagagttcctctcccacgtcaggagagccctgaccaggaaccctgcaacttcaacacagggatgatctatgactcgagtcagtgctggactcaccagtggatcatgagagggaaaagaggcagggaacacggagcaaagcacgggcgagaattcgaggaacattgggtccccgatggcagacacgaggcctacaggaacaggggacagactcagaggacgaaagaggcaactgggaaagctgactgggcagtgaaagggacgggacaaatagagacaagccgtacagggacatgagaaacggaagtgaagactggccgggcgtgtctctcctcttgtctggggacgagacaaagagcagaag

SEQ ID NO: 700467 - DNA, 852 bp, Homo sapiens
  misc_feature (852)..(852): n is a, c, g, or t
gtcagaggagggaggaggaataaggggaaggaagagagagggagcaggcggagcgagagagggagaaacaggcgcggggtctcaggttggattatttgttggccttaagtcccaactgatgtccattagccggactcgcaaagctgaggagccgcttaatgtggacctatgcgatcgcatcctacgctcacttaccggacttaaccgcgccctggcattctactcatctgcggcttggcggggatgacggcggggctgcgcgaacaacgactggactggacaagcggacgggcaaagacaagatgcaactagcgaacgagacacacctgaccagcccctccccccaggctcaggtgggagtcaaactgctcctcccctcccccatctagagtctagacagacggcacaggcctagcgagactaggagcggaatctggagggggcgctggaggagtgcgaaacggggcgcaagcgcgagcccgcgcagcaatacagggcatcccggctactggctggcagtctgtgtccgacgggtcgactagcggcgcagcggggtcctgggcccggtgaccgcaggcctcagcatctccactctgcgtaacaggttcctcctttgggcccagcggccggcgaggccgccagacatacacacgttaccagacgctggagctggaccaaggagttcactacaatcgctacctgaacgcggcggcggcgcatccgagatcgcgcacgcccgtgcctgaccggagaggccgacccagatatgggtccagaacccgacgcttaagtgggaacccggagaccaactgcccacgcgtcccaacccatgccagggacacggaaaacccn

SEQ ID NO: 700468 - DNA, 220 bp, Homo sapiens
caaaggaaatccgaaatctttccaaaaaaaaaatgcccatgcctccaactatggaggatttcgagatggctttaaaaaaggtttttaagtcagtgtttgctgcagccattgaaaaatacgaaaaatggatatttgagtttgggtcatgctaaattttcccatgtaaactgtgaaaaatgtgccttaagggtttgaatattaaatgcagtaattccttgta

SEQ ID NO: 700469 - DNA, 1136 bp, Homo sapiens
  misc_feature (1136)..(1136): n is a, c, g, or t
gcaaagcagaattgcagctgccgccgccgccacctccaggccactatggcgcctgggctgcccaggagcttcaggccaaggtggcagagatcggagctccgatccagggtaatcgcgaggagctggtggagcggctgcagagctacacccgccagactggcatcgtgctgaatcggccggttttgagaggggaagatggggacaaagcctgtccacctcccattgtcgggcacagttcccgtggaattcccatgccaccgaccacctttgggactcccccctctgcagtctcctccgacagccccagcaactacagcaggacatggcctcggctttgcctgatggacccagccacgcaagatcggggcccccgaactacctcatacgcgtgatgggtagagccagatggcactgaacagaggaggcagcggctgaacgttggctcagacagcaggcggcatagctgatgcagccaggaggagcgtgccaagcagcagggagatcattcgctgaaggaccatgagcgtctggagcagcagaagcgggcagctgtgttactggagcaggaacgacaagcaggagactgccacgatgggcacaccagatacctcgagcccccacaagacatgggccagattaggggagacgcaactcctctgggaacctcgagctagctgcatcagcggggcacagagagggccacaagtcatacaagttgaggcacaaaggagaagccaccacgatgacaagggcacagagaaacaacaacaggcaaccaggagacacgaaacgaacaagacagcaaactcaaagacccaacaaagcccacagaaaagagaaaaacacaacacgggggaaagaagcaacaacgaagggaaaccacacagcccaacacgagggaaaccgacccaacacgacagaggacacagagaaaaaaaaaggaacaagacgaaacagagaaagggcaacaaaaccaaccaaacaggagaaacacagagggccaaacagcgagacaaacagagcgacaacacacgagccacagaccacacaccaacgcaagcacacgctagccagacaacaccagagagacgaccaagcaccgagcagagaaaacacgagacacgaggccacggtan

SEQ ID NO: 700470 - DNA, 452 bp, Homo sapiens
  misc_feature (274)..(274): n is a, c, g, or t
taacaaagaactggtgtctattaaaacataacttaaaaactatggaactatataccttgactggtggtgtagaacatggggaaggagtcatcacacaggtttcttgactattataggaagggctgtcagtcaggttcaggtataactcatcttcattggtaaagtttccctgattgtccacttctggagagatgcagattactatggcactagtgttatctgctcggagcatacgctgcctccagcggcccaatgctcgattcacaagcatttnggcacaagattgtccatgctcaccctgtattcaaaagaacaaggagaaggaaagtaactcagatttagctgccactacatctgtatctatatcaaattaaatatttggtgttcgctgtggcccaaacaaagctcccaattttttttttcttttctcttttttttttttggaaacagag

SEQ ID NO: 700471 - DNA, 138 bp, Homo sapiens
gtgtccaccttgcaggaacaaaccaatgtgtttctgtttcttttgttattttggagacacgagtctcactctgtcgcccaggctggagcgtgtggacagtgattgcgtccaccgactcccagaccttaatagttacaa

SEQ ID NO: 700472 - DNA, 663 bp, Homo sapiens
  misc_feature (509)..(509): n is a, c, g, or t
  misc_feature (544)..(544): n is a, c, g, or t
  misc_feature (566)..(566): n is a, c, g, or t
  misc_feature (573)..(573): n is a, c, g, or t
  misc_feature (596)..(596): n is a, c, g, or t
  misc_feature (622)..(622): n is a, c, g, or t
  misc_feature (632)..(632): n is a, c, g, or t
  misc_feature (637)..(637): n is a, c, g, or t
  misc_feature (641)..(641): n is a, c, g, or t
  misc_feature (643)..(644): n is a, c, g, or t
  misc_feature (647)..(647): n is a, c, g, or t
  misc_feature (651)..(651): n is a, c, g, or t
  misc_feature (656)..(656): n is a, c, g, or t
  misc_feature (660)..(660): n is a, c, g, or t
gagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcccaaagtaacaaccagtttgtattgtaccgcataactgaagccactaagacggttggctctgacacgttttattccttcaagtacgaaatcaaggagggggattgtcctgttcaaagtggctgcacagcaaccgtggggaagaggagcagtacgaaattctccgtggctacccagacctgncagattactccagccgagggccctgtggtgacagnccagtacgactgcctcggctgngtgcatnctatatcaacgcagagcccaganctggagcccattcttagacacggcantcagtctttnaccancacncnncanttcntcctnttcncgc

SEQ ID NO: 700473 - DNA, 282 bp, Homo sapiens
ccacggcatgttctgagttatggggagttcacggggagcattagtgctgcgagatcttctctctcctgcttgcgcgttcggccctccccacacttcacttatgctactctaatacccagagtctgccaacatacgggcaggatgagagggctgaccctgggctaccaaattcctcttgtgatctcctcacctctcccaatccgttgataccaactctgtccctacattcccccaagcttgcattaccaagcattgcatgtgtgtaccgcgctcgaagttcgt

SEQ ID NO: 700474 - DNA, 369 bp, Homo sapiens
  misc_feature (262)..(262): n is a, c, g, or t
attgatcacattacaatgactcctctttgtacttgtaccccttttaaatttaaactagaccttcctagaagtaatcctatcatccccgctggcaagggtccacagactcctgttgggaccttgtgtgggggttccctagccagtagtactgcagtagattgatactgcacaaaagctatgagtcttctgcctgtggcgctgtggcgggggacaaatattgtataggggtgagggagtggcctgagctggaaatgccccagtntggaacggggcccaggatgggccctgcatggcatttcctgaatttaaaaggaaaaggctcaaatgtagctatatttccctgttgatttggggggtgtatgctaacag

SEQ ID NO: 700475 - DNA, 218 bp, Homo sapiens
tcccttttcctaggcacttctaacatccctagtacctcaactacctaacctacacattttgaatagtaatccctactatgcacactttatttctccacatactcgattctaccctatcatcacacaccgcacaatcccctatctaggtatatcttacgagccacaagctgcccctactcctcctatacctgttttggctgatttgccttttgtaaatt

SEQ ID NO: 700476 - DNA, 190 bp, Homo sapiens
atcggcaaaataaagctttgtgcggcagtaaattgtcctttggccagtaagaagccggcttgaataatattacccgtttgtaagctggcaaaccgttccccatgatattgaaaggtgtaggcatcgacaaaaccagaattggctgctaagagtaacgcgatatagagacgttcatgaatcggatgtgtcg

SEQ ID NO: 700477 - DNA, 900 bp, Homo sapiens
  misc_feature (197)..(197): n is a, c, g, or t
gtggcggtcgccgagtagggtgtgcgcatggggacaaggagcgtgatcgtggtggacgagtgggcccaggcgggtctaacgggagaactcccttgcgtctgctagcacaaggtgtgtatgagtggtgcccgcgtgtaaggtcttgcgtgaatactccgtcactggactctctggatagcacggcgagcgattgaccngtgcctattgtagtgcatctcagtacgaaggggcagcccgcatcccgtggctgctagacgagtgcccaacacaggggcctcataccgagtgaccaatgtctggccggtctcgtgcagtgtggggggggtctttgcgaggcgacgccatcctgggccgtcttccagagggctcgaaggcgtcaacgtatcgcttgtccgcaaactttatagtcccatatgcggtgacttggtcgtcccagtcgaaccctaggcaggccgaccagatcaagggtgctgcgatccaataggtggtgaggcacagcgacgggccagggtaaccttttaggccacggaaccgggaccaatacagaagcaatccgatggataggcacggacttggagccccgagcgtgccccaacccgggtggaatttgggacttgaccttggactttactttgggcaagcatggacacttgggggattcatatggttgaaaaacgaaacccgcgttggaccaggggattccatccaccgtggtgccacatttgaattcaaggggtaacagtaatttcaaaaggggatccagggacctgggcctgggaacagatccatatcttaaaaaccaagaccccaagggaccacacatggcacccgtgtggaagtggaacccaaggtgtgcgcacaaaaggtaaagggaaaggatgaacaggtagtaagaggtta

SEQ ID NO: 700478 - DNA, 165 bp, Homo sapiens
gacgaacgtgtcgtcaacaaccagatcggcttcaccaccgaccctcggatggcccgctcctcccccgagcccactgacgtgcccgagtggtgtatgcccccattttccacgtgaactcagaatgaccccgaaggctgtccatgtacgttttgcaaatgtggtcgg

SEQ ID NO: 700479 - DNA, 516 bp, Homo sapiens
  misc_feature (484)..(484): n is a, c, g, or t
atataatgaagatcacccagaactgatgaagtctacaagtatacagccgaaagacacactgaaaacgttaagaggtcaggcagataaatgtagacatgaggagaatacgatattcagagaaaaaagtgctaagactttttcagaataaaagctatggatggaatctcacatttatgacagtactttaaaaatccatacctcagtacaatagtaaaattgttgaacatcaagggtaaagagaaacattttaaaactttacttgggaaggaatggcaaatatttaagaccagatccaccctctacaatcaatgctagaaaaccatggagttagaacatcaaagtgctgaaggaaaaataatcgtgtcctataattctacgtataagtaaactatcaatcaagaaggagagtgcagtgaggacagtttcagaaacacaagatgatttacacccccaccctccaagccctgctctatattttatactntgataaaaaaagaaaagcccagaacaagatac

SEQ ID NO: 700480 - DNA, 456 bp, Homo sapiens
cgacggtaccaacaacattgaatcaatctcacaaatataatggatacccggtggctggggagagatccccaaacagcaatgggacctcaaccccagctgttgtccaggctcttgacactgtcgtgagaaggaatttaaggataagtcagaaaatagtgaaagcacagtgatttatggcaaagggaaaagtacacactcaagggaatgtgggcggactcaaaagtcacgtgtaagggggttggaggttgctacctctataggtttctttaaccagggactgggatattcatgaacattcctgggaaaaggtggagatttctgggaactgtggtgccacccatttttacatcaaaccggggtgttctgggaactgtcgagacacgggtgggtgtgtgttaaggatattaatgagtgtatatggaggtcctaggagaaacctgttcacatccagtgaca

SEQ ID NO: 700481 - DNA, 1270 bp, Homo sapiens
  misc_feature (686)..(686): n is a, c, g, or t
gggtggatgcgcgcatctttgtggtctgccccactgggggatggtttgtctcccatacgggggagatatgtcccgccctacatgagagatgcgccctgtctagagaagaatgttctgcgtattggggttgtgcagagcccccccttaatggagattttattgttaagtgtcccccccgcagactcgggggagagaatgtgtggtcggggtggtggtggggataagggggagcgccagccgccccgcgttcgacagtgtgtggcgaacacaataataagtgctcttatttttcgctcccccccccctctttttcgccacacagagatgatgattatatattataaccggcgctataatatattttttcgtggagtataggagcccttctttggagagttgttaatatgttttgtcacgcggagtaaaagaccgtatctacacggcccccctcctttgttgtgttttttatgacaacacggcgccccctgcttttattataacatctttttcgtctcgtcgtgtggagaaataaatgtgttgagaaagcaccaccttcgtgtggttgttcgcgcgagaaacatcatgcgcgtcgtgtatagtagtacacacccacacggcgtttagtaagacacttcgcatcatgggttctctgtgtttttgtcacaccacgcagcacatataaatgngtgcccgcacggcgctttgtttgtgtgtagacgcacacatgggtatattttctttctttgtgagagccacagagaaatattgtctctttgtgtgacaccacagagagcacacctctctcacacacactctccactacttgagagagagagagaagttctctcacagagaacacactactctccgccctgttgtctctcacacttgtttaatatataatatgtttatataaaagaacagagagatatctaagacaccacatatcttggacatcttattttctacacacaccgcctcgcgggagattgtaacattaacacctctcctctctgtatatatctctttctttccccgcgagagagagagaatatgaaacacccacacacaaggagatttgtgtttttcttttgaatgtcccacgttacacacccactcccagttcttgtttataattttgtaaaaaaatatacccccccctttatttttgtttgtggggaataataaaattatgttctctccacggaaaaaataataaatgaactgttaccagtttctttgtgcctttttaaaaggggttacccagata

SEQ ID NO: 700482 - DNA, 281 bp, Homo sapiens
attgagcagtactgtggcgaggaggaagttcacttagatggtggtgcgatgtgtgggagtcaggcaaaattggactgtgggggacaggcgaaaagtcagcaattcgtgatgatgcgtgagagcagtgaacaagtcctcagccgctggcccgtggatgaacttgaacccgatctgtgtgaatgggcccaagtttattgtgtgccagtgcattccaatatcccatggtgcctatttcataagttacttttagccaggcctcgtgtttaaattgtccgtcagga

SEQ ID NO: 700483 - DNA, 208 bp, Homo sapiens
ctctgaggatcttctgccgctactactacatgtgaaattcggaatgactgcattatcctgacgaagtgaaagaggcaggcatgagcaaggacagttaagaggggggagagcctcatcatgatggggagtcttgtctgacatctcgggaaaaactgtccacagtgtgaagtcatccacttgttgtcctggtttacagtttgagcatctg

SEQ ID NO: 700484 - DNA, 430 bp, Homo sapiens
cggtgactccgactatcatcgcgattcttgtgctgacacggagtcatccaaaaggcatgctgtggcgtcctaggcctttgcaactgactttcatgacaaagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtatgcatcacctgactataccttacttccgggacgaggagctgtcctgcaccgtggtggagctgaagtacacaggcaatgccagagcactcttcatcctccctgatcaagacaag

SEQ ID NO: 700485 - DNA, 836 bp, Homo sapiens
agtggagctgagccatagcgacttatttgtacaatactcacatagcccagcataccttctgtaagagatgtggcgttcagcagcttctatactccacgatcaaaccccggagtgctttggaattgtcccccactgcctggatgagggcactgtgcggagtatggtcactgatgaattcattggcggtgattgggagaaggccatgaaagagcacaagaccatcactaacatgtctatagagtgagcttctgcctcttctgccctgaaaaggaggaatgattgaggcctgtatctttgctcttcctgccgtgcctctgaggcgctcctgaatgtatgctgacctgggctgctggttccttggactaaggtcatcttgatctctgcagattgctccagctaccagtttatttaggcagctctttgtactccctctgccaagattatgatgtagtgctaattgacatccttctctatacaacttttgtgtgatcttttaagaaaaaaatatatatttttaacgtttctgaagacccacaaaatatgcaagacattctgtaatttatacacctgagttgcaaagagttaactggacttctttcaaagcttctaaataattataccgtatatatattaccaaaaaaatctctacactggcctttgttggccataatagggagattactgcaatcagtttcgcttgacgggagggcgaatacatgatctgagttcatagaaaaactacacaccccttctaaagctatcagaacaactgtattctgtagcctaaaggatgtaatactgtccactccataatcttgcggataaccccagaagat

SEQ ID NO: 700486 - DNA, 1049 bp, Homo sapiens
gaatgaacaagaactattagccatcagtgcattgcggagagtgtctgtgagctaagagccagatagaccagagcagcgactgatggcagctaggctgtgagcttcacccgaacagtatgtccgcatgctagctgactgggcctgtgaaaccgcgtacgagactggctgcggtacgacaggcagcctatgcccatcgtggtgacacgctgctggacagaaggggctgggtcggggcaggactgtggccccagcaagcgtatcctgggatctctcttgtcttgactccctgtttcttgaagtgaaagagctcttcctggcagctgtgcggctggaccctacctccattgacgcctgatgtgcagtgtggcgtatgggagtccgttttcaacctgagtggggagtatgacaaggccgtggactgcttcacagctgccctcagcgtacgtcccaatgactattagctgtggacatagagctaggcgccacccgtggccaatggaaaccagagtgaagaagcagtagctgcgtaccgcggtgcctcgagctccagcctggctatatccggtcccgctataacctgggcatcagctgcatcaaccgtcggggctcaccgggagggtgtggagcactttcgtggaggccctgaaacatgcagaggaaaagccgggcccccggggtgaaggcaggtgccacgtcgggagaaccatctggaggacctgggttggggattgtctatggtaaggccgagcgaagctatgggggagcggaagcgccgggaacatgaccacaccgtctaagaatgttgtggctgggccacagaaagtgcgcagggccgtcccgggaagggcacccgtgagacgaaccccgcgagggcagcgagtaccgcgcccccaagggggcacccaagggggggcgaagaaccaaagggacggagtcaagacaaggccaaagaggacggaaaagagcagtacacacatccgagaagaaggcgcatacacacgagcagcagacacacacaaacgacacatcataggagaggacccacgaac

SEQ ID NO: 700487 - DNA, 862 bp, Homo sapiens
agcggcggtaccggttgctagccgccgctggcgggcggcgagtctggagagagcgcgcagtttgcgcggcggctcgggcgacttccctgtacgtcgcactttgtggtatgctgcagctcggtggtgcctggggctagcccctagacaccccttacttgggcgattgtgtgcatgtttcaagtggcgcctccataccagccgaccgactggccgctaaccacgggtacctccgcaataccataggcacgactacggcgaccagtacaccaatcaggaacaaagacagagagcggagcgatggacgggcacccgccgaccagcaaccccaagacaagcacgaaccaagaaaaacggggcagggacagacacgggacaacggaccggcgaacctggcaaaaaggaaagaaagcatcacggaacagaaagcaagacagacacgaaagcataaaacatcagatcacggagaccacaagcacaacaacagacaaaaagtcgttgcaacgggaggacaggccaaacggaccatgcacgaaaaagcgacgccacagaggagtgccaccaaatagagattgcgcaagaacaagcacagggaggaaaaggacagaataagcaaaaagccagcatgactaatggaaacgcgcatgcaacgagaaaccgcgacagcaagagggaaagaaacagaagagtggaagattgcacaccgacccccgacaccgacacaacacacataggagacagagacacacatcgatagcacgccgataacacagcgacaaggcaatcaacccaggcaaggaacgaaaagaagacgccggaggaaccagtgcgagaagggaggagccacaaaaggaaaaacaaaaca

SEQ ID NO: 700488 - DNA, 192 bp, Homo sapiens
gggagtatgtggctctttgcgagatcaaccaacttaatctggttgaccgtgctgtacttaatctggcactcagcccctctggtaaacatcttttaattagcatctcagaaatgcaatgtgttaaggtaaagtgcgctagttcacgtggaaatctgctcaatgacatgagtcctctctgcgtttggggtaccg

SEQ ID NO: 700489 - DNA, 291 bp, Homo sapiens
ttttttttccccgctctttttgtttttgggggggggggccggcccctgtcgcccccacctttttgttttcccccaagagggggggtggtcctttgtgagccctccttaacccgaagtgaaaaggtttaaaaaatttttcccgttagaatagggggcctcttttttcccccccctttaaaaaccaaacccctctgggttttgggatggcttatactaatttcccttgttttccccgcgggggggcttttagaccccccctttaaaagccaaataaacttgggttccctttta

SEQ ID NO: 700490 - DNA, 102 bp, Homo sapiens
atccgtactgcatcaacgcctcgcggacgctacgccgcgacgataggagggcgctgcggcggtccacccgggccgcggcgttggatgcagtcgggtaccgag

SEQ ID NO: 700491 - DNA, 510 bp, Homo sapiens
  misc_feature (250)..(250): n is a, c, g, or t
ctgggaaccacaagtcaaagatgctgggaaatgccatcaatccagaagagaaatgcagccgcgtgatgcctcactcaccagaagggattgcagggtgaccctgtctgattaccagcctcgacttaggaaatacagccaatgatgaaattcatggcaggcaaattccctgttcaaggtggagcaacagcatgatggatgggccagcagtgatggatagcccctctgaattttggttcatgggtttcctccngcaaggactgagttgtcccagagataacactctaccagcggctgggctctgggctgaatgcttgcttagggataacaccctcattacccagtaaagcaaattattattgacaatgtaaggttttagttcctttcggtaatttttaaattaagcagacagcctggcatatggatcaagattccttgaactctaaaagattctctcttccaaagtattagtgaaacatagaattaaagtaaaatgaaagatttatatatagg

SEQ ID NO: 700492 - DNA, 816 bp, Homo sapiens
  misc_feature (21)..(21): n is a, c, g, or t
  misc_feature (77)..(77): n is a, c, g, or t
  misc_feature (103)..(103): n is a, c, g, or t
  misc_feature (130)..(130): n is a, c, g, or t
  misc_feature (159)..(159): n is a, c, g, or t
  misc_feature (218)..(218): n is a, c, g, or t
  misc_feature (228)..(228): n is a, c, g, or t
  misc_feature (290)..(290): n is a, c, g, or t
  misc_feature (393)..(393): n is a, c, g, or t
  misc_feature (437)..(437): n is a, c, g, or t
  misc_feature (473)..(473): n is a, c, g, or t
  misc_feature (479)..(479): n is a, c, g, or t
  misc_feature (495)..(495): n is a, c, g, or t
  misc_feature (503)..(503): n is a, c, g, or t
  misc_feature (535)..(535): n is a, c, g, or t
  misc_feature (583)..(583): n is a, c, g, or t
  misc_feature (632)..(632): n is a, c, g, or t
  misc_feature (650)..(650): n is a, c, g, or t
  misc_feature (656)..(656): n is a, c, g, or t
  misc_feature (664)..(664): n is a, c, g, or t
  misc_feature (668)..(668): n is a, c, g, or t
  misc_feature (674)..(674): n is a, c, g, or t
  misc_feature (697)..(697): n is a, c, g, or t
  misc_feature (703)..(703): n is a, c, g, or t
  misc_feature (738)..(738): n is a, c, g, or t
  misc_feature (814)..(814): n is a, c, g, or t
tttggttaacagataacctcncagacgaatcaacagtatagaattatagcagccaaactggttttaggtgtcgtttncaaacataaaagccaggcagccaagntctccaagtcgtgtcacgtggtaagcngagggccttgcaccaagtcagtctatctntctacatcactaggcacacacctctaccactaaggaacattatggtaaatctgaatgtnctagataaanatcaggagtccccatcaatggttagtcagtggttaagtcagttaaatcaaagaaattcagtnttaagtatacatgccgattcttggaaatcaattctaacattagtggttagggagaaagaaaaggaagacattcacctcacaaaacacagagtgtgacacagcnattaaatacatacgttaaaagtacttcatacaaaaacacatcanagtcttttaaaaattaaattctcaggcacaggtacngtcaanatgtggatggcacccncccaaggnttgacaacacacagccggatcatgcatctggnatgttttcttttttatccaggaaagtgttttctctgactccttgacangtgcacatcaccttacacgtggtgcccgagagcgccgccatcgccatcnccgccctgcatctgcatntgcatntgcgcctncatncttgcnatcatctcttgcatgcggcggantcagcntctttttccagccagatctggtctttattcatgtnctcattctccactttcctgccgcctctcttgagttttttagaacggaagttttcataatgaaggtcctgggtcacncc

SEQ ID NO: 700493 - DNA, 220 bp, Homo sapiens
agacctacttaggtgtataataggacgtatgtgcctgcgtacaggcgtactggctggtttgctcatcggcgtgatgctctgccaacgtggggataaatagataggtttcgaagaagatatacaatatgattcgttctgtggctgtgcaatgtcatcacattcagcgagcatttgtcagggagcattagtatccagaggtagagttctactcgtgatagtg

SEQ ID NO: 700494 - DNA, 117 bp, Homo sapiens
gtccgcaccagtgcgcacttctgtgttgagaagctacgaacttcctccctgtagtaaaagtgaaccccctggggggtgcagtggccttagggcacccactgggctgcactggtggca

SEQ ID NO: 700495 - DNA, 141 bp, Homo sapiens
tggagttccgtggagggtcgactgctagaggactccccgaatctatgttggcgcgtatcgttggtctgcatggttcttcatgatagaagctcctcaccaggaagtcctcacgagccagatgtgctcggagtaccaggttca

SEQ ID NO: 700496 - DNA, 770 bp, Homo sapiens
cactggcccccgcccagtgggtgcccccccggcgaacaaggtgcgcgccgacacgctcgaaggaagtcccgacccaaaacacaggtgtgccacagcaagaatttcgacccgaattcatggctgtgtggagcgccaacaacaggccccccccccccccagttccccgccccccccccggcgcgcgcccccggaaaattggagtccgccaccaccagggccacaacacccgtttgcacaaacgagccccgcgcgggtcccatcgacgccgcctctcttcccggcggaagttgccgacacggttttcgggcgtaagagaaaactaagcgaagagcgagactctcatttcgcgcctcggtgcatggggaaaactcgtgcgaagaattcccttcgggtgttatgcttaaaagcagaactgactgattatggtgaaaaccagccattccatagttgacacaagaacatgattttacccaccttctattgcgggcgcacacacgtcttcttcgcaatatccgcggcgcctccgcggagcgggatatttttatttgtccgccccaggcgatgggatttcaaaggtgcgctccccacgaaaccgattctctggaacaacatacactgcaccacggccaagctcgtcacaccgacggcttgtgaagccccgccttagattaaaagtgtctgttggtgtcaaaatatggtctgtcctaggaccgcttgccagctgtaccacaagagaccctggagttgtggagccccgcccacatagccaa

SEQ ID NO: 700497 - DNA, 131 bp, Homo sapiens
tgcggtgtcactgcgatcttcttttggtcttcctggaatgacaggttcctccctgccacctgtgaggagagttggggcccagccgtcttcctggcctccttcctttcctcagtggcagaggccatgcgtgg

SEQ ID NO: 700498 - DNA, 163 bp, Homo sapiens
tagaggatctgtgcaaggtctctacctagaaaaccaatcagaaaaatcttccctgggggaaccccaggcatcaaaaccagtatattccaatttgcttcgtgctatactcaccaagtggccaaagggttcggtaatgccatctcaggcaccaattctccttccc

SEQ ID NO: 700499 - DNA, 612 bp, Homo sapiens
cgcgctaaggctgcttgtgaatctatgctcgcacatgagctcaggatcgttcttcagtgctcagtgacaggagcaccatcctgagcattgacatcagcagtcaagttctctaaaagctgcattatgcccaggtagccatggataaaggcttaagtgtacacacgtgtggcctggaagatcttaaatgactcaagtagtctgatcatctgaattttaagaacctgcagtctgggttcgtaatgacctttatataggcatccaataggcactctgcccgcattgtttctcatccttccatatgttatcagtttaagctcctgcgtggactctttaagttggcccacatgccccttctctgtgtcacctgccctacgagggggtagggcagggcatttagccatacattccgttgtagttggtagcgttcagcatgaagtggaggtgcggggtggtgcagtcctgagtcaggactctttcgctgcctagtcagccctgctcacaggcaaggtgcagcttggtatttcctcatcagtcctggagctcaggattacagtcagctctcacaagtgcagcagcaatttctgcatggtcggtgatcacagcccagtggag

SEQ ID NO: 700500 - DNA, 404 bp, Homo sapiens
  misc_feature (81)..(81): n is a, c, g, or t
gggtcaccccctttgggtggtttttttttacgggggggatttcccccccccccccccaacacagggggggggtttcccttnacccgggggggttttggggccccccaccccccaaattttggggtcttttttttggggggccggaatttttttttaattttttccctttgggcccccccccccccaaatattggggggggggcccccggggccccccggggaaagaggagggggcccaggtgcccttttcccggggggggttttccccccccccccccgggggggggggtttttttggggggcccccccctttttccctgggcccccccccccttgggggtttttttgttcccggggccccccccccccgggttttttttttttttttttttggggggggggca

SEQ ID NO: 700501 - DNA, 296 bp, Homo sapiens
  misc_feature (8)..(8): n is a, c, g, or t
tagtgtantcgatgggcctcggcataactggcgcgttcgtcgccgaacaggttgcgaaaaggtgtgagccagtgactgttggcgatcaggcgatcccagtagtaatggccgacttcatggcgaaaatggccaagcacggtccggtatggctcgcgcatctgtacacggactttttcgcggtgggcgtcgtcggcttccttgatgtccagggtgatcagccccttggcgtgtccggtggtgggcgcgtagccttccaggtcgataaccgatgaagtcgaaggccaggacagactcta

SEQ ID NO: 700502 - DNA, 985 bp, Homo sapiens
ccctcatcactcgaaagggtacattatgggtgaatcatccgcgtaccttcacaagccaactgcttgcttggcacatagtcttttatctcgcctgctacctacacaatcgagggaggcctatagtactggatcattattctcttgactcaaggaaaccttgcaatagatctggctattgtcgcttcggggtttgcaaacttatcagcaaatagccttcgtacaggcataggtacatctgcgtgagagccctagtatccattcgtggagagggccaaagtgattttacaaaacttagtatggggcctatctcatattacttgggggtaaagcatggtgatttccaaaccgcaatctgagggaggctgatcaagccaggaaagtgtacgaacctcgtgcagattcgtttaacgtccagattagtcaagcgcgtaccaataaatgtggaccctagcagcaatgtgacagctcgctagtacgttgccccgtaggcggtgtctgacaacccccctaggaattgcctgcccattccgattaagaatcttgcttcctaccctttacaataaatgcacaaaagggcatgggttaaacttcaatgttcccttccggctccttaatgaccttaatactattattagaagagctgcattaggagatcgagagattatagcatagtcgatccccatgatggacccatgcaccggtgaggccgaatggtgttacgtatagacttcacaaatcacgatcgaccttagaaagattgagggtcttacctatgatatcagcttataataaataatccgagcactaattcaaagacaagctgttagaccgggggccataatatgtagctacgaagcgacatttaagaaggagagaatgaaacttacatgcaatgacgatatagacatgtatcatcgctagcaatgggcgagagaaactgggcggacaacgggggagtgtagaagcaacacgtaatggaaagaaa

SEQ ID NO: 700503 - DNA, 1047 bp, Homo sapiens
gcatctctcaggaataaaacgaaatgtgacttttccaggaacatagtttgagtatcaatatatagatgtagaaccaacagatttgatatttgattgtaccttttggctggttgaaagtttcttgatggaattctattcatacaatggtctcgacgggccctggagtagatcatgcttgtcacccgtctatgcactaccgtgcccttatcttgtgcattatagctccagacacataggataacagatattctgcagccgtcagcacctttacatcgaagctgtctgcatcggtttgctcttaggtcacaactcatactgtcacatcttcgaaatgatcgttcctgatgccttctctaaaaggcacccctttcctgacatcagtgacaatattgcttacatttggtgtaaaattgtcgcacaccatttctttaaaatctattactattaaggtccctagggcacgatgtgtgcccagatggtgcgcaacttaggttaacaatagtgttagtaccgatggtgccaaaatgcttaggatgtcgtctgagaccccaattttaacttccgatatatatgagcagttagaggtactatttatcccataaaggctttgacccatcgccataatgactcgcgaaacgcacccaaatgaagaagagacgcaagaggaatgacacaatagtgacccccattaccaggcaacaggggcgaacaacggcaacacacggtagttacaacgcaagggatcagcccaaacaggtaaggggtcagaccacaggtatcaaacgctccggggccccataccagacacgggaaaaagaaaaagcacacactccgcggtatcacaacgacgaggagcatgcaaaaccgctcaacacagttggaccacctacgcgacagaaagcaccacgagcaacacagagcgacctaccactcagccacctcaaccacgctaactgacagacaaacaccacggcactgtgaacaccgaacagacgactcgaacaccaaccggacagccaaacacagaacaaacccacaagaaaccaa

SEQ ID NO: 700504 - DNA, 105 bp, Homo sapiens
gagctggtcccccacctgggcatgagccagctgacccgctggctgagctggactataagaacgagatcatcatctatacccacatctggcgacaactggatgtgt

SEQ ID NO: 700505 - DNA, 413 bp, Homo sapiens
aaggttggtggaaatctttagatggttattaagaaacaaagaataaactggaaactgttggtgttaaaacaaagatcttagtgttttttttttttggagatagggctctcaaaacaaccaaacaaccaaacttaaccggtcagtaggtaatataatcaatccacatgccaaaggcaggggctcacacctgtaatcccagctactcgggaggctgaggtgaaggtggcagagagccaagatggtgccacggtactccagcgcggccgacagagcgagaccctgccacaaaacaaacaaccaacaaaacaaaacaaaaaccaaaacaaaccaaaaaagctagccgaactcagacgcaggagtgcccctcccggggatacgggggtcacgagctcagaatcgaaatcagggccata

SEQ ID NO: 700506 - DNA, 379 bp, Homo sapiens
aagtccctttttaggtcctttagggatacatatcccggagcagaactactagatcacatatggtaaggtttgaatgtcccccccccaaattggtatgttgaagccccccccaacgtgataggtgaggctttaggaggtgattatgtccttagagctccatcctccttaatggatttaggccccttattaagggggtcaagggaacccattccctcccttttgcccttggattcccttcccccatatgagggcccagcaccaggccccgtcctaaaagctgagattgggccccccatagatgataccagtttgccagcacgctgatcgtgggcttttcagttttcccaactataaaaaataaattcggccttttaaatta

SEQ ID NO: 700507 - DNA, 83 bp, Homo sapiens
cagctcccgcgacgcctctcctgcccctcgccggtacctcagcaaggtgcgttgccgccaggtgccactagaagcgccaggct

SEQ ID NO: 700508 - DNA, 155 bp, Homo sapiens
ccagctaagctcagaacaactaactcatgtggactcggaaagacgggcagctgtggtagatgtagagacaggaagccagagacagagcgggatagatgtggctacagacgatgagtctcctgggaccggtagccttcaagctagtccaaaggcag

SEQ ID NO: 700509 - DNA, 123 bp, Homo sapiens
agggcctcagaactcacaaagactccccagtgctgttcctcttccaacgaggctggactccttccagccatctgcgaactcaagcaggacgcaaggttccttaggacaggttcctggcatgcc

SEQ ID NO: 700510 - DNA, 133 bp, Homo sapiens
atcggcacttcagctattcatcaggacctcgctataacatcggcccatcgctatacatcggcacctcgctattcatcggccgtattgaattcaacacaccacaatactatgacctggtgccgatgaatagcga

SEQ ID NO: 700511 - DNA, 241 bp, Homo sapiens
gattcaccagcattcccttaccagatcaaaccgtggtgttagagctattgaggtgacggaggctcttgcagaagaagccagtcctcaaacaaactgatattgcaaaaacctttagtatctgctttgaggggcaggctatgcaagtggggagtatgaggtagaagtggtgttgtacttgtgattgggtagtgtatggtgaaggttgagggacctgaactgctaggtgggggtccggctgtct

SEQ ID NO: 700512 - DNA, 426 bp, Homo sapiens
tggaatcatcatctgtgtcactgaccatgctccgagctaaacgcgacttggtgtacaccgccatcttcgttgaagctgtggcggccatggacaggctactggtagtcagagcacagatgaccgtgtgctggagggcgtcatcaagggcagatcatcgcggacaccacctgtaggacctcgtcccatccacgctgcccccagagcttgggctgccctcctgctggacactcaggacagcttggttatattataagagagtggggtaagcacccctacctgccttacagagcagaccaggtacccaggcccgtgtgcagacaaggcccctggggtaaaaagtagccctgaaggtggctaccatgagctcttcacctggcggggactggcaggcttcaaaacgtgtgaatttcaaaagtttttccttaa

SEQ ID NO: 700513 - DNA, 1749 bp, Homo sapiens
  misc_feature (33)..(33): n is a, c, g, or t
  misc_feature (97)..(97): n is a, c, g, or t
  misc_feature (143)..(143): n is a, c, g, or t
  misc_feature (152)..(152): n is a, c, g, or t
  misc_feature (193)..(193): n is a, c, g, or t
  misc_feature (238)..(238): n is a, c, g, or t
  misc_feature (284)..(284): n is a, c, g, or t
  misc_feature (293)..(293): n is a, c, g, or t
  misc_feature (384)..(384): n is a, c, g, or t
  misc_feature (460)..(460): n is a, c, g, or t
  misc_feature (1157)..(1157): n is a, c, g, or t
cgatggactccgtcactagcctagtctaggctntatggctcattagtgtcgccgctcgcgcgtcatcatatcgatgtctggttagtgtcagtagctntctacttttagtgggtggagctacagtacagtaggcgctgattcgnccgccctgnttcgtggttgagtatacgctcccactcgttggtagtcgatntgcctgggtcgtccggatcgatgatgatgaactgtgcgcggtgtntttgttgctcacgccaccagcattgagcgtgtgtatagtgtgctcncctcacctnaagtgagtataccgtgtggtatgtatgctgtcgcgttcggtctctaccagcctgtgcgtgtgcatacctacttcatcacggaggcgtgagnacacgactctttataattgtgcggcgccacgcctgttgatgggcgcgtccctttgatatgatgggacgtggcgtanccacgcaggctcgttttgttgctgtcgccgcagtgtatgttcccccccgtcggtgtgtttgggtgtccaccacatggggtgtgccaccagagcccccaccttgtgttgtgcgcccgacccaaggtgccccccaggaaccactgatgttcccgcgagtatgccaaaatgactctctttgggggagggcctcttgtttttgacgagccacagatgtgtgtgcggacccgccccaggaaggtgttcgtgtgtattggggcggttagattgttttcgcccaacactcctggggcggcaacacatgtgttgcttggtgtggtgcttgatggtgcccgaccaacgccacccccccacagggaaaaaaggtgttttgtggccccctggattgtgtttggtggtggggagcgttgtttgtcccccccacagtggccgccaccactattacgcgttctcacctggctgttgttgtgtggcaacacaacaggggcggacactctccctctgggggagagatttataatactgaatagtgcgatttttgatcctgctctcgtcgcaactagaatagccgcccctcgtggccactgctcttctacaaaggagcgttttctttggtgacgattcaccaattttggtgggacaaccactgggggcgctccttctgtaataagtgtgtgtccgccctcctcttttgtttttntgtcctccacacaatacacaaagacacagctggtttgctcatcagagaatagagaagaggtacatcagaggggagggagggtacaccccgttcacgccacagaagagagcgataaagagtggtgtgtcattttctttgtgggtgtgttaatgagactattctgtgacacacccctcttagtaatatagacactcacaagagtctcttaaaatatttctcgttgtcatagaataagagagagctttagaggagatttagaatatattgcgatatactctatctacatataatatctcagcccactgttacacattatagtgaccccaggctcatcttcattacattaacacttctacctgaccatttatttccactttagatccctttatctatccctttaacaccaattttgtgacaaaacacaaatttaatttccattttacacaccaaagggaaatccgggccattggtggctctatagccctgtatatttccacgccactttgggaggctgtaggcagaaggattacctgaggacaaagagtttgagacccgctttgcccacatagttagaccccccttttcttttata

SEQ ID NO: 700514 - DNA, 411 bp, Homo sapiens
cagttaataaattattggtaacatcaaaaaagaatgctttagggatacatatttccctcatggaacgttttctatgatgggaaaatgtttgcaagcacagactcttttaaaagtggttccctctaggcggaggtatagaatttaaagtctatgtgtgtctgtataccagcaagtgatgtcaaaaataactgtttaaagatactgctttgggctgggtgcagtggcttacgctaataatcctagcactttggcaggccgaggctggtggatcacctgaggtcaggagtttgagaccagcctgaccaacatggcgaaaccctatctctaccgaaatacaataaaatttagcccggcatggtggcgcatgcctgcaatcccagctacttaggaggctgatggaggagaatggct

SEQ ID NO: 700515 - DNA, 359 bp, Homo sapiens
actatctctgacactgttaactttacgattttttttcttctgtacccaaaaaaaagtttgtttcaatagtgaactatgagccagggtggtggcttatgcctataatcccagcactttgggaggccaaggcgggcagatcacctgaggttaggagttcaagatcagtctggccaacatagtgaaaccctgtctctactaaaaatacaaaaattagccagatgtggtggtgggcacctgtaatcccagctatttgggaggctgaggcagcagaattgcttgaacacaggaggcggtggttgcagtgagctgagattgcgccactgcactccagcctgggcaacagagcaagactccatctc

SEQ ID NO: 700516 - DNA, 382 bp, Homo sapiens
aatcaccaacttcttaccattgactcacttataaccgtttccagatttatggaggatgaagacctatcgtaccaatgtggcagttgaaaagtgaattgcaacacaatgagatatattcacattaggagaggagcagtacctgtgcattcagaactggaactgcaggtgtaccattactgttgatagaggcatctcctgccgcggtccaacccagcctgagctgccagcctgcctagcttctgcaaagccccgagttgtcatggcaaccacttcctgagacttgatactcatgcctgcagactctgggtcctgacttaaatagttttattttttttaaaaaggcataaattgatagtgcaataaaatctggtttaaagattga

SEQ ID NO: 700517 - DNA, 102 bp, Homo sapiens
ttaatcgtgctggtgcttgtagccatggagtacgaagccactgcggcataggcactcataactgccgaacgtgttgacgcagtcctgctggcagccgccgtt

SEQ ID NO: 700518 - DNA, 425 bp, Homo sapiens
aggatccccggcgccatggggtctgtaatctcagctacttgggaggctgaggcagtttatttgcttgaacccaggagatggagtttgcagtgagctgacatgatgccactgcactcctacctgggcgacagagtgaagctcagtctcaaaaaaaaaaaaaaagggggggtttaattttaaaaaaaaatggccttaaaaaaaaccgggttcgcaaccagaaccgggtttacttttaaaaatgaaggttgggggaaaaaaggcaaaaaaaattttttggcccagtgtgttttatttccaaaaaagagggaaaaatttttttttcctttttaaaaaaccctgttttttttgcccctttttcccaaaatttaaaggaaaattaaaggtattgggggggcaggcccaggaggaaccttttattttttaaa

SEQ ID NO: 700519 - DNA, 664 bp, Homo sapiens
  misc_feature (664)..(664): n is a, c, g, or t
gtccaacaaaaggtccaacagaaatctgtgagttaaagaaagactatttttactttgctataggaccccatcatttaaaaaaaggacctggtaatatgaagaaccttccctgtaattgtctgtgaccttgttatctgagaccggcattcacgataggagtctagatatttacctgatactaatcaagagatatatgatatccggatctaaaaggtagatagttatatttaatgacctcagtcctaagttcctttttcgctaatggagctttcatttctgatattgctgtttgaataatatgattaaatagaaggattgtgccagtagacattatgttactaaaacagcactttaaaaacgttggttctctaattcatatgaaaatgatgggtgctctaagttctttgagctcttctagtgtgagtgcgagtcaaacttgtgtgtgagacagaacagagcaactgtgcagggaaatgaaagaagaacatttggtggtgagtatgacgtgaaacccaaaggattaattgttactgtccaacaccgtggagcaggttgggcaccaaaaagggaattactatttattggtctaaggaaggataaaaaaagacaggggaaagggggaaactttgttttaaaaacgaaacctggttccacttgcgtgtcn

SEQ ID NO: 700520 - DNA, 911 bp, Homo sapiens
  misc_feature (608)..(608): n is a, c, g, or t
  misc_feature (653)..(653): n is a, c, g, or t
  misc_feature (752)..(752): n is a, c, g, or t
  misc_feature (825)..(825): n is a, c, g, or t
agttaaaataatgtttccctttgaaatgtttaattagctctgttttattacaaaaacattcttgatgtggagcacagtgttgagctcgaagactctgatgagttaaatggtgtaaagtgttctcacgccctatgtggagcagaacctgaccaggagtggctgttgtcagcagatgtctggaccactggggaaaccatgatgcttgctccaagcagcaggccatcatttcaacctttgttgcttccaccaaacctcccattgtgctttcaatttaacagcatcacaagcagacaaagaaatttcttacaatttgcccttcagttcagagacgaatcctatttaaacttgtctaacctctcataacatattagttattgttgccagcctgcgtgtgtcctctggcaatgagctactcattctgggagaaggagggggtgcccttcagtttgataaagcaagaccagatttactggcacacttacaggaggcttgtctcaagactgcagcaaatttaattaaccttattacaaatatgggtttcttgatgattacatcacaatttggtattactttgcctactgctgtttcaaagtaatatgtgctttctnaaatagttttctagaaaacgccaggatattggaagtagtaaactnatcctagccatgacctaccctatctatgtcctgttctcacacatacataggttatcaacatcttctttcctgcatcctatgaccttacctctgttcttncacactccactgaaataatggcagaggtaactttacattagaactaaagtgattctgggacagtaaacatacntcaacactctgctgtggaaatcgatgccagactaattgctgccctaaattcttaccaaagagatgatcctgatctgtgaaaagtac

SEQ ID NO: 700521 - DNA, 849 bp, Homo sapiens
atgtcccccctggcgcacccgtcatatactctatcatcttcgcgggttcactcgttaaaaagtctacccgtcactcggttctttggaccgtgggtagggccgtagctggtaatggtgcatagcggtaaaggtccatattctctcgcgacgacttaagcctgtcgcttccacagatagtccgtgcactcacatgctattccgtccatgcagagcggagcggtagtccagtagatcctacattgttagccataattctctcacactgactactagctctccgggacaatggatgcaaggagaccaaattattaccctatattcacagacgtcgatcactaatagaatattcattaatttggctatgaggctatagtacaaacatcgtatgggacaatatgcgccacctgtattcaacatatccttggacgctaacccaagaaggctttaaccgcgaatgggtactcggacatcttgatcagtcctggctctagttgcttgactgcatcattggattaaagttacttacgtcccctcattcaatcaagtcagtatacctaaaatatttcttacctcatatcttaggctctgttactgccgttgcgtcactcacttcatgcaacaatctggatgcctcaataggtctgcgcaaggagtcggtgtcattaaatccaacactaaggctgaagcttccaacctattgcatttttccttcaattacccatcgtgagtgactggaatagctaggcatgtactgtcctgtaaaatcccttacgataactatgctgtagttttacttggtatctttatcctattctagctaccggttgcgttttagggcatttttagttc

SEQ ID NO: 700522 - DNA, 501 bp, Homo sapiens
tattcatggcagtcttctaatactactgcctatcctcataacatcagtcatcctttacctcatcctaatcatatcacccatttagctcgggtctacctagtgcgacctctagagacgacatgacatgtctgccagtatgtactagtacagtcagcgccacataatcatacaaagaccccgcaccaataggatcctgccgaatcaagcctgacccctctccttcataaattattcagcttcctacactattaaagtttagcacaaacaccaccccatcatactctttcacccacagcaccaatcctacctgggttaggtctacctgccaggtagacctaactagacctaacccatgtagacctccaggtagacctaactagaagtgtgaaaacgtaggctcggattaaggcgacagaaatttctaggatagtcagtagaattagaattgtgaagatgataagtgtagagggaaggtaaatggttgatattgctaaggtggcg

SEQ ID NO: 700523 - DNA, 209 bp, Homo sapiens
aatccttaaagcttctagcagaagaaagtcttcccacaaccccattttatttcatattgggaaacacaggcaacagcaggatgaaaactaacgaactttagagaatgagctggtacaactacccttacagaaacatacccgcaattagtaggtagtaattattgaaaccatgtgaacagattaatgcacttaagcacctaaggttaggg

SEQ ID NO: 700524 - DNA, 233 bp, Homo sapiens
ctgctgcaatagagcgagcatcctcattctcctcctcattgtgcagttgctcagatgtatgcatccggctttcggatcagagggtccaccagcatacaggaaggacatgtagagcaacagggcacccaacacggacaggtagatgaccatgatgaacttgatggtggtggtgctgagctcctcgtacctgcactcgcacagcaggcaagataggcctccacgtcatggccagg

SEQ ID NO: 700525 - DNA, 321 bp, Homo sapiens
  misc_feature (48)..(48): n is a, c, g, or t
  misc_feature (50)..(50): n is a, c, g, or t
tgcggcggcagtggctcacgctatccagcactttgggaggcgaggcangngcggatcacgagatcaggagtttgagaccagcctgaccaacatgttgaaaccctgtctctactaaaaatacaaaaatttgccgggcgtggcagtgcgcacctgtaatcccagctacttaggaggctgagacaggagaatcggtcgaacccggaaggtgggggttgcagtgagctgagatcgtgacgctgcactccagcctgggagacagaactagactccatctcaaaaaaaaagaaaaattcctgtcttgtgtatatctgtgtatggtcg

SEQ ID NO: 700526 - DNA, 702 bp, Homo sapiens
ctcgggtacccatcccccctcggcccacgcgcccacacgtcagctgtctccagcccccccgggacgaggaggagaccagccagtggcctggacctgcttcccctccccgggtgcctcctgcgtggatgcccctgtcccctcaatggctcgatggacacccagccccctggtaccaccatggcagcatcccctgctgccaccccgtgctctcaatgctcacctgggaagaccatgcccaccacccagagcatttgcctcatgaccccaagtacgccaccacacccaaggtgatccatggcccctgtgccctgctgggctggtccctgacaatcctgcccatctgtcctggggatgtgcaagaatgtgtcagcagcacccactagttacttgcttgcccagagctgaccatcctacctggatgcgctaccagacggcttccatgctgatgatgtgcccatgagcccccggaggcagccctaccacccccattgcactagagcgctactgcatagcttgccacatcaagcgaggagcgaggaggaacagggagcgacaacagaggaacgagagcagcgacaggggacgcgaacagggaccgagcgagaaaggacaggggaagagaaggacgagcggcgggaagagggcagcccgagacggaaagcgcagggacagagggcaagacaggaaagcggaaagcgagac

SEQ ID NO: 700527 - DNA, 783 bp, Homo sapiens
agcgggtttgaaaaccaggcggccgccttagccggtggtaagacagttgcatgcagaggaatcttgtaatacgagagcgacaacgactgtctggcatgaccggtcgggctcctggggttcagccgtggccgtcctcggtctacggactgacctaaggtggtggcttaatgacaggtgtatagcctgcatcgcccccctctgcgctgaagccgcgtggccagccggccaagacaacacaaatctcaggcgaccacgtatcataaagaggtctcttaacctgttaggttcatcacgagaagtcggaatggtgtctcacaagcacgcattacacttcaaggagagtccacgagcatactgaatgttacggcaacattcaccatataggatgaggatcgagtacaatgggcataattgttaagctaccgtgatcagctgccaccagtaaaggaatgtcagaaatcggctacatagacctactgtacgttaagtcagaaaattcagaatggatagagagctcgaaggacacacgtataccatggctgttacgatagctcgtcaatcaagcatgttgcaccaagagagttgactgaaagctcagggagagctgaagggacctgacccagtaaggtagagctgctggagaatgtttcagtggacaggctgtttggcaaatcttggatgcagcaagggccttgatccagcctttaggcctcgtgagaccctggcatcacgacaagaatccatctacgtgatcacatggactctatgttgctgtgagaaact

SEQ ID NO: 700528 - DNA, 165 bp, Homo sapiens
tagaattgtgggaatacgcataccctagattcttactactgatagaacattatctgcatatccaaaaaattttaagcaaaatgaaagctaccaatttacagttacggactctaccattttaaagttattgcttgtcacgctattaccacaacttctaaggttaag

SEQ ID NO: 700529 - DNA, 221 bp, Homo sapiens
ctgtcatgcagttgacactctatatttcaagtaacgcttcgggccgcggacactcagctacagcatgatgggcgcgagagcaaggcgggacggcggtggtcgccttggggacgcccgccgtcccagatcaactacgagctttttaactgcggcaactttaatatacgctattggagctggaattaccgcggctgctggcaccagtgttgcatggacaccaa

SEQ ID NO: 700530 - DNA, 212 bp, Homo sapiens
ccccccccttttttgaatggggggggcacccttttttttccccctgtgggtcccccggggcagggggggccacgaaaaaaggatattttaggctttggggggtgctagttggggttggggtttcccccctgggaaaaacccccctttgtttttcccctgtggactttttgggggcgggtttttttgttcccattaaatttttgtgggcccca

SEQ ID NO: 700531 - DNA, 193 bp, Homo sapiens
  misc_feature (16)..(16): n is a, c, g, or t
  misc_feature (58)..(58): n is a, c, g, or t
gggcaggtgtcaaaantgggcaccaggactggagccccctccggagaccaaaacttcncctcctcagtcctccccaacagggtactaggactgcagccccctgtagctcctctttgcttacccctcctgtggacaccttgcactttgcctggcccttcccagagcccaaaaagtaaaaatgttttggttttga

SEQ ID NO: 700532 - DNA, 474 bp, Homo sapiens
  misc_feature (226)..(226): n is a, c, g, or t
  misc_feature (236)..(236): n is a, c, g, or t
  misc_feature (239)..(239): n is a, c, g, or t
  misc_feature (245)..(245): n is a, c, g, or t
  misc_feature (359)..(360): n is a, c, g, or t
  misc_feature (380)..(380): n is a, c, g, or t
  misc_feature (460)..(460): n is a, c, g, or t
  misc_feature (468)..(468): n is a, c, g, or t
ccaggccatgcagaactccggcatcgtccttgagcgcgctgctggggaggagggtgccctggagccagctcctgctgccgggtccagtccccagcccctggcagtggcatgcccctgcatgcttgcctgtgtacttgtgaagttgcatgcctgctgtgagacacatggtggccagcgatggcctcagctggtgcccatggacccacccatgtcctcatgttgcagnttggaggaanccntttccngcttgacatgcatgcccaaccctgtgaagtgcccacaagacggggccacacctgggcctgaggcctgttctgccttgcgctgccagttgttggcaaatgggccctttccccccnnaagggcccccttaaaccccntttggcctttctcaaaagccaaaagcccaatccccaagcggcagggcttgccaacggttgccgttgaagcctggcctgcntttcccgnctttga

SEQ ID NO: 700533 - DNA, 1525 bp, Homo sapiens
agcggaggtcggggtgacctggcacgcgcaagcgctcggcggggagttcccgaccggtcaggacgcagagccgacggagctctcgagggctctggcgaaagggggtagggaagcggactccggcgaagagcagtcaggaacggtggacggggccgagagacgacgctgcggtagtctgaatggggccggggtcacagggagaggccaatgagggcagaagcactcttcagacggagacggggctgacggctgagcattcaaaaaggggcgtgaacttggagtatcggcatgaaaaaaaggtgggggcccagatggggagcacctcctcattcctccctgcccaactcagcgatcgtccgcgcctcccaggcggaaaaagcgtttcgcgggctttccaactgcccggctaagttcgcgatccccctccctccagccgtgactccgtcgctttttgtgcccgcccgccgggctgtgctgcagtgcgcttcgggtaggggcggtggcgccgcggcatgggtcgttacgaatgcggggcgcggtgggccaatcagaacgtttcatttccgggtggcggcgtggcgccgttttgtgaggagcgatataaacgggtgctgtagtgccgggtgcccgcccagttgttacttaggtgcgctagcctgcggagcccgtccgtgctgttctgcggcaaggcctttcccagtgtccccacgcgtaaggcaactgctgagaggcgcgcgtcgaccgccagagtgaggaagccggcgccagttcgcggggctccgggccgggctactcgagagctatgagctacggcgatccacctcccgatgtgtcaggggtatgacctctcgctcgaaggtggacaatctgacctatcgacctcgacacgacacgctgaggggcgtcttcgagaagttagggcgcgtcgaggagtgtacatcccgcgggagcgtacatccaaggcagttcccgcggcttcgccttcgttcgcttttcaacgatagagcgcgacgacgtggaggacgctaatggaatgccatggaacggggccgtgctggaacggcgcgagctcgcgggtgcacatggtgcgctaaggtcgcctgcgggactcacaccagagcgccgggtgacggcaccccgctggtaacgggggcggtggctacggacgccggagcgaagcctaagcaggcggtccctgcagccgaaccggagttgggagccgtcaaggctccccaccgattggccaagcggctcgaagtgcggtcacgaacaggcttgacctcgggaccccaaggtcacattccgcgaaggccagtccagctcgtggaccaatttgtacggcacagccggtcgcccaggcctccccatgttcggggacaaccggcggtagagagctccactctgagaaggggtttaaaaagtttcgcagtacagtggcgtacagacaacagtcctgtctagatgtatacatactaggaatactagatctgcagaatcttgtcttgttctgccggcttgacttctg

SEQ ID NO: 700534 - DNA, 983 bp, Homo sapiens
ggtcgtgccgcgccctttggtgcgcctgtaatccctctttcgtctcccgcccggcgtttttgggcgccgtttatagccacgcgcaatgttggggaggtctttaacagtgggggcaccctaacccgcgtgcccgaggccccaagttggcgtcccgagaccccgtatctgggctgcccgctcattttcgattgcacccgctttgcactttatgtatttgggcgccttcttgcatgtcggctattatagaggtcttgcatacggacgcgaactcttcggtggcttcctgcccgggttctctggggggttccggatcgcggggggcaacagccctcttggggatcacctcatcgcgagccctccctctcgacttctataaacaggagaggaagggcgcggtgtaatagggcccaataagaacgggggcggggacccttctattagcttgctcccaccggcgctggagttcgcattgtgctcgtgcaagcaaagggacagccaacgcacgtcatgtggttgaaaggcgcctccctcctcctttatctctattgtgttagtagacatggactccacagtcatcgttaaggatttaactgttgcttcctctttcctatgtaatcattattgtagcgcagcgcgccccctctgtacgccaaggcggcatgtatgcccaccggcagcgtcgcgcaagcagtgtgcaaggacggactccctgtaaaaagcgcactctttctgtcatcgcggctttttggggggccctacgtagacgttttctacgcctgccatgattattgttgcagacaagttagcaacaaaaggtgggtcgattatttcagataaatacgtcgggaagacaaacctcctatcttcagtccagggccggtcatacaatgaggccacaggagaccccccgcgagtgaatcaggatataactttcatgtcgtttttgtttttaaagaaatgcgtttgaagttcaaacatgtaca

SEQ ID NO: 700535 - DNA, 391 bp, Homo sapiens
cagggctgttgtctgaaaaagaatgcatttctctttcattttttaagaatatttccaacaggtacaacattctagatgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcaccatgggaggccgaggcaggtggatcacggggtcaggagatggagaccatcctggctacggtgaaaccccatctctactaaaaatacaaaaaattagctgggcgtggtggtgcatgcctgtaatcccagccactgggtaccgagctcg

SEQ ID NO: 700536 - DNA, 426 bp, Homo sapiens
agcatactcttcggactcattgtgccccttacggctgcaagtatacgcattgtgccacacgcgcaccctctgctttgatccctatggaggccgtgatgcgacccagggaggagatcggctacctgacctgcattgactcgtaacacagagcactgaggccccagattatctgaccactgcggatgctgactccaaggctgcacagcattgccagtgcattgagctcactgacatctatgccaagtgcgaacatgcgcttgtccagactagccagtgcctgacctgcgattactggatgatgagatacgtgccagatgataagggcattggcagaggagacagtgtgctagtgtatgggacgacctgcgatgagactgctacatgcaagagatctgcccgtgttgcactgctagcctatgactctgt

SEQ ID NO: 700537 - DNA, 125 bp, Homo sapiens
gtgctccctcgacagtgactactttaaataccccctcatggcactaggtgagctctgtgaaaccaagtttgggaagacacaccctgtgtgcaatttggttgcttctttgcggttgtggttgccga

SEQ ID NO: 700538 - DNA, 132 bp, Homo sapiens
aggttgggcaagctactccagcatgctcagtcaatcatagtatacttcgatggtggcatgctcagatgcaccatgcatccatgttccagtttgcaacaccactccaatcagcatcgggcaggccattcatca

SEQ ID NO: 700539 - DNA, 147 bp, Homo sapiens
cacgaggctgacctggcagtgggctgccaccatgactccagggggctgttgcactgtcttggcatgctttttcacacgctccccattcattgtgtcggtcatttgcagtggggttggatgggtttgctggtcttttaggccaccatg

SEQ ID NO: 700540 - DNA, 928 bp, Homo sapiens
  misc_feature (1)..(1): n is a, c, g, or t
  misc_feature (4)..(4): n is a, c, g, or t
ngcnacgtgatgaccataaatgatagattatagagtgaagaagcaaacagaagtctgacgtcctgtacactgcaagtctgtttctcaatacctcctcttgggacactccctggttaatctttggatttttatgtttctctgaaagaccagttgtcgacagtgttgtgccaacaaatgtccctgatcatttgttgaaggcccgccgctgcacggtttttttgttttctggcagagaatttcacagttcaaattctgtgtctggggacacattatcccttaagtgtctcgagcccttctccgtcagaggctgtgcgctaaccatgtgaacattggaagagccgtcgttcgcaccccgcccgggatactccggcggtgaatcatccgcctcacgggggttaagtacaacgtgtcaacccgacgcctacacccagcaaacgaggggaaaacaaagaagcaacggctcccccacacgggcaataatttcttgaaccatcgatccgggaaagtcgggattacaaaaaaatagccacacggcggggctacaaatatcaaatggctcacgccacaatccacccccgccgttctagggcccccaccaaatctgggacacaatacggcgatgatccaatcgcctggggcctgtcaagggagttctctaaaaactgccctgcgaggcgacaacaacaccaaaatgttcacgaatgagtgtatacaaataatgggagatattcttgagtaatccaagcaccgcaagtttctatttaaaaaatttgatgtaatactccacaggaacaataaacaccgtgcctgtctgaaaaaaaatgttagatttgcatatgttgaacactcatacaaaggggtaaacccaaaaaaaaacagcctttggggggaatatctttaaaaaaacaaggttttcccccaccaaaac

SEQ ID NO: 700541 - DNA, 116 bp, Homo sapiens
gcagagatccgcgatgtggaacttctgctctcattcttcaaaccatccatggttagctctaaggagcgtttgaataacgccatctggaaaagcttatttcaacttcccttgggaag

SEQ ID NO: 700542 - DNA, 929 bp, Homo sapiens
  misc_feature (929)..(929): n is a, c, g, or t
ggtccttggtgctgacggacctggaatggcgactctcgatattaacaaggatggcggcggccgcaggaagtcgaggagtcggggcaaagctggctctacgtgagattcgcatccacttatgtcagcgctcgcccggaagccatcggtcgtcgatgtacttcattgagaacacgctacgtggagctgaggaaggcgaatcccgagctagccatcctaatgcgcgaatgctccgatgtgcgagcccaagctctgtgccggctacgcattgggccaagagacgaatgtccctttgaacaacttcgagttgctgatcaggtaaccagagccctggagaacggttctaaggtggtgaacacgcctgaagcctccaactgaggatgaggatgcaacagccccaagagccgtggggtctgctggacttagtataagtgttgaccgagaactttgtgtcctccgtatttcgtcataaaagttgtgctcaacataggattaccgcggaacgtacgaaaaagtgtttggggcgtctccgaggccacgagaaattttcagcccactatccttttggggtgcgcgccccctttagtttgtttacatttggaccctgggtacccctaggggacgcacgacaggacaatggtggatttcccccatgtaaaaatggcccgtggtgaccacgttttgtaaacactcaacaggggtttgggggctgcggggccatacagggcggtcagggggcaattcaatcgccgccgggggcttgtgagcggttttacagtacttttggaattatacaccctatctcatactcaaatcaggcttagcagcacaccatttcggctggaccacaaatagcgacggacgcaactcagtatgtaacagacatgcgaacagcaacactagaaaacggtcgggattgacatatcacctcn

SEQ ID NO: 700543 - DNA, 239 bp, Homo sapiens
agcgctgagcttatcttacttgaatcatatggtctgggtggctcatagaatggttttcattcaatcaggcatcgggtttggtccaaccagttttacattaaaaaaaaacggggatataaaagtggatatttaattaatggtggaggatgacgtggaggatatcctctagtactggatccacaaggagaaatctctcagggggtcaggtctcaggtattggctcaggcggcggggtaccg

SEQ ID NO: 700544 - DNA, 506 bp, Homo sapiens
  misc_feature (498)..(498): n is a, c, g, or t
tggactcctgttaccatgaggttcctgatcctgttcctagccctgtccctaggagggattgatgctgcacctcctgtccagtctcgaattgttggaggatttaactgtgagaagaattcccagccctggcaagtggctgtgtaccgcttcaccaaatatcaatgtgggggtatcctgctgaacgccaactgggttctcacagctgcccactgccataatgacaagtaccaggtgtggctgggcaaaaacaactttttggaggatgaaccctctgcccaacaccggcttgtcagcaaagccatccctcaccctgacttcaacatgagcctcctgaatgagcacaccccacaacctgaggatgactacagcaatgacctgatgctgctccgcctcaaaaagcctgctgacatcacagatgttgtgaagcccatcgacctgcccactgaggagcccaagctggggagcacatgcctagcctcaggtggggcagcattacanccgtcaat

SEQ ID NO: 700545 - DNA, 243 bp, Homo sapiens
  misc_feature (240)..(240): n is a, c, g, or t
agccggtacctatgggcgtagcctgcttttgggcaaataatcgtgcaagtattctctcatggcaggtgtagctgtgaacgtaattgtaaccacaacggtgaaaggatctcaacactgtgccttccaagtgatcttggatcataagatctgtcgataatgctggtgaagaaatatagactctcatattgattatttttactgaacatggagtggcaccctcaataaagataacagagcacnttt

SEQ ID NO: 700546 - DNA, 1269 bp, Homo sapiens
  misc_feature (15)..(15): n is a, c, g, or t
  misc_feature (23)..(23): n is a, c, g, or t
caggctgtaccgccnggagttangggatcggagctgcgtgagctcggatcttctcccccgtctggcccggctctctgacccgctgcgctctgctgggccatggagccgggcccccgactgcccagtgaggcgcgcactgtgcgcgaggcgctgggccgctacggagtgcggcgctggagggtgcggtgctctgcgctgcaacgaggacatgcgggggctgcagcgctggcgtggatgcggcgagtggcagagtgcgatgcgcctggcctggccccctggcgcgcacggtggccggacctgcagctgggacaaccatgcggctgcagtgctgcagctctgatgctgccgtgacgcgccagtgttggatgtgcgcttgtggctttgtgccatgctgtggacttgtcccctgtgttgccctgtgcacttccctgtaaaccgcgccaatggcgccccccatgccctgttgcccctggggggtatcgcctgacatctgtctgctgccccgcgaacatggtgcaaagacgcagcagactatcggcgcaggacacacagaccagcacgtatcgatcgaactgataccgggccggccggatccaagaagtattggggaaatcgagcgaatggagagcgccgggtggagtcgggcacgcattgaaggaaaagaagcctacaaaaacatcacattggcgagtacacttggtgcagcagccaattgggtgtcatacccaaggaacccggggagacaccagtggatcgccaaagggtgaccagcaagatggggacccccccccattggaacgataattaagtgcaaacccaaaaaagatacatataccatccaagagcaaaacgccaggaattacacacgccgccaccaagagggaccctatacgggaaaccaccatggattaggaaagagccacggtacatgtacgacagtttatacagtaggagggacatacgcaacatgtcgccaaagacacagagagtgtccaatgtgatacaacagctgaggtcaccgaatacttcgaaacgcaaccagtaaagaaattctattcatatggaacgacgagggtaatacaatacctttggaggggtgtaacgaaatcccctattcaagagaccattggcaccacgtgacgatcatcataaagatcataagccagccaaatttggttactattggcctatggaccgctaggacgctcaatggatgaagcggggcagagacacactacgcaaagaacgcgccaaaagaggacgacgtaa

SEQ ID NO: 700547 - DNA, 707 bp, Homo sapiens
gcaggagaattgcttgaacccaggaggcggaggttgcggtgagttgagatcgtgccattgcactccggcctgggcaacaacagcaaaactccgtctcaaaaaaaaaaaaaaaaaaaatgccacctcacagtctttatcgtggggccctgtggttgcaaagttgcctcctgaatttaagaagggaagggggaaaagatatagctgggaagcgagtggaagagatgcttgagggcggggggctgcacagacgtgctcagcagggctacagggtgctcaagccctatgggggatgggtgggcgagtggggcagcggcgttggccaccttaagaatgggggccaaagccactgatgtttatttgacagtgacactgcactggggtaacttaaagaattttattccccgtggtaattataatgacgtggcgttattagggaaaattatggggatttttagaaagaatcacgtttggccacccaaatggctaccactggttaatctttgggtggttaaatggttccccctagacttttctggtggcatagatttcgggtggtggtcacataagtcgtaatccggtatatccaatttttatgtccctttggtacctttaaacgttattaaaacattttttttccattgattaccagctcgttaaggcagaaaaacaaaaaacaagaaacaagaaaaagacaacaaaaaggaggg

SEQ ID NO: 700548 - DNA, 350 bp, Homo sapiens
acgcctggctaatttttgtatattcttttagtacagacggggcttcattatgttggctaggctggcctcgaactcctggcctcaagtgatccaccgccctccgcctcccgtgctgtcactacacccatgagcccaccgcctgcctccctcaccccctttcccaccccacccccgccctgccgcccaccccgccgcgcaccccccctccccctcctcactccacgccctccctcccctgctcccccctccctcccaccccagccccctccccccccccgctcccccccccctctctcccccctcgcccacccccccccccccccctccctccccctctccccccctcccct

SEQ ID NO: 700549 - DNA, 315 bp, Homo sapiens
ttagttactgtgttttatgttggaaatattttaatattgcacttctataaatagtatgatacatgcacagacgattgcagtaaatacttttttaagctaggatatgtgaaatgacaacctttggttaagtgtgtcaaggttgccaccgaattttcaccacttttttgttgtttgcgacttgttactaatattgaagaggtaagggaggcaatgcgaatgatttttaatctttctttattatcttttcacgcggttatatattttgtgacttatagcaccctatattacttgtcttgcaactgaaaaatataaggt

SEQ ID NO: 700550 - DNA, 147 bp, Homo sapiens
tggttcggctctacttgtctctcggctctacttgtccctcggctctaccttgtctctcggctctaccgttgtctcgcggctctaccgttgtctctcggctctaccttgtctcgcggctctaccttgtctcgtggatgctatgcggcg

SEQ ID NO: 700551 - DNA, 765 bp, Homo sapiens
ggacagagcccgtctcgggtgatagacccaggtcagctgaactttgtgttctccgatacaaagttgttacagagtgtctccagagccttctctctccattgtgcaaagtggcaacgtctgtagggaaaatcctcatagcaccatgtgggggaacgaatagggcaacagtcccgaaacaataagcatcactgtagtgagtctgttggcgcacgaagtgcggtactggctgttgtgctagtcagcgatgcctggggaaaaagtctctgggactggtggaaaactatagttcttcttttgtcgaattggttctagtctggagaaagcaagtaagagtgctttcagaagagggggcacgtaggcattgggaatttgggaatttcgttgccaacgtgaattggggggcaatggcttgatgagtttttcctatcgatgaaaaacggcataaaaaagagttttggttgcgcaatgaaatagaaaggagtttaagtaggctgggtaggaccacgggactcaagagtgcgttaaggaacttgggttagggtggggatacagctgggccagggcaggatcacggtacgaggcacaaagaacccgggggaagaaagtcggggctttcagattcgttgggttgcaggaggaacactggtttcatctgggttcttcgcagaggatttccaatttaatatccccttcaagtcattcgcagatccaagaggtaacaggagtccttggaattgtggcgttcccattacatgtgggttggga

SEQ ID NO: 700552 - DNA, 368 bp, Homo sapiens
  misc_feature (207)..(207): n is a, c, g, or t
agcgcgcgagggagtgtgagtgtgtgtgagcgcgggtgtgaggcggtgccaggggcgggcggagcgctgtccggccccggccaggcgccggcggggagcatgggaaggggctagaactgctcgatgcccccacccccctcgccgggatccgcgccccccttcccgggagaggggccgccgccccgggacggacatgggctcgcccangttcgccgctgccggtcgggggaagagacctgacaggtaattaaatgtgtattctgtcggccaagctttacactggatgcagcgatcaacccaccactcagggacggctcccctcgcctctgcccccggctcgttagctccagctggctccagggtagttg

SEQ ID NO: 700553 - DNA, 865 bp, Homo sapiens
gcgtgccatatgcaaaagacagtcgatcatctacaaagcgtgaagatgcgtcctgctgtgagagaatgtaggacaagagagcaagactcccgcggatacttaaagagaacaatcggtcctgtgtcatcaagaacaccgcaaggtaggcctaatgagtggtcgcatagcgattgaacagaagaaaattgccctctttcacgaggataactgcagttctcgattcggagcgggcggaaatccattcacatgggaagtggtctgtaccaacatgtcactgcaagagaattgcatgaatgagatccctatttaggggaccagacccgactcacgagaactaatgcgagcgtatctgacaaatcgctggttagagtatagcaatgcgcattgacggagaagaggcaggctcaacgatacgaaaaactatgttgtgtcaatagggtaagcaaaccacaataggtataaccaccgccacggtaggacttattacaaaggggggagaaccggggttttcccaagagaaaacttcggaggaggttggaaactatcttgcgtgaggttcctggcccaacggcgtgtgagacaaccaggaacagtgatttgacccaggggtgccctaatccgtgtggacagatttcggccaggttaaacatggtttgcgcccggccatatacacacacacgtaatgtgcctttctaaggtgtgctacaaaacccctaaagggtacttggctcggagatacctgaaagtgaaatggcaggtcttcccgtgacagttactcagaaggactggaacagatcggttcggcatacgcacaaaaagtgaaaataaggagtttataagactgcgatatgctaccataagagca

SEQ ID NO: 700554 - DNA, 135 bp, Homo sapiens
gcagcgggggggtgtcagtacctgcgctgtggagtgaagtgaaccggtatggccagaacggcgacttaaagggcgctcttaagaccgtcaataagatactacagatcaacaaagatgacgtaactccccttcatt

SEQ ID NO: 700555 - DNA, 502 bp, Homo sapiens
  misc_feature (273)..(273): n is a, c, g, or t
  misc_feature (346)..(346): n is a, c, g, or t
  misc_feature (349)..(349): n is a, c, g, or t
  misc_feature (365)..(365): n is a, c, g, or t
  misc_feature (389)..(389): n is a, c, g, or t
atagctctaattttacagtgaaaaacacccacagtgtgacaacatggaaagaatataatcaacttcaacccaatatactcaactccaatcccaattttggcagatagaacaaaaagtcaatacatgttatctgacattaaacagagcttatggaagacagaagtgggtgaggcagataggccgtacttggtcagatccagatgaacaaccagacaaaaataggagtagagccgggtgcagtgcttcatgcctgtaatcccagcactttgggangcggaggcgggaggatggcttgagcccaggggttcaagaccagccttggtaatttagggagaccctttctctncanaaatatgaaatcactncctaggcatggtggtgcatgcctntagtcccagctacttgggagactgaggtaggaggattacttgagcccaggaggtcgaggctgtgagccgtggtggtgctactgtgatccagcctgggcaaaaccctgtatcaa

SEQ ID NO: 700556 - DNA, 802 bp, Homo sapiens
  misc_feature (561)..(561): n is a, c, g, or t
actcttggatactaaattgatggccagcacacaagcttttaaggatatcattaacaacacatcccttgcggaattggaaaagcggttaaaagagacaccttccgatcctgctaaaaacgagcccaaggtttaccaagttatgacacaccctctgaacaactccaccaggcaggctacgacgcctacatcgcaggccctgaggttcatcgtcatggacaaagacctcatgctaacttttgaggccatcacctactatcatgaggtcaactccaccaaagcccgcgcccccttcgtttaacgctgtgagcgccgcgacacatacactcccctcgactgcagcttcaatatggccttcgagtatctattcggtcgctacagtggacggggataggcacgacagggtcgtcatactcataatatatttgcgcagcccgtgcagggccggctacattcccccttgccactcccactacacgccaggacctcgcacccgctctccccaccgccgcagccccacaccccactccaccatagctgtgtcggcagatctggcaaatgtcncgtagggcgtaagtattgctactttcgtgcgtctaccacccgctactgcgcgactagtcctgccgcgtaatgaccccggggcgttcttcgaagagaagtggaacgccctagatcgcttagaccaactcgtttctgccctcggttggctggctcctgctccgacatccggaagtgtgcctctgcggcccatgagatacgcccccaccgagcgctagcgcctgccctgcagatctcatcgggg

SEQ ID NO: 700557 - DNA, 411 bp, Homo sapiens
atgtatacagcaagcatcaaagcatcttcatttctctaacagggtttttttttctgagacagagtctcgctctgtcaccccggctgcagtgcagtggcatgatctcagctcactgcaagctctgcctcctgggttcacaccattctcctgccttggcctcccaagtagctgggactacaggggcccgccaccatgcctggctaattttttgcatttttagtagagacggggtttcaccatgttagccaggatggtctctatctcttgaccttgtgcccgcctcggcctcccaaagtgctgggattataggcgtgagccactgtgcgcagccgtctctgagggagtttaatgagttgttgccttttgagttggtccagctttttacttagtgttagaaccgagtgacaaatt

SEQ ID NO: 700558 - DNA, 192 bp, Homo sapiens
ttagcaaacccccttttttaaaaaaaaaaaaaaaaaaaaaaattggccaggcttggtggtgtaagcctgtagtcccagctacttgaaaggctggggtgggaggattgtttgaacccaggaggttgaggctacagtgagctgtgattgtgcccctgcactccaggttgggtaatgcagcgagactgggtttca

SEQ ID NO: 700559 - DNA, 159 bp, Homo sapiens
gcaagatgcaatgcaggcattttactgcaatgtggagtgtcagaaagaagattggcccgtgcacaatggctgggaatgttctcccatgtgttgttttttggaggtaataacttgtgcaagtcccttcggaagatctggtaagatgacctaatagcagtc

SEQ ID NO: 700560 - DNA, 1355 bp, Homo sapiens
  misc_feature (295)..(295): n is a, c, g, or t
  misc_feature (310)..(310): n is a, c, g, or t
  misc_feature (323)..(323): n is a, c, g, or t
  misc_feature (353)..(353): n is a, c, g, or t
  misc_feature (357)..(357): n is a, c, g, or t
  misc_feature (360)..(360): n is a, c, g, or t
  misc_feature (370)..(370): n is a, c, g, or t
  misc_feature (385)..(385): n is a, c, g, or t
  misc_feature (397)..(397): n is a, c, g, or t
  misc_feature (447)..(447): n is a, c, g, or t
  misc_feature (484)..(484): n is a, c, g, or t
gtagagtttcccaaccctacatgtataaatgctcacaaacaattctctggtatttgagtcacatagagacttttgaccccttgctttttaaagccacacactgaatgtacaccttgcccctgtctagttgctcttattctctctcacatgttgagcccctgcagattcacgaaactctgggaaatcacttgaagagtttgctgatcacacactttgacccccccccagcagattctatttttactgaagaaggagtcgatgcgcaacagcctggctgagtagaggtcccgcccanctgcagaccctccangctggaggaccanccgccctccttccctcctggatggaagtanaaanccnagctttctcnccaccctctgtgggncacacgtgcacntgcaccccccacacacacacacacacacacacacacacacagacacatangcacacacgtgcacacatgtacacacggatacacacncacacacacacacacacacaagtgtatatcgtgagcacgccctctcgcagtgtgtctcagccttgcaccttcttcagagattatatagtgtgaagagatttatatatagtatttttctcccttttttctccaaaacactatatactttaaaaaaaaaaaaaaaaagagcaactcccggggcggcgcgtgtgtcgccctcccaaccctgtggctccccctcttcgtgtcgtcacagcacacctcttcgtgttgtggggcattcgatgacgcgtgggtgcgcccgtttgcccaaagaggcttccttggcagagaggagccacaagagagtatagaaacgccaagtggggcagggggagatagctccctcaaaacgagggggagagaaacatcggagagagacgctagtaggcaccaaacccccaatctattaacaggtcgcaccaaataaacgtcaatgatataaaagaccaactctttgctcgtggccccccatatttgtggcgccccgcaagtaacaccaaggagggggcgccatacaacgaggaaacaagaagggggcacgcactaaaaaacaaaggctgagacaacccatcctaaggaggtccccccaaaggaaggccacctcacattagcgaagcggccgtggtgctgcgatagtgcggatttgaccaaaaacaacgcccggaacagagaagcacccacacaccagaaagagggggggtgttactacccacactagagggggaaccaccacctggaaaacgccccgtcgttatgaagcgcgataactaaaacagccggcgtccccgagaaaagaaaaacaaacaacacaaggcgggggggacggcactactacgaaaaaatctcccgc

SEQ ID NO: 700561 - DNA, 585 bp, Homo sapiens
  misc_feature (295)..(295): n is a, c, g, or t
  misc_feature (310)..(310): n is a, c, g, or t
  misc_feature (323)..(323): n is a, c, g, or t
  misc_feature (353)..(353): n is a, c, g, or t
  misc_feature (357)..(357): n is a, c, g, or t
  misc_feature (360)..(360): n is a, c, g, or t
  misc_feature (370)..(370): n is a, c, g, or t
  misc_feature (385)..(385): n is a, c, g, or t
  misc_feature (397)..(397): n is a, c, g, or t
  misc_feature (447)..(447): n is a, c, g, or t
  misc_feature (484)..(484): n is a, c, g, or t
gtagagtttcccaaccctacatgtataaatgctcacaaacaattctctggtatttgagtcacatagagacttttgaccccttgctttttaaagccacacactgaatgtacaccttgcccctgtctagttgctcttattctctctcacatgttgagcccctgcagattcacgaaactctgggaaatcacttgaagagtttgctgatcacacactttgacccccccccagcagattctatttttactgaagaaggagtcgatgcgcaacagcctggctgagtagaggtcccgcccanctgcagaccctccangctggaggaccanccgccctccttccctcctggatggaagtanaaanccnagctttctcnccaccctctgtgggncacacgtgcacntgcaccccccacacacacacacacacacacacacacacacagacacatangcacacacgtgcacacatgtacacacggatacacacncacacacacacacactgcccgcacatccgtactggcccgacatccgtactggcacacatccgtactggcccgcacatccgtactgcccgacatccgtactg

SEQ ID NO: 700562 - DNA, 94 bp, Homo sapiens
ctgcctccgcaagctgtcagtggtgcagcagcctgtctgagtgggtgtgggagtgtggactgctgctccgaaatctccgctgagctcattcgct

SEQ ID NO: 700563 - DNA, 370 bp, Homo sapiens
gataatacacagaatagagctcgggcgtagtgatagcgcgccgagtaagtacccagctactcaagaggctagaggagggagaatcgcttgaatccaggaggcagaggtatcagtgggccaagatcataccactggactccaacctgggtgacagagtgagactcttgtctcaaaaaaaatatttttccaacaatacagagtatatagaataagaagttaacttagacccgctattaactctgtgtcagtcaggaaaagagaaatcataccagctaattaatttcccagctttatggagatgtaattaataaataaaagctgtaatatatccaaggtatacagtgtgatgattagatatacatagtgtaat

SEQ ID NO: 700564 - DNA, 580 bp, Homo sapiens
agcggggtggctgcttctgccagtattgaatgtgcatgctgtgtgccctggtgccctcacctcacctgagtgtcctggcctgcccagtgtgatgctgctatgccgtcgggatgtgtgaccagtcgccaccctggccccactgacactcccaccatcctggctgtgatgtgacatgcctcgtgatgacggagtgaggaattgactgacaggacgagtgcggaagaccgccgatgccagaactgccgagatcgcacacacacctcaagatccagcaagccggtatcagacaagagctgtgcaagacctggcgtcacaccatggacagagtgctggcagcaggtgcactgcttggcctggtgcacagataaccagcagacattgactcccggaaaaggcttaacaaccgccctgcgacggcgcaacactggactctttcgatattgcgctatcagcccatgatgaccccttattcatgtagcgcatagtcagtgaactaatcactgattcgcaagcttggatacagccaaagtgggaccagactgaaaagggaaacatacgggtcgtctttaaactagaaatc

SEQ ID NO: 700565 - DNA, 1052 bp, Homo sapiens
gtggctgactcccggacgtaggtagtttggtcgggccgggttctgaggccttgctttcctcttatacttttccacttctaggccacgatgccgcagtaccagacctgggaggcagttcagccgcgctgccgagaagctttacctcgctgaccctatgcaaggcacgtgtggttctcaaattattaggcattcctgcctgggaacttgtcgtgctccccagctccccagcactgactcacgctcaggctccgctgctactaacacacagacccacatgctccaaccattgctcccacgccacgcacttggacccaacaacttcccacaaggctcaaaccttaaacttgcagacctatactgggtcagcccaaatggcaaagcccctgccacatggttaacccactggcgccaccaccttggcgcttgcaccctcgcccaccatctgcacacccttcgacccctgacccttagcgggccccgacggctacccctatacagcgcgacaccggctacacccctacactccttctctccggcacccacttatcacgcacgcaccaccccgctctgcctccgggggcgcaccccagtgaacaccccgcgtctcaccctatccctccctttggtctaaacccccttaaaacggtcctggacaaccctttggcctccccacaggaaacacgcgcctattacacggccaacgcgtctacacaattactcaaccgtctgtggctcacacgcgctccactcccccctttctctcccctctcaacacactttttaaaaccctctactctcgccaagcgcacaaaggaaatcagccccttataacgcggcccacaactttggaccccaacaaatccgtcgttcggtcctctactcatcctaccccaacgcgcacctccttcaagccggccacatcaacatggtgccccccctcttattcctatccaacatcttttctcctacaccccccctattctctctctcacagtgtcggacaccaacaccacgtctttgttcgtggcgcacacacactcccaacacaatga

SEQ ID NO: 700566 - DNA, 306 bp, Homo sapiens
gctcgacaggttatctatgagggccctgcctgcagcaaacttctgcctgggcatccaggagtttccatacatcttctgaaatctaggcagaggtgcccaaaccccaattcttgacttctgtgcactctcaggctcaacaccacgaggaaactgccaaggcttggggcttgcaccctctggtccactgcctgagctctacattgagcaacggggacgcagggttccaagtccctaggctgtatacagcacagggatcctgagcccggcccatgaaaccactttttcctcccaaatctccagtcgacg

SEQ ID NO: 700567 - DNA, 852 bp, Homo sapiens
gcacgagtgtacacttcacgggctcttgtgggggtccccggccctccccccaatttgggtttcatatagttcgacagggcgtacccagctccccgtaggatttgtgccgccacgacccagctcccccttggaagacagaagcggttgtgttcctcttctgctcaggggccaccccctaaatatgtgttcgaggcccccacgggaaatcatgttgttttgttcgagacagcagttaccacttatcgtatgccggctcgtgtgatggcaccaccgttctgtcccccaggccccgtcttggtcaacgggggggggcctttaagtccccgaaggtgcttttgacgccccgggcgttgccgaacatgcgccggggattagtttttgtggacacccaccgccggccgatatgtttgtctcgactcgagtgtctccaatccaccctttgcgtagagcccctattcttgtgtggttcttctccccccccaggtgttgtgcaatattcgaagaaaaatattcttgcacgcctgccgagtgtttgcccaccgagacgctcgccgcacttgctgggctcattcacttctttttccctcccacacaacaagcacgtctctgctttttcccacacccacctattagcaccatttttctccaggtaaccaacatggtccccctaattctataaggtcctattcctctttattatttgaactaaaaaaaattgtttatcgcacgccggtatcacacaaacaccccctcgtccagacccttttacaccccccacaatgaaacattacgcccccacaagtcccggctaaacataaaaaaaaaataaaatgccgtttaaaccacataaca

SEQ ID NO: 700568 - DNA, 367 bp, Homo sapiens
tctgatactctgtcagcttatctaattagtatctaacagcaccttatctgctgggtgtagcagcttggccctgtaataccagcacatggggaggctgaggcaggatatcgcctgacagctaggagtacaagcacatgcctgggcaacacagtgagcaccatctctagcaacaaattttcacaattcgccaggctagggccaggtgcagtggatcacgccggtaatcccagcactttgggaggccaaggtaggcggatcacctgaggtcaggagttcgagaccagcctggccactatggtgaaagcccgtctctactaaaaatacaaaaagtagccgggcgtggtggcacgcacctgtaaccccagct

SEQ ID NO: 700569 - DNA, 322 bp, Homo sapiens
  misc_feature (147)..(147): n is a, c, g, or t
  misc_feature (155)..(155): n is a, c, g, or t
  misc_feature (166)..(166): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (205)..(205): n is a, c, g, or t
  misc_feature (207)..(208): n is a, c, g, or t
  misc_feature (322)..(322): n is a, c, g, or t
agaaattgcagagcaacctgggcaacatggtgaaacccgtctgtaccagacaaaaagcactcaggcgtggtggcacatctgaggacccagctacttgagaggctgaaccatgaggatcgcttgatcccatgaggcggaggttgcagngagctganatggcaccacntattgcacncnancccgacagagcgagactccatctacnannccttatgacgcagctgatgcctgccttggttcctaccactctggtgtagacagaggacttgtccaagtctcacactatacatgccatgcgtggataaaggggccgactgatttn

SEQ ID NO: 700570 - DNA, 229 bp, Homo sapiens
  misc_feature (39)..(39): n is a, c, g, or t
  misc_feature (45)..(45): n is a, c, g, or t
  misc_feature (71)..(71): n is a, c, g, or t
tacatatatatacacatatatacatacatatgtatgtanatacanatgtatacacatatatacatacatanatatgtgtatatacatatatatacacatatatatgtatgtatgtgtgtgtgtatatgtgtgtgtatatatatgtgtgtgtatatatatgtgtgtgtgtatatatatgtgtgtgtgtatatatgtgtgtgtgtattttctgaaacacggtttcactcca

SEQ ID NO: 700571 - DNA, 1067 bp, Homo sapiens
  misc_feature (207)..(207): n is a, c, g, or t
cccaaccttgaagaaagtcctaaaagaacaaattaattacatatgaggaattaagggatatgaacagagagtcatatgaagtatctatcaaccacctacatacagactagacccctcgtcacggtcatggtgctattgcatgaaagacgtgccacaaagaacgaagttcaaaagtgaacaacaaacgctactgcgtatgatactgtnaggattagatgctcgcaacacacatttgacagtcatccggacatgcaagcagttctcacatcactccacgctctcaatcgagtgtggttcatcgtattcaccctggcgaagtgcttctagaggctcagcccagcaggtcttactctaaatacacatttcacacaccaagaaacggatacctcggagattaactcgtaggtccccgacttcctatgtgtagttcgtaacataaaacaacagatgtcctagctgttaacactattcgtcgtcccatgtccctcacccttaggggaatacatttagataatgaatggtatcagtaccatgaattgtatacatgctttgtgaccactgtgtgtgcaagggcaaacgactatctcattaacaaaaaaccgtagacgagttaaaatggtcctagaatcaaggatatttaggacatatataactgactatgtgcaatgtagaaattgggcgtgaatggggggggaagccaaagtcctgaaattaaaagtgtgatgcgtttgccttcaggaatagtgattgaagcagctgattatctacttccgaggtaatctacgtgtattaattcggtgaaagagtcacatgggcaatataacctggttaaagggaacgatgggcaagaacaccacggaagcaatattttcaccttccggttaccataaatcaatcggtaatcccccaacggggtccaagtcatttacagctgattgcccaacatccgggggcagcaatttgaaaatggctcggcgggcggcattgagacccacagatcttttaaaaaccgccatggcgagcggaataaaaaagcacgcgctaaaaacgggcggaaaatcatggcc

SEQ ID NO: 700572 - DNA, 101 bp, Homo sapiens
cccccccccccgcccccggggggggggggattaggggggttgggccccccccccccccttttttgggggtttggggggaaaaagggggcccccctttttta

SEQ ID NO: 700573 - DNA, 158 bp, Homo sapiens
ccgaacagtcttcaatctgattacaagacaacattgtaagagagatgagcactcctaagtcgagtatattataatacattagtactggattattcaggctttagagcattatgcttctttaaaaaagctataaattatattcctcctgcaaattttgg

SEQ ID NO: 700574 - DNA, 1710 bp, Homo sapiens
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggaggtgagcgggcgcgagcgcgggcgcgggcgggtgggcagggctgcgcctctcggggccagtcccgcctcgcttggggccctcggccgccccgcactctccctggccttcggccgccgcctcctggaggggcctcttctccgggctccagaagcgctccccaggccgaggagggaaggcgagctgctcggagtcggatcttgtcttcacattgggatggagcattttgcataacctaagtggtactctttcgatttttcccagtaaatgtctcacatctcccccctccattccccaccggagcagtgacaccttcatcccctcagtggctcccgccagagtcccgggcttaccctccgctccgcatcccatctctgggcataggcgaggctgacggctccttctgcaacaaaggtctcggatccgttcctttgctgccatcactgatgtcatccccaccccagctgcaccccagagttcaacctttgtggctctcctgcttaaaaccctgcagcgcctccttgttcacctagcatcagatccagaccccatgggccccgtccctccacctgcgtcttgtggtgttcttgctcgtgggggtctgttcatcggctgtgcccatgggctttcgatgtggtctttctgctgcctgcaggcctccactcacctacccacacaggcagcctcctttcctccagggaggccccgcaggatgatcttctctgtgtcctgtgtaacacacaccagggagctgaccagcacaggggaggcccacctgcagatggagggaggcttccccgcgctggcgcaaggaacctcgtgaggggtagtgagctctctattaccgcaggtgtccaagatcaggccaaatcatcatcatcaggaaagccaggcagcgcgtctctgtggttgggagatgctttctaaggccctgctgaactccaagaggccatgagaagcatatagtcttctaaacagaaaagcattaactctagcactctctggagcccctcccaccacacacggtccccagcaggtgcacagcctcaaacagcatcactgggtgggggctgagtaccaagaagtgtggtgacctgcccagggttgaaaacctttcttagttcaatactgttgcccagattgttccccacaaaatcacaaaagaagttaagaggttcctggccggacgcggtgactcatgcctgtaatcccagcactttgagaggccgaggcaggcagatcacaaggtcagcagtttgagaccatcctggccaacatggtgaaaccacatctccactaaaaatacagaaattagccgggcgaggtggcacactcctgtagtcctagctactcgggagactgaggaggagaatggcttgaacccgggagggggaggttgcagtgagcagagattgcaccattgcgctccagcttgggcgacaaagtgagactccatctc

SEQ ID NO: 700575 - DNA, 674 bp, Homo sapiens
  misc_feature (484)..(484): n is a, c, g, or t
  misc_feature (674)..(674): n is a, c, g, or t
gacatttacagcgctttgaggcctatgttgaaaaaggaaatatcttcccataaaaactagacagaagcattctcagaaacttgtttgtgatgtgtgtattcaactaacagagatgaacctttctttttacagagcagttttgaaacactcttttttgtagaaactgcaagtggatatgtagagcgatttgaggcctactgtggaaaagcaaatatcttcacataacgactacacagaagcactcctagaaacttctttgtgatgtgtgaattcaactcacagagctgaacctatcttttgatggagtagcttagaatctctcttcttttagaatctgcacgtggatatttgaagcgctttgagacctaaagtggaaaagccaatatcttcacataaaatctacatagaggcactctaagaaacttctttttgatgtgtgcattcacctcacagagctgaagcacacagtgcttgagtgaccagntttgaatctctctttctgtacaatctgcaagtggatattgggagccctttgcggcctgtggtggaaagggaatatcttcaattctacacagaagcattctgagctctttgcgatgtgtacattcatctcacagagttgacactttcttttgattgagcagttttgacacactgcttttgtagggctgggn

SEQ ID NO: 700576 - DNA, 2101 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggcccccactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700577 - DNA, 238 bp, Homo sapiens
gactctagagggcctgtcttcgacggtgtctggaatgggacacggtatggggcttcataagcactgctggataaacggcaatcaatacatgagactgaagtctccccatatggggcttctttttctcttagagctgggtggactccatccataatgagatttttttaaacataaagaatctgatgtgatccgcacaccgtaaacatgcagttaaatttcttatatgagaagcatgtat

SEQ ID NO: 700578 - DNA, 1027 bp, Homo sapiens
  misc_feature (551)..(551): n is a, c, g, or t
taaattttaaatcactgggttgggtatttttctgacaaagattaagaaaaagaaaaaaaaattatttgtggggcaaactgttcaaatttttatggtttccccttttacctcaatggtatcatagtactggggtttttttggttggttttattggtgtggccaaggtcttggggcatgatgctatctaatcatggttaacgtggtgagaacattttctgaagatgggaaagacaaatttatgttagctcacaaacgggcttaattatatatatggataaaaaactttttccatgggtggtcttaacacttttatttaaaaatgaaactggaaaaaaagtcccattgaactctctcttccttctccttttctttccttccctctccagagatgtgggtttctacagaaaccctagatttaaaatggtggctttaaaatatgcttgaaaccacctttaatttatccagaatgaatcagattggtcttttcctcaccaacttccctccaaaactgtgactttaaccaatatttttgtgcgcttgggatcctgggncccttttcccatttctcaagacgcatccaatccctctgtggacaacgggtcctacggcggttcatttagccaggcaggagattcctgaaggggattcaaacacggtgtaggggggagccattcccgtttgggttttatccgggtagccccggggagccccgtgttagggaaatacacgtgtgtaagatggaaaaacccggttaaaggagcagaggggctagacggagagaatatgtttccaaagttttggctttagaaaagacccgtttggataccgagactgtggggcccagaactttaatataggagataagaaatcaaggggattaaaaaggagatatattatacgcggggaaaaaaaaacgtggaggaatttcgatggttaaacataaaaaagaacaatctgagttaccaagcgccggcgcttttctttttttttcttttcttacgtgcatcttctccttttgggggggggg

SEQ ID NO: 700579 - DNA, 1933 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700580 - DNA, 2026 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700581 - DNA, 2153 bp, Homo sapiens
  misc_feature (671)..(671): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700582 - DNA, 2164 bp, Homo sapiens
  misc_feature (734)..(734): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagatcaggcgttcctggggcagctgtcctgtgaagttggtgggacgtgctaccctgggccagctccagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggcccccactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700583 - DNA, 357 bp, Homo sapiens
tggtgttgttttgcatttcacggggctgtggccggatttgctggacgcattaacagtgtggtgttgccggtcggtaaaaataaaattacggtactgagtattctgcaggcatgtatctccgtggcactgaccatggtgattgcattgtgggccagcgctgctctcgaaacccgcctgatgcaattgcctactgcacacatgtcgctcaaagtggtgctttcgagagtaggccgtgcgttgctgattctgctggccttattgatcagcctcaccatagtgggtattgatcttactgtattgtctgtttttggtggcgcattgggcgtgggacttgggtttggtttgcagaaaattgcc

SEQ ID NO: 700584 - DNA, 2173 bp, Homo sapiens
  misc_feature (818)..(818): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaaggccctagggtccagccccaccggccgccacccagggagttcagtgttgggttttctcctgtctaataattctggggtccaagtcaggcgttcctggggcagctgtcctgtgaagttggtgggacgtgctaccctgggccagctccagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700585 - DNA, 2058 bp, Homo sapiens
  misc_feature (628)..(628): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggcccccactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700586 - DNA, 2339 bp, Homo sapiens
  misc_feature (685)..(685): n is a, c, g, or t
  misc_feature (713)..(713): n is a, c, g, or t
  misc_feature (909)..(909): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaaggccctagggtccagccccaccggccgccacccagggagttcagtgttgggttttctcctgtctaataattctggggtccaagtcaggcgttcctggggcagctgtcctgtgaagttggtgggacgtgctaccctgggccagctcccaggtgagcntggcttcggtggtccccgtgggctcctnagtggcgagggtgaggcctggcactgggcctctaactggccccgtggccctgcagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggcccccactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700587 - DNA, 101 bp, Homo sapiens
aaaatgggcttcgggtacgcatcagctcattgcttctttccatgtgtttcttgctcattcagggtcactgcagctcgacattctgtaaatccatggtcata

SEQ ID NO: 700588 - DNA, 2018 bp, Homo sapiens
  misc_feature (588)..(588): n is a, c, g, or t
agcgggactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcncctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggcccccactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagcctttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacaaaaaaaaaaaaaac

SEQ ID NO: 700589 - DNA, 129 bp, Homo sapiens
gaaggagctcactggggtccgataactgggcaaataccctaggagttcaaggttataaacaccggtatgaacaaagcatgctttcagctgcagacggtgaatctccgggcttttaagtcgaagtttata

SEQ ID NO: 700590 - DNA, 459 bp, Homo sapiens
  misc_feature (276)..(277): n is a, c, g, or t
  misc_feature (283)..(283): n is a, c, g, or t
  misc_feature (331)..(331): n is a, c, g, or t
  misc_feature (353)..(353): n is a, c, g, or t
  misc_feature (355)..(355): n is a, c, g, or t
  misc_feature (367)..(368): n is a, c, g, or t
  misc_feature (372)..(372): n is a, c, g, or t
  misc_feature (383)..(383): n is a, c, g, or t
  misc_feature (432)..(432): n is a, c, g, or t
tacttccacagggaaacgggcatacactgggagaagaaggtgtgggtggtctcggtagtcacaccgggatgtaaccagcttcctacttgggagtcaggggagaattatacccggaccataaatgatgaccagggtttactcctctctgagacggtcgggggagctctccgaggtctgggagacttttagccagctggttgggaaatctggctgagggcacattctttatcaacaagacggagatggaggactttcccggctttcctcacgggggcnngcggtnggatacatctcgccattaccggccactctctagcatccgggacactcnggatgtcatggcgtacaataantngaacgtgtccannggcntcgggtagatnatccttccttcccatatgagagcttcacttttccagagctcatgagaanggggtcctacaaccctggggaaaagta

SEQ ID NO: 700591 - DNA, 178 bp, Homo sapiens
ccgcgtcgacgggatgaggaggaagcaaatgttgatggtagtacggcagctcgtttgccatgaagcggtaggtgctttgcaaagcatcgtatctggggaaggaaaagctgagctgcaccgcagacaccgggggaagaggcaggagttctgatgctgtggtcgacgcggccgcgattta

SEQ ID NO: 700592 - DNA, 106 bp, Homo sapiens
cattggtccgagagaaattaggcctacccgccgcagtactgatcattctattgccccctctattgatccccagcctccaatagtatctcatcaacaagccggacta

SEQ ID NO: 700593 - DNA, 262 bp, Homo sapiens
  misc_feature (229)..(229): n is a, c, g, or t
  misc_feature (238)..(238): n is a, c, g, or t
atccacccgcaggacccaaacaccttctattagggccaaccttcaacattggggattacatttcaatatgagattgggaggggacaagtatcccaactatatcaggcagaatatatggcattgatatatatttgaattataacattctctataattcaggtgactgtaaattatgtcggatctgacctggggggatgtgttacctaagatttgactaggatcaggggcnctgtgtccngtccggggtgtatttctgtaggtc

SEQ ID NO: 700594 - DNA, 343 bp, Homo sapiens
gatagtatatcaacatggaaccattaacatttggactggtatagaaccataccagtttttgatataatatgcacatgccgcctccccaaacatgaacgccattataacccttaatggaataataggctccaaatactttcttctgcaagtacccaccctttcatatgtagttaaatgacacactagactgataaatcagttctttttcttaatttaaaagaaaaaagctttgagaaaggcaaacccccttctccatggtgaagactacatgcttgcatgtgaggactcaagcccagtggtctggctttgaatctgcttacaaactccaccttgtgttgctcag

SEQ ID NO: 700595 - DNA, 213 bp, Homo sapiens
ataggcatcccacctccaccaccgcctgtaggatttgggtttccagggacgcctccaccaccctgtgccccatctttgccaccttaccctgattttgctgcccctccacctcctcctccaccaccagcagctgactacccaactttgccaccaccttctttgtcccatgccaacaggagggtggaggaggaagaagaggatttttacagggtt

SEQ ID NO: 700596 - DNA, 1169 bp, Homo sapiens
  misc_feature (1169)..(1169): n is a, c, g, or t
cacgcaccggctcgcatcgcagagcgcacgcgccggagcggggccgagagaacgcagcgcaggtgagcagcccgagagcgagacaccagcgagaccgtccggcacctcccgacagatcgcgagccggctcctctaggcccggcacagccggtgcgtcgtgcttgcgtggctcggaccttggattacctcgcggtctggctccacggcgccgcgaatgtgctgcagctgtggcagcccagtgggtcgccggagtcagctcctcctcctccctgtctgcatccgatggatcccggggtgatgcgcgcaaggggctcggaggcccagaggctgcggcctcacccgataggcttaccgctcttggttgagtccacgactgcaatccgtctgcgtgggtcattgagacaaacgaaggcacccttcgtctctacctggccacttagagcaagcaagcggaaagcagcaggaatgtgatgcgacgaatcatgaggtagcttggcgattgctgcagcggtgtaacaaaagggtcgtagccttagcgaagcctacgcttccgcatccttacatagcatacagttataggctttgataagccctccctttgcataacaataaagcccttagagaccggcgactggttgtcccgggacggacgaggcgagagtctcctatttggttgtccacttctgacccggatgtgtgtatgcccatacttagaagacccgtcgttggtaacgcccgaagtcaaagccatgtggatcgtggagctcaattcatatcttttcgatcgtacagaatgggctctcaggatggagacaaccagttaaccgcactccggccggttggcgatgaaaaggcggtcgccaaccagtaggggtaggccagatccccaggtataaccgactggaatttaatcgccaaagttgacgcccggatatcaaaggccgtggcaagatacaccacaggggaaccagaaattggcgcagcatcagaaatgagaaccaccgcaagagtgagttgcgccactggtataggacgagggcaaaaggcaactggggtgcccgaaaacggaattaagcggttgacaagcggcacgaggaggccccccgtattggttggcagtagcaacggccacagaggtccgtacataagggtggaaagccccaaacacn

SEQ ID NO: 700597 - DNA, 245 bp, Homo sapiens
  misc_feature (41)..(41): n is a, c, g, or t
  misc_feature (65)..(65): n is a, c, g, or t
gataggcgcggtctacaacaaagattgagaaacgcgacagnctctgtggcaatggaggcgagaangctcagagaaactcgcccagaagaatttcccttagcgctgagggccaaggcacaacagttgtgccaggaattggcttggttgtgtggagcagctgggagctggggcctcaagagagcagaaatcctacccccgaagacagacaagagcgaggctatttgggagcgaatcctgacacccct

SEQ ID NO: 700598 - DNA, 338 bp, Homo sapiens
agcgcacgattcgcgtcactgctgctctacttcatccccgacacgccactccctcaggccctgacatcgagtttataaacgcctaggagtgtcaacatcgtccctgtcatcgccaagggtgaacactcaccctggagagagggtccacttcaaacagcggatcaccgtagatcttgctgtccaacgtcatcgacgtgtacccccggaaggaatttgatgaggactcggagcaccggctgctgaacgagaagtccggggagcatgatccccatttgctgtggttggcgagtgaccacaagtaccaggtcaacgggcaaggagggatcccttttggaacg

SEQ ID NO: 700599 - DNA, 493 bp, Homo sapiens
ataacttggtagctagctagcctaaaaacccaccagaggctatctatctgcttcttaacaccaacagcagccttcttatcctatacttacctaccagaggctacttgcctgcaaccgccgccttctcatctagatttggcctagtagtgccgctgctagcagcagctgccttatccacccggagcttgtgaatcctggcctggcgacgaatggtgtaccggcgcatggtctttgcatatgggtttagcttcaacatgattctcaagtatttcagtgggtccttctttaggactctgcgatggatctatacttgcgtggtgctcgaagggctcttaggatctctgggctacacaaggattctgctaagatctgtatcaatcatctagtgcatgggaagatcgtagtaactcttgagggaagcggcttaacgccaagtgccgtacaattcatccaacttccggaaagcacttacagtccaaatgcagaaacgtcc

SEQ ID NO: 700600 - DNA, 408 bp, Homo sapiens
  misc_feature (192)..(192): n is a, c, g, or t
gggaacaaaagctgtctgggcggccctcgaggcacaggcccttatggccggatccagctccagtgggtccgtccagccttatcccttaacctggtgtagccacacaggggtcaccatcctgcagacaggcccacactttcctctcactgtgactttaagacacaatttgctcattctgtgtgtgttagaagncccgtttcctcaagactctttatttttacacatttctctgtgacatgcctttgctgctgtccttggtccgaatgactcatcattcgtgtacttcttgctacttgctcactccagttcaaatgctgctccttctcggaagccttccctgttctctccctccctgcgccgatgattggtttttctgcctctgccccttcctcgctctgctgcggcgcc

SEQ ID NO: 700601 - DNA, 2685 bp, Homo sapiens
  misc_feature (183)..(183): n is a, c, g, or t
  misc_feature (209)..(210): n is a, c, g, or t
  misc_feature (213)..(213): n is a, c, g, or t
  misc_feature (216)..(216): n is a, c, g, or t
  misc_feature (234)..(234): n is a, c, g, or t
  misc_feature (317)..(317): n is a, c, g, or t
  misc_feature (461)..(461): n is a, c, g, or t
ggaccaagatgttggtatctgaaagcaaggagacggcatctggagatgtagacagcttctacaatttgctgatatacagatgggaatatgaagtgcaagtgtggaaccaggacttggtattaagcctttcccaacttgtgaatatagaatttgataatacactttgtgtattagcaatggttnttactaatgctaaaactttgaaagtnnatnttntaataaatgttgagtatnacatcatttacttgaggttcaaaaataattcattttaaattaagtagttttaatcagcttaaaagctatttaacccattttantaagcttgcagtttgtttctctgcatatgatattcttattagaaaacagaagtagctaaaagtttattattttaatcctatttaaatgttctttcaaatctctaataatttaaactttcctcagtgctccatgatacttttttngagactccatatcatgcttattttacctttttcaatttagagggattgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattagaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatattttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcctgagtagctgggaatacaggcatgcgccactacacctggctaatttttgtatttttagttgagatggggtttttccacgttggtcaggctggtctcgaactcctgacctcaggtgatccgtccacctcagcctcccaaagagctgggattacaggtgtgagctaccgcgcctggccatgatgatattattaaacaccattattcacatttcaaataataacaatactttttgtttttcaaaaataaaatgcaatgttatataaagctataaactaagttctttatgatatttgagcaacaactcaggaatataacatataagggagatgttaatttaaaaatttccactacacttattatctattaaccaaagcttaaaattttgtattcttctgttagataagaccttttacccatttaatttgtctttaaggacagtcatttggcttctgaatgtttgaaacgattttaaaaaataagtagtgctatggttgtttctataattctaacctttgatagtaatcagaatgtattacatttcatttctgaatagcttttgaatttatgaaaaattattaacaatgaaaaattggtaattttattaagttatatgtgtttaaatattatattagcttatttctcttgcattaatagtactgctgtttttgttttgcttctttatatttatgtctagcttttatatgtaatttatctagtgtttataaaatgtgatttgtaataaatgttgttaaaatgaaaatggaaaaaaa

SEQ ID NO: 700602 - DNA, 396 bp, Homo sapiens
  misc_feature (138)..(138): n is a, c, g, or t
  misc_feature (141)..(141): n is a, c, g, or t
  misc_feature (316)..(316): n is a, c, g, or t
  misc_feature (356)..(356): n is a, c, g, or t
tttaaaaacacctttattagccaatatagtgatatatgataagttgttacacaaagtatacagtttgattagttttgatgtatataagcccggtgaagcctatcatcacagtcaagagagtgtggctgggtgccggtntcnacgcctgcgctcctagaactttaggaggctgaggcccactgattgcttgagctcaggagttcgagactggtctggccaacatgatgaaacctcatctctacaaaaaaatgcaaaaattagccaggactggtggcatgtgcctgtggtcccagctacttgggaagctgaagtgggntcatctgagcttgggaagttgaggctgtagcgagctgtgntcatgccactgcactctagcctgggcgacagagtgagacc

SEQ ID NO: 700603 - DNA, 439 bp, Homo sapiens
aattttttatcttactgcagtgaccaacatgtcgatgtgaaattcgcctttcgtcagggattcgataaaccaagtggatgtgtcatatattgccaaacattacaacatgagcagcagcaaagttgacaaccagttctacagtgtggaagtggagactcaaccttcacagttctcaagcgttaccagaatctaaagcctattggctctggggctcagggcatagttcggtaagcggaatggatttgctgtatttttaaagggaacacaccgtgtgcaactactagacacaaacacacaaacaaacaaaatccccaaaataaatagcataatttgggagggaaaaataatcctactgaagaaaaaaaaataacattatgagcattatgtttaatttgttatccacttgctaacaatatatacaacttggcttgtgaaaaaa

SEQ ID NO: 700604 - DNA, 498 bp, Homo sapiens
cttttggctatcatgaataatgttgctatgtacatggttgtacaaatatctttttgagaacctgctttcaagtcttttggatgtataatccagaagtggaattgctggatatgataatcctatttttaattttttttaggaactactatgctgttttctgtagcagctgcaccattttacattttcaccaaaagtgcaccagggctccaatttctccatatccttgccaacaccttttaaaatagtagcccccctaatctgtgtgaggagatacctcattgtggttttgacttgcattttcctaatgattagtgatgctgagcctctttttatatgcttgttagtcacttctatattgtgtttggagaaatgtctatacaagttctttgcctattttttattcaggctatttgtttgttgttgagttgtagctcagtggcatactcttgattttgaaatgtactacaatatctggaagcaaatatttcctcatgggta

SEQ ID NO: 700605 - DNA, 212 bp, Homo sapiens
  misc_feature (15)..(15): n is a, c, g, or t
  misc_feature (40)..(40): n is a, c, g, or t
  misc_feature (65)..(65): n is a, c, g, or t
  misc_feature (75)..(75): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (147)..(147): n is a, c, g, or t
  misc_feature (197)..(197): n is a, c, g, or t
  misc_feature (201)..(201): n is a, c, g, or t
  misc_feature (205)..(205): n is a, c, g, or t
gcagtttgacctgtnaaacaggactagttcaagtcaaganactaaggttgttgtatacacctggnggcatctctnattcagcttatccnttnantgggtatttcgcacaatgaggataaacttatgtcacccacttgagtggctganctaataatgtagacattatgcattctgtacttagtgaaatgtcagatganaatnactnatgaata

SEQ ID NO: 700606 - DNA, 457 bp, Homo sapiens
  misc_feature (55)..(55): n is a, c, g, or t
actaatactattagcatttagcgtagcgcatttgcatttccagagctctgatggnacgcctgcgtgccaggtaggaccaagaggttaatgaaagtttgatttttaaatcaatttatttgaattttccgcgctgcatgttccctggtttttggccaagcgggaagcaagcgtccccaataacataacaggttaaggtgtaacctgtgaagaacccactaaaaccacataaaaagaccccacacaataaatcaaacacggtattaacaccactaacaaatattcgtaacaggtgggttgtgtgtggatgctggcgtgtgtggttaaaacagggtaaaaaacagaaaaatggccgggccttacttaatttgggagctcccttaacagccggatccgggtaccttaatactgtatagtatacagtcttgtcgacgcggccgcgaatttagtagtagtaggc

SEQ ID NO: 700607 - DNA, 1024 bp, Homo sapiens
  misc_feature (1024)..(1024): n is a, c, g, or t
tggtggagccccctgtttttttttatggccccccacccgaaaaggggaccgcccgggggtggggggggtcccccaaaatcccggggggtcttttggttttccccccgggactggggggggggggggaaactcttgtggggtgcaccccatgggagaacacacctagaatattgatatgagacaaagcgagcactcgcacaaggaataaggaggcagccaaatcggggggcaccgggatgaaagacgtggacattcagaagaaggaaggaaggacatgccacagggggacaccgcatagagtgaatgggagcgctagtggaggattccctgactacacacccaccttgggccgcagcgctatattctccaccagtgaaggaagatgagcgcgaaaaaaaggggggaaatagcacagcgcaggcgaataaaccggaagaaaagacgcccggcacggcggagacagagagaaccaggaggggtggcgccacaacaaagcgataggagtaatcaagacacgacgaggaacaaataaacaaataatcaccaaccaacccaccaaaaatgacgatacatcgattcctcacccgaaagaaaacccatcaatcacaaaacgaacatggagacagcaacatatttcaaccagaaaaagggagcaaaaaacaatgccagcccacaaaaagatgtaagaacactccaaaaagtaaaagaaaagcacctactcatcagaacacaaagagaaacacagcaataaccaaggacatcagaagcggagcgaaagcaaaccagcgtcacacacacaaccaattccaaaacaaaaaaagagatggatgtaagtgaaactacaagaagacatcaatactggtataatcatataaaacaggggatgataaatcaagaaaacatagcaacaccaacccagactaagagacacgaagcgatacagacaagagtgacagaccttacctcattatgatctatgacaaggaacaaaaagaagactacaaaacatcagacgtataaacan

SEQ ID NO: 700608 - DNA, 1217 bp, Homo sapiens
ggcctgtctccgggccatggctgttcactgcagggctggtggtgcgtgcaccgctcccctgtgactgcatcctgcctccctgtgggacctgcctgtggcagtgaatggaatggtgtgtgtgccccatgccccatgtgccgtggaatggatgccagcgtgcctgacaaatgcatgaaacaccctgctgctccactgtagccccttgctcgctgtccttgctctcagaagtcccggtcccatgtagatagaggggggcgcatcttaccaaagcatttcctcctggaggctacgcctgatgtgctcccagtcaggctggctggtagggagctttgcctgccccggggataccctctgccagccgctggaacgtgggaatgctggcgacagactgtgtccatctttcccaccttcatagcacggactcacccggacccgactggctgggcattcgctgctagccgagcggttctggccggtggcgtctcggtgatcttgtcctatgcgtgagtctgcacctggctctacagccacatcctatgtactcctgcgatctctcaggcagccaatgctagaagtcctgggagtttgcgactggtcactatagcgcgcatcagtccatttccaggccctggcgctccacgggaacacacggtcccacacccaacaaccccgcaaagtccatcatgtacacgccacgctgcacacgccgctgctccgtcaaccccggatgccccaacggccccccacgatccccccagacctacagatttcccttggcgatgaagcttggcggttgcaccctcccacctatgcgctgccacctaacgcctaccgtggttcccgcgcaagccgacaagtcctcgccgcctctagtccatcctggctggcgagtccgtatgcatgttcgcctcttggcaaacacctgcagcacccgctctgcacgtcgccattcatgcgcgcggcgaacgagcacacgacactaccaacaccacaccacagcagctgccactcaccccacccgctcgccacacaactaatcaaccacacgcaaccacaaccaactcccacaccaacacaccataccacttcaacaccaccccccaccgctattacgacacgtcaatacacccaaaccctcaacaccacctcaactacccaccccctactccccttctctacgctctctccagcagtcattatctcccccctctacacct

SEQ ID NO: 700609 - DNA, 129 bp, Homo sapiens
acatttcacttctctgctaagaagtgttcacgacccctcatgacacgaattcaaaagatgtagtaatgtttttttaaatagaaaatgaagcctaacctttcctttaccatggatattaaagccctttac

SEQ ID NO: 700610 - DNA, 1335 bp, Homo sapiens
ggtacttgtacatctgctcatgttctagacaagtccgggagtctcggtgcgaacccttcatctactcacgtgctgatttccgttcgacgaatgaacatatgagctcttagtagaacagatctttcctaaacccgtcagctgcgtggctgcgacctgagttggttcctattcctacggtgctggcatatgctgtcaggatttccactatctgttctcgtgtaactaggttcatgtcgggccttccttcatgccagtcctgttgcctagtcgtctggattcccccttcaggtgatcgactacagtttgctgctagctccagatcaccatgtctcgaaatgcaactaggaagtcagtatgtacagctagagttgtaaagatgtgtttactatccatcgaggtgcagagctctgtgtgggcggcttcccgattgctgaggtggcaataggagcatggaccgttaggtaggaggggatgctactggaagatgactaataatactggatgtcactgtcgaattcgatggcctctgccgtctacggggcccaagtttctagatccaagctgttacgaccagagctatcacaggagttcttccttcacctgtgtggggccccaaccgaggtctagcgaagccctgagtgaaaggtactaaccgtacattggttaggagcgtagagatcggaagtttccatccactacgagtagagcatgtttgggcgttcagaggttagcacttcacaccatgtcagcttgaccccatcttggggcataagttgggggagggtcccttgcaaggatctgatgaggacggtcctacacgcacatgggatcgcttgaccctggcccttcctttcattgaactcgaccaagatgaataagagtctcgaggcattccttgtgccgctttccgtcatcttaagagcatacgcttgtcaaattggtcctaacccacaatgtaacaaatcacacagcggctcatacaccccaaacgccagtacaattcctacattccgggccatggaacggaccattatacagtttcctacactgaagcactgcatgggctgctcgtttcagtgccgaccgctaacggagtcctaaacaccacatggtggcgcacagacctgaagggccaagaagagccgaaccattaaccattacacaagagccacacgccccgtaacaacattactttcatggaagtcattactctgtacgactaaagattgggcacctttccatagtacgaaaggtcatgaagtcaattcaccaatctggcttgaatatctgagatcacacattcttatccacgttaaaccttggtagagacaacgc

SEQ ID NO: 700611 - DNA, 955 bp, Homo sapiens
ggtactggtccggaatttagggatcctgaagctgacaccccacctacggggacttcagcatctggtgtcggccaccatgaggggggtcaccacctgcctgcgcttcccgggccagctgaacgcagacctgctcaagcgggcggtgaacatggtgcccttccctcgggctgcacttcttcatgcccggctttctgcagcccctgaaccatgccggggcagctcagctagtaccgggcgctcacggtgggctcggagctcacctcagcagatgttcgactccaagaacatgatggccgcgtgcgagccgggccacggtcgcatacctgatcggtgggtgcctatcttcctggggccagcatgctccatgaatggaggtggacgagacagatgcatcaatcgtgctagaacaatgaactagcaagcgtacttcgatgggcagtggatccccaacgaacgtgaaggactggtccgatgctgcgacatcccgaccccgcggcctggaatatgtcggtcaccttcatcggtaagagccacggctcatccaggagctgttcaagcgcgtctccgagcagttcacggccatgtgccgtgcgcaaggccttccgtgcactgtgtacactgggctgagggcatggcacgagatggagttcaccgaggtcgagagctacatggaacgagctggtgtcctgaggtaccagcagtaccaaggacgcccacggcgaccgaacaaggggagtccgcagcggaggacggcgaagacgagggtttaagaccttctcagagtcactcgggcatccttagatggaagtgcctggttgtcctcaagccatggtcttgctacttggtaacgtatgggggctcaggtttgcctctggttacaaatttccactggttgatgttatgaatgtggaactctctaatattcccgtattgctgtgagagtatcaatctatta

SEQ ID NO: 700612 - DNA, 189 bp, Homo sapiens
ggagccgcagagactcagcacagaaacacgccccgaggaacctgattaaccacttggtgctgagggcggctggagggcctgtcagcacagccagagccccatgagcgccggagcctgacccctctcaaatcactgcagccccgcagcctccagggctgcgacgggaggacttctctcagggtgactggg

SEQ ID NO: 700613 - DNA, 292 bp, Homo sapiens
ccaaacaaaactctttgacaatatttaggtgtgagtaggggagttgataaatgatgttttctctatactttgtctctgtgtctttttcttttccaagtctctcgttccaccttatgagaaacacccacaggtgtggaggggcaacccaccccttcaatgagacagattcctttctagctctgcaaccctccatagctctcatgtcctccaaatcctgctttgtaagcattgagatgtttatgtgtatgcatatctaaaagcacagcacttgattctttaccttgtctatgat

SEQ ID NO: 700614 - DNA, 425 bp, Homo sapiens
tagatcttcgcgatcccactctgaggttactatgcttgtgagttcccgcagcctctcaccagagttcctatacgagaccacatcttcatctgagacggcccaaccttgagccccaactcagaggtctgaggctccatttgtaccgaacaccctgtaggctgaagctcctatgtcctgaggtaactttcccagcacggtggttggtacccaggcctggtcagaacagggacatgcagggtgacacaggacagagggtcccagctgcaacctcacccacgcaatcatatagtagcagcacagggcagtccggcacgggattctcaggcctaatgccgagcctcgagggctgagagcggaagacaggcaggctacgggagttgcagcaggatgttcgaaagggtacgagcatgaatcgtactcatggt

SEQ ID NO: 700615 - DNA, 694 bp, Homo sapiens
cgaggcgctgggcacagttgctgtcccctttgacgatgatgaccagattgttgggggctacacctgtgaggagcaattctctcccctaccaagtgtccctgccattctggactcccaacttctgcgcgtggctcccttcatccagtcgaaacagtggggttggataattcagccaggctcacgttgctaccacgaccccgcatcccagtgtggaaagctggggagagcaacaacagttacataaggtccctggggaggggggaaattgaggcaaggtttcaattcaaaatcggccggggcccaaaaaatcccatcgcggcccaaccccttaaaaatttaccaaccaacggggaacagcatccttgggaaccaaattggaaccattcattggcctgaatccaaaaaccttcttcccttcaacccttgccctgtgcaattcaaattgccccccggctgttgtacccagcccagtcctccttcttgacccccaacacggccccccgtcccgaggcctagctttggccaacgtggaagttagccctccaatccttcccgggccttggggggcaaaacatcctccatgaaggcatttggggaatgccttgaacttatccccagggaacgaaggcctgacagcttggccttggaattgcttccccggctgcgtgaaccccaagggctttggatgtggtgc

SEQ ID NO: 700616 - DNA, 1127 bp, Homo sapiens
  misc_feature (90)..(90): n is a, c, g, or t
cagtctctttccttttttgctgatgtgtgctctctctctctctttctctctctctctctctctctctctctctctctctctctctgtcgngtcgtgtctcgtctctcgtctgtctctctctctgtgagggcatgtgtgttggaaaaaacgtcggagagatgcccaagaaccctgggatatttctatattttttgggaaaatagagaggagagaggaaatagcagcactcttagtcagttgtttgctgctgtaatctgcttcaattactaaagatggttgttgttttataaagacgatgttgctggatgggagaaggtagtatgttgctgatgctggtggagcagtgtgtggcagtcagttcggctcggcatgacgtgctggtgtgatgtagagtaatgtatgctcctaccatatgcacgtagaggcgtactaaataagcacggtacatatgtaggtcatacgttgtattatcatataattatttattagctgataccaaaaaaagaagagaaaacaacaaagtgcatttagacagaagaaagagagcagtgtggatggaagtcaggtttgctgcagaaaaggagaaacacaacgaagcaattagttcgcgtgagagagtaaatgactgagtgagcacagagtgggttcccccccagtaaggtgtggaggggggtgagtgataaattctgttgcgtgagaaagtaagttacaggatagatagtgagctggtgacaatcccttttgttgtatatctagagagagatacttgaaagtttgtagacagagaggcagggcaaatagcgagggatggaaggaaaaaaaaagcgagagtagttagggaagtacttaggaaccaagtgattgacacgcagggtgttggttgtattacacgcgtgacagcaagtttttctctttaggtacacggggcaattatgtctccgcggtccgcagggaggaaatgactgtggggggcactgtgggggggaattggacggagaaccaacaaaggggggggggatacaacgacagtggggggtgacttctcgcagggggcgagaaggagaagcactgggagggcacattaatgacaggatacaaggcacggggcagtgaagtgaacaagatgc

SEQ ID NO: 700617 - DNA, 264 bp, Homo sapiens
aagtcatgaccagttttaagtgttctttttcgttttttaaattgagacaggtttcgctctgttgcccagggtggagtgcagtggcacgataacagctcactatcacctcaaactcaagtgatgcacctgcttcagtctcccgggtagctaggactacaggcgtgtagcaccacacccagctaatttttaaaataatttgaagagacgaggtgagatctcgctatgttgcctaggctggtctcaaactcctggcctcaagctatc

SEQ ID NO: 700618 - DNA, 605 bp, Homo sapiens
ggtacccgcccgcagcgtgcgtccccctacgtgttctttacacgggcgctcggcatgtcagcattctcccttgatcacttcgggggtcaacacgccgcagagcgatgtttgtgtcgtcacgccacgccaggcatttcttatggtgactccggacaacatttgggacagcgcccttctcctgtctcagtcgggcagcccccatctctctcgggtcctagcacacagcatctcccacacttgcggggggaccttgatattctcccccaaaggccccctgggggttcttctggccacaacaaccccgacaatgtcgacactcccgagcagcaattactcccatgaactttgttgcacccacgagtcgcgaggtgatgacccctgagcccaatctcggcgtcctcctcataatcatgcgcacgactcggccacaacccccaagcactttcgaaccgtccttggcccccttacggaaaatgataggaggtcttccttcttcacatcgcctttcaccgagggattcttgctttcgaaggccccccgggacccggagatcccaccggggggaggggaacccaaggggattttaataaaactctaacataaca

SEQ ID NO: 700619 - DNA, 893 bp, Homo sapiens
gagtcgatgctcaagttccacatgtgtgtcacctagaggttataggcgctgtgtctgaggagtacatgtggtttatcacccagagtgtatgccagatcactccgcattggaacggatgaggaacttgagcctgccgctcaatcaattatactaggacaattataggcagtgctttccttgtcagttctctcataactagggtaattattctagcggctgtaaaataactggttggtctagcggagtccttttggcctatttcctttggacaatggcaagacgtccctatcagtcctggctgagctgtgggcgcagactaaaagatataggttatgtatgacggtgtatgaatgggtatctatcatctcatttgaaggcacatgaatgaattagaagaaatggagacagggttatgggttattattagtggtggcgattttgcaggagtatacttttaaaattgtaatgatcaatcatgtgttggggtcataatagcatggaagatctggatgcttacctatgccagtggcagtgagcaaaacaaatagtagttagcaaaactgtcgtaagaagcacattagaaaaattggatacgactctacattggtcgcactcattgggatttgcataattgcccccaaccatctcagtcccgagtcgataaagcatccaacgctgaatcaagggacctggaaaacactcccttttgtgagcagtctaaggggggagttccacttagccaactgaagcccaccgcggatcgacatagagcgcttaatcgaaacgggccttggttacctagaaaggaacaaggcacacgcctcgtcacaggtgacaatgaaccccaggcaagtgctccttgcttttgggccagcgctcgcggtgggtcaccg

SEQ ID NO: 700620 - DNA, 147 bp, Homo sapiens
cagtcttattctgcaccacagcctccgagtagtatggatatacaggtgccaccatgacgcccagctaattttcttatttttagtagtgatggggtttcaccatgctggccaggatgatctcgatctcctgacctcgtgatacaactg

SEQ ID NO: 700621 - DNA, 268 bp, Homo sapiens
ttgtgaagaaccacgtgagattgctgctataccatggtggactttaaaaacactgtatacttatgctacagtgaaatttctgaaaacatatacttctatcttcaaaaatcaattaaccttagcttcctgtaacttatttacttacactactgaattatttataacttatcgactcttgtactaacatttggcttaaaacacaagcaaggctgcccacggtggctcacacccataatatgcagcactttgggaagccggacaagaggat

SEQ ID NO: 700622 - DNA, 873 bp, Homo sapiens
agcggggggtgcttggtagtctgagacttcccggtgtgacgtgacggagatccagcagaacgctcctgagttccctgcccaaggactcgggccgtgagaacctgcgaatgttatcgtcagaagactcctatgaagggacgcgggccgtcctttttgagggcctgagtgtgccggggtcgcgatcactgacaggagatgtaggattgatccggatccgcatatatttccctgaacacgcttgttgtgacctccgtagttgatccttcgtcgatgcactaagatagtcaccaatctgggacggtgcagactggccttgacatgcgctctagaaccagagtgcgcagagacatctatttacatttcagaagccccagagaccaaatctttgtatcattgcgacccacgccactcagttacattggtttacctcgaaaaccactaagcaaggattgtcatccatctatcaaaggcatgtagggcccccgtcaagccaaagaaggggcacctcagtgaaggtcatctaatctttgcgataaaagccgtatcaaacgatgtattaacatgattcttaagatctatcattaaatctccatccactgaatagtttaaaatatcaagaccacgccccctcgtgaacgattatgaattatactctcggctttttaaaaaacttccccaagttgtgcactatcatttcccacaatcacaagattcgccgttttgaaacacagctattacaaattgcgattatgtccaaagccaatacaaaaccggtgatctcactgaagccaagctggctctcgcacactaatggcaattaatcgcaccactttacagctctcccattgaatggcgcgacccaagggctcggag

SEQ ID NO: 700623 - DNA, 258 bp, Homo sapiens
tttttaataatacctttgcaatttctattttcagagagagctatgtgcatacatattcaaggtcagtctagttaccctgatgttataaaacagctgatattttagattctagtagaaaataaaatcttctgaatttgattagcaattgattagcaccttactccggtttggatctttgaacatatacagaaagcctttgggaattatggtaactgaatttattaggaaagatcatggtaagaaagagtgtcgacgcgg

SEQ ID NO: 700624 - DNA, 174 bp, Homo sapiens
ccatgcaaatatagcatctggttttgaccatggatgcattacaatgctcaaacatgcatcactatattctagtctaagggaaaatcttacccatggccttatctcgcaatttagagggaaagcccacgatgaatttcacatacagtattcctttcttctaaattaactctcaaa

SEQ ID NO: 700625 - DNA, 826 bp, Homo sapiens
ccaggttctgcagtcagcaggcagatgatgcatatggagcgtagactgagtcgtcctccaggcgatgcaagttgagggagaaagggcgggcccgggaacagggctgaggctgaggtgggctccttgaaccgtaggatccagctgtttgaagcaagatgcgtggaccgtgctcaggagcgcctggtcactggcctgctaaaagctggaagcatagctgaaaaagctgctgatgagagtgagagaggtatgaaggttattgaaaaccgggccttaaaagatgacgaaaagatggcactccaggaaatccaactcaaagaagctaagcacattgcacgccgcaggcacgatcggacgtcatgaagaggtggctcgtaagtaggtgatcattgaaggcgacttggaacgcacagaggaacgagctgagcctggcaggagtccgtatgccgagagatggatgagcagcattcgcactgatggaccagaacctgaagtgtctgagtgctgctgcaagcaacagtaactcttcacacaagcagatacaactctgagggaagcaaactccacgcacttcttactgattacaactcaacggacgccgaaacccgtgctgagtatgctgagagatcgggcgccaagcggcacaagcaccaatgatggacagtgaagaataacctggaacatccaccagagcagtaggcacctcgtgacacaaaggatgctggaccaaaacgctgattgaccctgaactgtaatgtgaacggcccacaccaaactgactagtgatcctcacatgacacaaaacgccgatgtcgcgtgcgaacaatgc

SEQ ID NO: 700626 - DNA, 203 bp, Homo sapiens
ctgcagcctctgagaaccagtgttctggagactgagacatccaaggttggcggggggcacatctgggaaactgggaaactgacacttcctgccttatattgttgcagttgcaaagatcaaataccaaggttatgggaagatgttttgaagccccatataaatatgtaatttaatttattccaataaagactcattgcacaggc

SEQ ID NO: 700627 - DNA, 181 bp, Homo sapiens
gctcgactaaaaacaaacaaacaacagaaaaaacactcactgagcgctgggtgcagtggcatgcacctggtaatcctagctacttgggaggctgaggcaggagaattgcttgaaccgaggagttggagaccagcctgggcaacataatgagatcccatctaaaaaaaagaaaaagtcgacg

SEQ ID NO: 700628 - DNA, 1048 bp, Homo sapiens
ctagcattcaccatctcacttctaggaatactagtatagttcgctcacacctcatatcctccctactatgcctaaaaggaataatactatcgctgttcattatagctactctcataaccctcaagcacccacgtccctcttagccaatattgtgcctattgccatactagtcttcggccgcctgacgaagcacggtgggcctagccctacatagtctcaatctccaacacatatgggctagacatacgtacattaccctaaacctactccaatgctaagaactaatcgtcccaaccagattatatttactaccactgacagtgacttgccaagaagcacataatttgaatcaacacaaccacccacagaccattaattattagcatcatccccctacgtagttttttaaccaaatcaacaacaacctatgttagctggttgcccaatccttttcgcttccggagtcgccctaacaagcccgcgcctccataagtactaagactatactgacatctggtacccccctcaacaaatcaatggcacaggccactcgccggcattattccaggttgagaccactatgtacgcaaagaaagatctcctacctctctatacgaatctgcctacgaaatctcctttaatgaataaccattgcacgggcaccagaactaatcagtatcttatagtcttccttgcgaaaatgcgcacacgttattccacgagctggagcctatcatcttcgccgaggagggcacccgccaggaaaaggccctgaagggctaggagacaatccttcttagttgtagaccactatgtaggctccggtgcgctatccatcggacgtagttacctacccgcacgctagggtacgtaagcatgcaaattacaatatcgtgcacagaacaatcaagtcggacagaaagattaatgtcacagcggaatagagagtagcagctcgagcatgagcctgcagtcgaccagaggtaagatcggcacaacaaggaagatagggaatcgcgaaaacgcgacaggaaaaacacatggataa

SEQ ID NO: 700629 - DNA, 353 bp, Homo sapiens
  misc_feature (50)..(50): n is a, c, g, or t
  misc_feature (103)..(103): n is a, c, g, or t
  misc_feature (135)..(135): n is a, c, g, or t
  misc_feature (240)..(240): n is a, c, g, or t
  misc_feature (243)..(243): n is a, c, g, or t
  misc_feature (256)..(256): n is a, c, g, or t
ggaattagaccgtctccactggtgccatcaatgcctcaattcaactgatngcttcctagaggtgcactgtccccaggtgtgagtggatctttctagacccttngctgtgccattattctacattcattatgtctnggaggttgctgtatgtttaacagataaatctatttgcatcttcttacatactacatagaattctaggctgggcccagtggcccacacctgtaatctgagcacttnggnaggcagaggcggncggatcacaaggtcgggagttggagaccagcctggccagggtggtgaagcctcatctttactggaaatacaaacacaaaaaaaacattaagcgggtg

SEQ ID NO: 700630 - DNA, 1133 bp, Homo sapiens
ggaagaggcgagaacgacccctcggtaccgagcaaagcccgcgctgcgcatgcatccgcgacgtccagcagctacgtcccgctggcgtcgcgcgcctgccatcatgcccgaagtagaaatggctgaaggtggctgctaagggcgagatcagagcacaagtgtgaacgtgacgacaccacacgagaagatccagcgaggtttgtcttgctaaacctgctcctccatatgccagagccgcagagcctaagaataggcccctgcgacagaagggagatacaggtacccaaagggaacatgagggatagaatgctgatgctggctatggacgggcactcagcctgcagaaaattggagatgccagggagacagaccaggcacgagaaacgctgcaatggtgctgggagcatgccaatgtgaacgtgtgtaggcattattggaataaactgtggtactgtctgggtgagcatgtagcaggatttgacaagtactatttgtttatcagggattgtgactaacaaagtgcaggaagttatggtacttacgtttataaatataattattataaagaaggatattgtgggtaaagacaacacagctgcaagacacctctccacagagatgcagttactacggcggcggccaacggggggcgcactattgctcacgccataacataaagccaaacaggttcctacccacaacggacgaggacacttgagagatgttgggcagcaaacatacagaagacgttgttacccccttgcataaggacttagcagacgacacgaacatacacctacgtggggaattccccaccaaggaggaaggaaaaagggggacctacccgcacgtagaacgtgatgaggcaaccaggccagacaagtgggggacacacacaccgaggtgagcagacaacagcaaacagagaccccgatggggggggcaaaaaacacgacacgatacaacacgaacaaccagctgagggggcgagacgaaagaggaaccccagacggataggatacacccacagatgatgcacaagttcaccttgtaccgaacggacacaatagagacaccgatatagagaagctcccgcgtcgaaagaccaccagaggaaacacaacatcgggagg

SEQ ID NO: 700631 - DNA, 1432 bp, Homo sapiens
  misc_feature (179)..(180): n is a, c, g, or t
  misc_feature (184)..(184): n is a, c, g, or t
  misc_feature (187)..(188): n is a, c, g, or t
  misc_feature (190)..(191): n is a, c, g, or t
  misc_feature (193)..(193): n is a, c, g, or t
  misc_feature (195)..(195): n is a, c, g, or t
  misc_feature (208)..(208): n is a, c, g, or t
  misc_feature (452)..(452): n is a, c, g, or t
  misc_feature (499)..(499): n is a, c, g, or t
tttaggtttacactaaggtacctgatgacatgtgtctaccattgtctgtctatagttagtaatttgtattgtatgacccggctggtgtgtgctttttggttcctgccattcaacatgtttggagtgtatactttgcccttttccccttgtactcccttaggttttgttagttgtttttnncctnccnnanntntngtcccaaaacgcnttagccacatgccaagcttatattaaagtttgatgctttctcccagttccaacacatcatagaaaagagctttcccgagacccttgatgcagctttattatttagtcttgctttatttggcattttgagctccttcttttgtttacatctgtactataaagtgaaacctgaacctggggccccctatgaatatataagtgtcttagtgattttgagtttatataaactgattatattgttttcnaagtttaatgagatcttccacttctatctagttagtgcagatgtccnaattaaaatatttccctcttatactaaaatgccgcattaattttaggccattgaaagctgtaccttatcagaggtaactccccttaaccaggataactggtttgaagaaagttaagcttaatttttgtaatcacagattaacttaatttgtgataccattttaactttgagctcttaagtaaaaagtagcagcattcctaagttgtggggtgaagcatctgtttcataacacaggtctatcataattgggttctgtaaatgtaatggttctctaaacattttaatgcccaggcttgatattgtacacaatgcaagatgtctaaaatcttcatttagaattcaagggtattgcttgctatttcacattatatactttttaaatactattgctctttgtatatgaggcatttcactaaccttggatcattggatcttaaacatgataatatagaatatctgaacattgggacttgttctttagagtatatggcctttagttcttgtggaactaaatacagtgattctaagatcaaaagtcttagtgtttggggtttttttttcctctttttggatatggggtgtctactcttggttactggtattcttttttaaagcataatgctgtaacaacctgtccaagcttatgtttggcgggccgatgggtttaacacctgattttcatgtttccaaatgctagcataatcttagattggactatccgggtgactgtagctacgttaaggtaccacatttggtctaaagtcacagttcatatagtatttaacctatttcagatgaacgttacattcttgaaaaccagttattcctttcgtccattaaggccgtgtgttttaacgccaaattcacgagttccttcacataagggttcaccattctttctaaaaaacaacacacgacaaacacaacacaaaa

SEQ ID NO: 700632 - DNA, 357 bp, Homo sapiens
  misc_feature (75)..(75): n is a, c, g, or t
  misc_feature (275)..(275): n is a, c, g, or t
  misc_feature (329)..(329): n is a, c, g, or t
  misc_feature (333)..(333): n is a, c, g, or t
  misc_feature (336)..(336): n is a, c, g, or t
gacatattcttttgactaattagaccacttatggctgggattacaggcatgagccaccacacccggcctctgctntgttttttaaaaagaaatgcaagagagggagggaggcagcctcctgaccattgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtanagacagggtttgattatgttggacaggctggtctcctcctgacttgtgatccanccgnctnggcctcccgtgatgggactat

SEQ ID NO: 700633 - DNA, 869 bp, Homo sapiens
  misc_feature (213)..(213): n is a, c, g, or t
  misc_feature (306)..(306): n is a, c, g, or t
agcgggggcggacccgtcccccctgcccctggatcgctcttataaagctcccctgagccagtgtgctgcagctccttctacattgtgactccgcagccggggctatttcttggacgctggcgccaggctccatacgaagggtattccgcattatcgctacccagggcgtgactggcgcgacaggacagagagtcactaggacacggtactctncaagacggcccatgtcaacccgtccggcttcactccgggcaatgcgcctggatgaccgcgctagccagaagtgactcgtggcgggcacgacgncttcagtgcatctccatgtcactatggcactctttctcaccatgctcctttacgaagaacgcgagaactgatgagtcgagtccgatgcctcgaccagtcctaggtccatgcgccgttgtgcgcatcctagaggtcgaccgtgaatagagggaccgagcaacttgacgtaaacgccgtggagccaggcggccaggagcgcgctgcataagtcagaccgtctcggatcgagctcctcgttggaccagtcggcctggtgtcagtggatgctcgagacatggtagcccaggcggaaggtgcacaacaaccgtaaagatgacccctcagcggcggcccggacccgagaaggggaaaggcaaaacaagcagaagggttgcctgacccaaacgaaccccggacaaaaacgcagcccagcaaacgtccccagggaacacggacacactccacagggtggtcgaggacccgcagttaacaaacctgggaagacatgcggacggaaagaagcgcaggggccatctacgcccacggaagtcctccgcgagcgcagggcagccaggccaccccac

SEQ ID NO: 700634 - DNA, 1109 bp, Homo sapiens
  misc_feature (129)..(129): n is a, c, g, or t
  misc_feature (176)..(176): n is a, c, g, or t
ctaaaattaatgcggcattttagtataagagggaaatattttaatgtgaaacctgaacctggggccccctatgaatatataagtgtcttagtgattttgagtttatataaactgattatattgttttcnaagtttaatgagatcttccacttctatctagttagtgcagatgtccnaattaaaatatttccctcttatactaaaatgccgcattaattttaggccattgaaagctgtaccttatcagaggtaactccccttaaccaggataactggtttgaagaaagttaagcttaatttttgtaatcacagattaacttaatttgtgataccattttaactttgagctcttaagtaaaaagtagcagcattcctaagttgtggggtgaagcatctgtttcataacacaggtctatcataattgggttctgtaaatgtaatggttctctaaacattttaatgcccaggcttgatattgtacacaatgcaagatgtctaaaatcttcatttagaattcaagggtattgcttgctatttcacattatatactttttaaatactattgctctttgtatatgaggcatttcactaaccttggatcattggatcttaaacatgataatatagaatatctgaacattgggacttgttctttagagtatatggcctttagttcttgtggaactaaatacagtgattctaagatcaaaagtcttagtgtttggggtttttttttcctctttttggatatggggtgtctactcttggttactggtattcttttttaaagcataatgctgtaacaacctgtccaagcttatgtttggcgggccgatgggtttaacacctgattttcatgtttccaaatgctagcataatcttagattggactatccgggtgactgtagctacgttaaggtaccacatttggtctaaagtcacagttcatatagtatttaacctatttcagatgaacgttacattcttgaaaaccagttattcctttcgtccattaaggccgtgtgttttaacgccaaattcacgagttccttcacataagggttcaccattctttctaaaaaacaacacacgacaaacacaacacaaaa

SEQ ID NO: 700635 - DNA, 242 bp, Homo sapiens
  misc_feature (42)..(42): n is a, c, g, or t
  misc_feature (57)..(57): n is a, c, g, or t
  misc_feature (178)..(178): n is a, c, g, or t
  misc_feature (203)..(203): n is a, c, g, or t
gctgagttggtactttttttggtcctatttcacaagggttangatagattaaccaanaaaggacaagtgacagactgaaaggggctggaaaaacaaagaggaaaaggcctgtcacttctgtatagttgatggttcctgtcacaagcccaggtcacaaacagattaatttgttttatantgtttatatgctatttagaatgttnacaaaggaacgtggataaaatacagtttctactgcctcc

SEQ ID NO: 700636 - DNA, 800 bp, Homo sapiens
aaatggctggacatggtggcgggcaccatgtaattccagctacttgggaggctgaggtgggagaatctcttgaacctggggggctgctgtgagccgagatagttccatgtcacttcagcctggggtgacagagtaagactctgtctcagaaaagaaagaagtacggcagaaaaaaaacacgaactccttgggacgaatcaaacacacggtctccgaggaaaatgttgggtccatggggctacctagaattcggacgaccattcgggtctgggtacgcataccactttgtccattaatatacttacgtcctatcgacgtcgtttctatagttttatgaagttcacataagtagacacatggtatcgccggggagtcactgggtagacccttattagaaatgcagcttctgatacagggagctgggggtgggcgcctgagagatctggcattatctcccaggcatccctggttgctagccagatcgggtgctgctcctgcagtaacaaaggtggggtgggagaaatcgatatggagccgctcccatcatttatagtccccatctgtggacaaaattgacgctcacaagaagcgcccataggggttacattgaagagctgggggctccaaaggccgggaagtccaggaaaggcatgaggcaccgcaagggcaacaaaacactttaaccggccacagctggcgaagcaacgggtacattaatgaaaggagccctgaaaactcgggcagggaaacgcggtggaatggagccacaagaaggctacggggggcccacgaaaccccgg

SEQ ID NO: 700637 - DNA, 175 bp, Homo sapiens
aggggtgcacccacaagaaggatgacccttcctcgtctggaagatgatgagaacaacgaacagcgaacagatgatatccggtggcggggaccaagaattcctgaaagtcgaccaaggaacactataggacctcatgcgggctgcaaggctacttagacatcaaacggttggctgg

SEQ ID NO: 700638 - DNA, 102 bp, Homo sapiens
  misc_feature (38)..(39): n is a, c, g, or t
gggcagtttttgcttttattggtcaagaattctttcannaacccacacacacacatccacacacacacacacacatgatgcctgcccttctgtcgtcttctc

SEQ ID NO: 700639 - DNA, 563 bp, Homo sapiens
agaaacaagcaggagtcgtcaggtaaaaggtggcgagagccacttcagaaagatgggcattaccttgagaagccaaatgtactcatcaactatgaccagccattctgttcctagctccagactctagcgaaagtcttgctcacgccccaggtgaaatgtatcagaaggtaatcccacgcccgtcatcccagcactccaggtgaaatgtatcagaaggtaatcccacgcctgtcatcccagcactccaggtgaaatgtatcagaaggaatccatgcctgtaatcccaacacttggggaggcagaggcgggcggatcacttgaggtcaggagttccaagaccagcctgacagacatggtgaaaccctgtctctactaaaaatacaaaaaggttagccaggtgtggtggcaggagcctgtaatcccagctgggatttgggaggctgaggcaggagaatcgcctgaattcaggatgcagaggttgtagtgagccaagattatgccactgcactccagcctggacgacagagcgagagtgtctcaaaagaccaagagcgagtgacagg

SEQ ID NO: 700640 - DNA, 328 bp, Homo sapiens
tctagagtatccccgcatgtcacgcgcaaacgtgggtgggcaacccacgcttccttcacacacaggcggcagctcctcagccacagagcagccagcgcattccagctcttcccactgagacgcgggttagagctccagagccgctctggccacgacagtggtgttagacctgcgcagcttcctcccgggagaccctggtgattctaggactagactaccaggtgggccaagatgaaggcggcatgtatcgtgaaagacaagggctctgctagagagtgggcaggtcattcctctggccaccagttgacactccccacggttttgcggc

SEQ ID NO: 700641 - DNA, 346 bp, Homo sapiens
cttacttggaaaacccctgcgggagggtaccaggggctgtaatggggaggtaatggagagttattgcttgatggttagtttctgtttggatgatgaacaagttttggacataggcaacagtaatagttgcacaacagcgtgaatgtaattaatgccagtgaattaaccacttaaaaatggttgcaatggccaatttcattatatatattttaccatatttttttgcatttttttggagagtgagtctcactatttggcccaggcgggtcttaaaccccggggctcaagtgatcctccggcctgggcctcccaaagtgcgggggtaataggtgtgagccccacccct

SEQ ID NO: 700642 - DNA, 241 bp, Homo sapiens
cttgacttacaggatcccggtgcagtggtactgtgtgggtgtagtggtgactgtgggccagagaaaggaggtgctgagcccagaaaagacccaggccctcagcagcgtcgtgactgggcacaacaagcgacttgggcacccagacctacatctgcaacgtgaatcacaagcccagcaacaccaaggtggacaagagagttgagcccaaatcttgtgacaaaactcacacatgcccaccgtg

SEQ ID NO: 700643 - DNA, 475 bp, Homo sapiens
  misc_feature (35)..(35): n is a, c, g, or t
  misc_feature (182)..(182): n is a, c, g, or t
  misc_feature (334)..(334): n is a, c, g, or t
  misc_feature (441)..(441): n is a, c, g, or t
  misc_feature (447)..(447): n is a, c, g, or t
  misc_feature (463)..(463): n is a, c, g, or t
  misc_feature (469)..(469): n is a, c, g, or t
gtaatgggaacttagtttttcctgaactccaaccngaatccaaattggttagatgaggccaggcgccgggttgtcacgcctgtaatcccagcactttgggaggccgaggtgggtggatcacctgaggtcaggagttcaagaccagcctggccaacatggtgaaaccccatctctactaaaantacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaanaaaatcggttagatgagaaagcatgtatattttctatatacaaaaacaagaaaggcgttttgagcccctgtgctcaggcccactcccacactgtggagtgtactttnattttnaataaatccccttatnccttcnttacaa

SEQ ID NO: 700644 - DNA, 307 bp, Homo sapiens
tagagtatcaggttcactaatctattgtcatgctgtagcctatgtaacgactttggacttgatgaatttcaaagaatactttatctattgctatgagcctgtcagaataaaggccaatatataatgtagtgacatcatatctgataaccagaggtctggtatctacactcctggtgccccgtcagtggtagtctccataagtcatcttgcgtgattaaaaaaaaaaatgaattcctgttgttgacattctaggacactgctttctccacagaaggatgctgatatcaaaaacttgaagatacaggga

SEQ ID NO: 700645 - DNA, 203 bp, Homo sapiens
caccctgaagcgagcattcagtaaaaggcactgttgggatgttgtacaggggaggagagtgagctcgcagcatggagccggtccaggacacctaccgcccgccactggagtacgtgaagggggtccctctcatcaagtactttgcagaggcactggggccactggagagtttccaagcttggcccgatgacgtgctgatcagc

SEQ ID NO: 700646 - DNA, 529 bp, Homo sapiens
tacgacaaagcaatcagaaatagatcatgagagagatgatccgtctcctggcatcagggttttaaacatcccagagaaaggggaagtgctgacttgtgggaagcccctgatgtccgtcatgtggttcagggagtgggtactacgatagtatcataggagatatgctgactgtggcacaaatttcgcgtcacgcccatgacattctgggtcatcatggaatattggagcgaatatgcaggaagtgtgaaagtgactatctgcttcagataccccatgatcccactgggcagctctctggtctattccccatgactcgtgcgctccttagccaggctagtagatgcacgctggtcgtccccagcctggcaggaggtggctgggttaggatccaaagggcaagtgccttgcagctgctccagggcaattgccccagaaccacactccagttggcccactgattgtggctgtcacagccctgtgccagggctcctaatgggaggacaccctgggacaaagaggaaaaccagaa

SEQ ID NO: 700647 - DNA, 219 bp, Homo sapiens
ggccctcccttgcagacatcaacagtttccaaaaaattgggttcaattccttcccccggggccccccaaccaaggaggtggcaaaaccccctaaccaaccaggagaacacaaacccggtttgtttttttacaaccaagtggaactgacggggccggggcctgccctgggggtcccctcccttggttgaaaaaaaaaccaaataacccttggcccgccca

SEQ ID NO: 700648 - DNA, 151 bp, Homo sapiens
gcagcagtctcgagcatttccggcatcccaggtcctacccagtgctttgaggagacgcttccttgtcccatacacagtgtgacgtgtactaagatatggagttcgttaacaaattagatgagctgtgtgccttttacaaccttcacgtcct

SEQ ID NO: 700649 - DNA, 526 bp, Homo sapiens
tgtgactgctaagacgtatgccatgactaaacttctgctgccttctttgttccaccaagtaatacccctactctgagacttgcaaataactattctcttcataagaattctctcctcagtcgggcgcagtggctcactttgggaggccaaggcaagcagactgcctgaggtcaggagttcgagaccagcctggccttaggcaggtgctgaaaccccgtctctactaaaaatacaaaaattagccaggcagccaggcacagtgcctcaagcctgtaatcccagcactttcggaggccgaggcaggcggatcacctgaggtcaggagttcgagaccagcctgaccaacacggaaaaacactgtctctactaaaaatacaaaattagttgggtgtggtggcacatgcctgtaatcccagctactcaggaggctggggtgggaggatggcttgaacccaggaggtcaaggttgtaaggttgtagtgagccgaggtcacaccactgcactccagcctgggcaatcaagctt

SEQ ID NO: 700650 - DNA, 921 bp, Homo sapiens
caaagaaggacggacttcggtgttgcacacgcgtgattgtgaagatcactggatttactctcgcttgttggctcgtctcactgttgttactttttctctctgtgttatgtcggatagactagtgtggcggggtagacggaccaagttgtttctgctgctgcaacgtattacgactttttggtgcttcccggggcgcatgattattacacgatatgttgtttgagcacaccagccagtttcgcctcggtgaatgtggtcagatctgcccccatgggcccgtgtggtgcgcggccagttcggcccgagcccgccctcggttttccccgcgggcccgtatatttttcatttttggccccgccggggggtacacgtcgactggatggtgcggcgctgtgccgagtctcgtagctgtgtgggggcttgtctccccggtgtcggctgtattggtctcctcgtctctccagaagtggtcccaatgggtttttctactctcccccgtaatatgggctctgtttggtaggaggcgcttcttcagccacggcgcgctttgcgttgataccgctctgcgtggtatcccccgctcctcgtgtttactcatgcttggggggaggacatcctcttcgtggtaatggtggaactccccgcttctcctcggggcctcccaacaaggcagtcttgctgggacttgtctagggcgtcctacgacaacatagtgttccccgccctatattcttcccgttacaaaattgtttcgcccgccacaccacagggggtccaccctccccccccacctgtggtcccagactcagtcactccctcttgcctccccaccagggccccccccttttttaacacccttcccccctttttccccattcccccacccccccaaccttccgggggtttcctttttaaaaaaaa

SEQ ID NO: 700651 - DNA, 609 bp, Homo sapiens
gtatcacttatctgtataattcttgacaatcaccctacctgactccctgtttgctcttgataaggacccttgtgattagatcaggtctaccagagataatccaggataatcttccgatctcgaagttcagctgattagcaagtcttaagttccatctgacaagcttaatgtcttccttctcatgtaacataacatattcagcaggtaccaggcacgtaggatatggacatctgtgtgagggagtgcatcatttttatggaacttgatggcccagcatatgattgatgttgggaaatgttcgtatgtacatgtgaaaagagcactgaactctgtccttgtcggatgcagtgctaggatttatatatatatcacttagggcccatgtttgtcaaagtctgtagttgaggtcttatatatctttagctgctcttttgtctggtctatcagatggttttcaaaagataagttaaaatcgccagtatgactatggaggttgagtatcttccttatcaatttggtcgattgttccctgtgtatatggggaagctgtgtatgagatgcgaacaagttgagcatggtgatatcttgcctttttgagtcgctttagca

SEQ ID NO: 700652 - DNA, 372 bp, Homo sapiens
  misc_feature (36)..(36): n is a, c, g, or t
  misc_feature (69)..(69): n is a, c, g, or t
  misc_feature (80)..(80): n is a, c, g, or t
  misc_feature (118)..(118): n is a, c, g, or t
  misc_feature (125)..(125): n is a, c, g, or t
  misc_feature (176)..(176): n is a, c, g, or t
  misc_feature (179)..(179): n is a, c, g, or t
  misc_feature (188)..(188): n is a, c, g, or t
  misc_feature (190)..(190): n is a, c, g, or t
  misc_feature (207)..(207): n is a, c, g, or t
  misc_feature (209)..(209): n is a, c, g, or t
  misc_feature (225)..(225): n is a, c, g, or t
  misc_feature (254)..(254): n is a, c, g, or t
  misc_feature (270)..(270): n is a, c, g, or t
  misc_feature (277)..(277): n is a, c, g, or t
  misc_feature (279)..(279): n is a, c, g, or t
  misc_feature (287)..(287): n is a, c, g, or t
  misc_feature (304)..(304): n is a, c, g, or t
  misc_feature (343)..(343): n is a, c, g, or t
gggcggggggggccggggtgggggggggggtcgcgngtcccgtccccgggcgtttttggcccatacccntgagtatttgnctaaaacatgtcttctttgtagcagctaggccctgccnccactgngcttggctgagttcccaaatctgttgtaccctggagcttccctgtcacttntcnggctccccncncctgctaagctttgttncntaattaaaatcttctnccactgccatagctactgctgctgctggnaccgccatagcccccntggcttncntggttttncaaagtattggcccccnccgccataggggccagagcttctgcctccaaaatttccncccttcatgggtccaaaatttgaagcctg

SEQ ID NO: 700653 - DNA, 388 bp, Homo sapiens
  misc_feature (146)..(146): n is a, c, g, or t
  misc_feature (195)..(195): n is a, c, g, or t
cccaaggggcatccccaaatccctgaggagtaccagctgcaaactggtcaagttctcagtgagggccagttcactaaagttttgttgtaagaccctgttgtggtggcatttctgggtgcccattacaacttgtgaaccaaaaaagntggcatggcgctaacccttgggccgaaacttggtctcttggctccctcnttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaata

SEQ ID NO: 700654 - DNA, 1065 bp, Homo sapiens
  misc_feature (57)..(57): n is a, c, g, or t
  misc_feature (66)..(66): n is a, c, g, or t
  misc_feature (77)..(78): n is a, c, g, or t
  misc_feature (365)..(365): n is a, c, g, or t
  misc_feature (472)..(472): n is a, c, g, or t
  misc_feature (477)..(477): n is a, c, g, or t
  misc_feature (547)..(547): n is a, c, g, or t
  misc_feature (559)..(559): n is a, c, g, or t
  misc_feature (572)..(572): n is a, c, g, or t
  misc_feature (609)..(609): n is a, c, g, or t
  misc_feature (777)..(777): n is a, c, g, or t
  misc_feature (795)..(795): n is a, c, g, or t
  misc_feature (799)..(799): n is a, c, g, or t
  misc_feature (801)..(801): n is a, c, g, or t
  misc_feature (807)..(807): n is a, c, g, or t
  misc_feature (813)..(813): n is a, c, g, or t
  misc_feature (836)..(836): n is a, c, g, or t
  misc_feature (858)..(858): n is a, c, g, or t
  misc_feature (878)..(878): n is a, c, g, or t
  misc_feature (884)..(884): n is a, c, g, or t
  misc_feature (891)..(891): n is a, c, g, or t
  misc_feature (894)..(894): n is a, c, g, or t
  misc_feature (901)..(901): n is a, c, g, or t
  misc_feature (904)..(904): n is a, c, g, or t
  misc_feature (912)..(913): n is a, c, g, or t
  misc_feature (919)..(919): n is a, c, g, or t
  misc_feature (924)..(924): n is a, c, g, or t
  misc_feature (937)..(937): n is a, c, g, or t
  misc_feature (951)..(951): n is a, c, g, or t
  misc_feature (955)..(955): n is a, c, g, or t
  misc_feature (960)..(960): n is a, c, g, or t
  misc_feature (962)..(962): n is a, c, g, or t
  misc_feature (966)..(966): n is a, c, g, or t
  misc_feature (972)..(972): n is a, c, g, or t
  misc_feature (975)..(975): n is a, c, g, or t
  misc_feature (1034)..(1034): n is a, c, g, or t
agggagagccctagtcttaagtttgtttctttttttcttctagtatggaagttgaanagctgtgtnttaataggatnnccttaggataagaggactgcttttaaagatacgagatcccgctgccttggcaattctgttatcagaaagatagtgattttgatacaaaacagtaagaaactgtagaattgcaggacccataatcctcacaaggaagatttagagagtgctgtgtgtcaatcactcatcagcacctcacagatattatctcaattcgtcctggcaaccatcactgcccctacttagcagtctcagagaggagactcaactcacacaggggccaagagctggaccacggccaaccaggnctccccacccccaccccagccatgcctctccccaccacaacagcacccggcctgaccctagtgtccaggtctgtcccggtggcctccaaggaaatgggacaaaacanccttnctgccaactgcaggggcagcagaacgccacagtggttgagcatgggctctggtgaaggatggcgggggtncaaatcccagtnctccacctctctncttcgctccgattcctgggcctctgagctggtctccnccgccgtggagtaacagtgtgactgctcatctgcacagattccttctgtgctggacacggttccaactttccaactactcccgcaggagctcatttagtggagacaagatcttgctcagtgtcatagtgaggaagaaatggaaatatctgtgcagggcacaagcccgncctggtgcgggagaggcnttantnaacgcngcatgngttacgacgccggaggactgtanctcccacagcctggcttcctgntggagtctccaccgtaatgngctacnattcctngcncgccccncantcccgacnntgacantaccngtggtacccccgngccccgcagcggcncctncggcngnttcngcggtngcngcactgcgttcctgccctcgggggcatggccccctcctgttctgggggtccgggcctantgaacctcttgttcccagtacgcccccggtt

SEQ ID NO: 700655 - DNA, 1328 bp, Homo sapiens
  misc_feature (272)..(272): n is a, c, g, or t
  misc_feature (447)..(447): n is a, c, g, or t
  misc_feature (453)..(453): n is a, c, g, or t
ggtaagaggaactatatagtcgagtgagagtgagagcatcatgttgtaagcgggtaaagtgtcgactatcatctctcaactcgtggatcctccgacaaatggtgcagctgagtgatctactgtgtgtggtcctgaatgcaatccgcatcagatgcgatgtcgatgatccaggagagcgcgcaatgagacaacggtattgctggacacggaagtatgctgatcacctctctattaaagtgcctctggtggatcagagatgctgctatagggcnatcgaccgctttacctgatcggattcaagaagtgagcttgatgagcttgaagtagtctctaagtatctcaaacatcccacaactctatgggatctcgcattgtgttctcattgatagattgagcgcatggagcaacatgtgcgtaagatcgctctcacacggtcgatagcattgngtgcanaggcgtgggaattggggacgagcctagggggggctttgtgctatcaaacgataaggtaacatggatagacgagccgaagtccgaagtcataaggcattgcccttctataagggatacaccattgaaatatacttatcaataatagacacgtacacgagtaccataatatacactgggaactggtcgcaggaaaacgcggttaggaaacaggagtgatgcacggcgaacggctaccgtctgtggcgccctataaagttgaaactccgcgtgtgtagttcccccccgaattattaatgtgtgctgtgtcacaggaatacgttgtgggttgtggacatctcacacccagtttaaagatatgtcagcgttccaatgtatataatataacttattgagaagaggattgggggaggttacgcagaggggctattctaaggaacaagagacggaatcacagacatgaaaagacgaagaaagcaaagaaaaattattgttggaaggagcagtgattttgggcgaagaaatctccacattactggaggagacaaagtacgataatttgtcaaacgaggtgttatgggtggcagaatagagtcgacagacgaaaacacggtggtgggtgggaagaaacacgtgtgacccccaaaggaaataaatacatttggtttaaaggaggcagttaataaaggtggtatacgttggataatataacgggggctatgtatacataccggtggcgtctaatacagaaaggatgttggaagggaacacggaaggacgtacgcaaaataatagcagaatataggatatagacggtttatcacgataatgaaattgttggcgagacaaggactgggcgagataaatatagatgtaag

SEQ ID NO: 700656 - DNA, 95 bp, Homo sapiens
cttattgataacctcagacgttcccaccactgaagatgaggttgaaaaacctgacttttatcatcatattgataatctcaggagaactctatgca

SEQ ID NO: 700657 - DNA, 1127 bp, Homo sapiens
tcgtccttgctgttcgttccccgttccctctcgctttttatttttcttccagttccgtttgtcttggttcttccatggttttttctcttttgctcggtggtcttttttgtcgtgtgtccagggcctgtgtgttttgttgtatcttcttttctccttggtggggttttcgtccttctttttcgttgcgggccctttggtggcgccttttacctctttgactggcttggttccctgggtcctatgccggccggtagcttgtgggatgtagtgggttcgggtgtgtttggcgtccgggccttgggtttctctgtctcgtctgtttgtgtcgccccttccttgtaacgggtttcgggtaccctggtttggtatctggtcgtccttggcacttctggtttttttctcctgttctggtctatctgtgtgctaggtcatgagcttggtttggcatctctgtttctggcttctggtcctccctttgctgggccccttctggtcctcttttgctctttatgtttttcctgctcacatcagtgggatacagtattctagtttctcccttgcctggtcctctgggtatggttgatcccctgctctctgctagtagtccttttgtgtagttctgctataggtagctctcacacacctcggtctctggggttgatacctgagcctgcatatagagccctgattatctatagagcatggcttgagtgtgtgaatatgatgtgtgcacatgcttaatgagcttgcaagtgtgcacacgttttgtggagaggagggtgttctggcctgagtataggtaaagaagtaggcatgtccagtatgctttgcagggtgtgtttgctcgttttccatgcccatgctatccctgacttggggtggagcatggaaggagctcttttctgttcccaagcctcagaactcttgagctgtggcttacattgcatgtcttcaccaggttcagctccgtgggccacactgctgctgtgccaaagaaggtgtacagcctccccaggatggggccatcatacaacccattcatctgcacatctacatttaaatcgtgtccattgctgtcttttatatattttccatttttgaactggaagacgatgacctctatacag

SEQ ID NO: 700658 - DNA, 334 bp, Homo sapiens
acagacctaagcgcgaagcctctagcctccgtgctcctgttgcctgcacatcggcctgtggcctgccttgcccggagccgagcttctctcttggcttccaggagcctcagctcctctccgcttgctcactgagccaacagacgcggtcaccaagaccggggcagctccacacccatgaccccccacccccgcggcccggctcaccaaaactgggaacatcactttgcctcccgacccctctggaccttgatgagctgagtgcatccgcggccgactcgggagccgcactgactctgtggcccgcatgtgcacggcagcgacagcctgagcgctc

SEQ ID NO: 700659 - DNA, 390 bp, Homo sapiens
agagtaggagcaggagggaaaaagaaaggtgctacactcttttaaaaacaaccagatctcatgagaactcactcactgtcacgagcacagcaccaagaggatggtgctaaatgattcatgagaaatcacccccatgatccaatcacctcccaccaggcctcacttcccacactggggattacagttctacataagatttgggtagtgacacagattgaaaccatatcaccattccatatttttttctgtttgtggctgtacatatatatgtgtgtatgtattgttttttacagaaatgagataactttgcatacattttttgtaacctgcttttttcactcatctatatattgtaaatataatttcatgttagtaaaatcttctataagc

SEQ ID NO: 700660 - DNA, 927 bp, Homo sapiens
  misc_feature (207)..(207): n is a, c, g, or t
  misc_feature (378)..(378): n is a, c, g, or t
ttgagttctcttaaatgagaaataactgggacagattctcacttttctccggtagcaaccatggtatctttttggaacaatgggagggtataaacttatttttttaaacaaatgggaagggagagcacgccttctggttggccaagcatagcattaatttccaaacacaccatcatttaaggtggccggggcccttttggtcacagnagattctggataaccaacagcaaagcaacacagcatttggcaggtaaaaagcagaaactggggttcccaattcccatctctggtactcctaatggagttgcagagggttctgggggtgcagatctacttaaccctctttggaattggcagcttcccttggctgggtaaaanaggggatggtcacaccattttggccgggatggaatcattagcaattcaaatccacctggaaggtatggcctaagcaactccaaccatgggcagcagaagaccccaaggggaagccactgggggaacaaggcgtagactccctggacaaattaacccgtcgaaccaaaacttcccagggccctttcctggaaggcacctatgcagcaaatatttcctggttccttaaaatgggccgcagattattactggacgctttctaaccaccaattcttcctttaggctccccattgggttctcccttaagagtattcttcctttttccagccatattcccattaacttttaataagaattggtctccttaattagcggggtggttaacccttgactggtgccaattctggaatcctcccgagcaataccccaggcattattaagctgtttggtacctccagggctacaatctctccgactcgccctatacgtgggtggttctccccaactttgtgtggtctggtgttaccctaagagagcccctttttgggcgac

SEQ ID NO: 700661 - DNA, 175 bp, Homo sapiens
  misc_feature (13)..(13): n is a, c, g, or t
  misc_feature (131)..(131): n is a, c, g, or t
gatccgtcatggncaacgagaagcacagcaagaacatcacccagcgcggcatacgtcgccaagacctcgagaaatgcccccgaagagaaggcgtctgtaggccctggttattggctctcttcacttttgtngtctgtggttctgcaattttccagattattcaaagtatcaggat

SEQ ID NO: 700662 - DNA, 197 bp, Homo sapiens
ttgctctggtggtctcctccgccggcgccgtgcgcgtgcttgtagtcccagctactcgggaggctgaggctggaggctcgcttgagtccaggagttctgggctgtagtgcgctatgccggatcgtgttgtccgcactacagttcggcatcaatcatggtgacctcccgggagcgggggaccaccagtgttgcctaac

SEQ ID NO: 700663 - DNA, 185 bp, Homo sapiens
tcgataagggccaagttacattcccaccaacaatgtacaagaggttctcttttctccacaccctcaccaacactaatcttctgactttttgaaaaagccttccttacatctgtgaggtgatatctcattgtggggttggggtttgtttatctctttttttatttcaatcgtcggccccttatgag

SEQ ID NO: 700664 - DNA, 1081 bp, Homo sapiens
agcggatgcgacatcatcttcgtcaatgcacaaagatggcgccctacaggcgctactggtgactctgctgccgaaagctctgggtgtgcgggagataccattgtggccgtcagatcctggtgccaacgggccaaggatggatagttgaccggccaacgtcttgatgcccagatggatgctatcgagtccagtatatgaccatggcatagtagcaaagatatcacttgagaagattgattcgacacaacagacgtgtagatcctggtccgcatgatcctcgtcttcggatcaagctttgttgtagttggcacccatcctggagtcaacccacgactagacgcatggataaatatgaatgcagaagcgtcgaatgtgctccgtagccttgccggtgcgagcgtgctctgggaaccagatgttggtcccagtgcaggtgattgtcgcaaaggctcgcgaagaatgcgactcattgcatccaatgttacaataccgggccatacggggggcatgtctcgagaagggtagggctttgttggcacttatcgcgagcgcagagtcacgaactctcgatgggaaaccaatctcgccatttggaagcacccgatggcttgggaggggggcccgatcaaaaagcaacgtgtggcccccgtggcctgacaggagacagattcagagacctgacaggacagtcttcatgaatttgtctcctgggcccaaacgtagcaatggctgcctgagacaaatttttgagcgctgtgggcttttccatggggaacgactcgttgggcattcactgggaaaggtccactttgcgacccgacagaatttacttgcctaggcaaagacatgttattgccgctaacctcgttgcgctaggttgtgcctctcccttggaatcttgtggcgatcgtggaaacgttccgcgcgacatgccccccccctaacttacgttgtggtcggagctcctattggcgtagggagccagagtacgttgtgaactctcggagaaaggtttcaggcgagtggtgccctgacgaagcaatacatgattgcacattgttcccatgttgcatagagggat

SEQ ID NO: 700665 - DNA, 1024 bp, Homo sapiens
gaatggataattggatgagctagggctctgggggtctgcctggtccactctggtggagccagggccccagcaccctccaggacaggagatctgagatgcctggctgctggagtacatgtgtgcacaagggttactcctcagaatcccccagttctcactcatgtccccaatcagggctagaaaacagcaagatggacgcaaataactgttctgcatgcgatccccaccgatgacctgccctggcctcccctgtctcagggagcaaggtcacaggtcaccactggggagaaattgtatacctcccactggggggatgttacaacaccatgctgagttataagagcggctgtagttagtagggagggaatggtagtgtgtgcacgtgtcgaagtgtgatgtagtagacgtgtggggatcgttctgagatctcctagtccccgtgagtacaggtcactacgctgtacccagacttgtatatcctgaccagatgtacagagatgtctcctcgcacgtgactcttgtggggaaggaggcctcgagagtaccagatcttgctagtctgatgggctgagaggacattttattgatacctttatcaactgttgggatgtcacattgacttgtatactctaatgaaggtttcatggaccataagatattcaaaaaggcaagatattctaatacaatatgtgttatatgtataatataatcattatgtgcagccactacaagctgatacaatgccgacagggggggcctaccacaccgcgggtatccatgtgacctggacgcacagaccctgacaggttgacgggcaacagtgcaccacgacggactcaacaagacctggggcagaacgacgaacacaaacgcgataaaacacccaccgtgggcggaacgggagccagcaccagaaaacgagcgagcaacacacgagcggggggacaaccagcacggggaagacgcacacatatacaattaagccaatcacacgcacacacgccaacagacacgccacgacaca

SEQ ID NO: 700666 - DNA, 134 bp, Homo sapiens
agcatacgcctctaagacagggttgggcccagctgccctgtcagctaggactggcaggcgggctaccctgggaagacaggaggggtgggctaggggcctagtttgggacccctccaagggcatcctggccacat

SEQ ID NO: 700667 - DNA, 171 bp, Homo sapiens
tgtgcttcgacggtgctggcagacactcgctgctaagatcaaatgatggcaatgagtacgtcttaccaagccaaagacgatgaggaaatgaacacatggatccagggtatctcttccgcacatctcctctgatacaacacgagagtgtcagccagacacccaagagacacg

SEQ ID NO: 700668 - DNA, 123 bp, Homo sapiens
tgagataagcggattaataattacacaatttccagacggacgggcatttaaggctcattaggtaaaatacaagaattagataatataattaagaaatattaagggtccatcaaattaggtaaa

SEQ ID NO: 700669 - DNA, 83 bp, Homo sapiens
ctttcccccttttttatttttaatttcctttcaaccaaatattccccctatgtgctatatgtaataataaaaagttgccccca

SEQ ID NO: 700670 - DNA, 411 bp, Homo sapiens
  misc_feature (6)..(6): n is a, c, g, or t
  misc_feature (53)..(53): n is a, c, g, or t
  misc_feature (58)..(58): n is a, c, g, or t
atattnaaatggccttccattccttttaaacttttaagttcctccttcccccnattanaatcacaaacttcggaaaatgttataccctttcaacttacagtcgctatcaaaaatcaaataccttagggcagggtgtgatggctcatgccctgtaatctcaacactttgggaggtcgaggtgagcagataacttgagcccggggcttcaagacaagactgggcaacatggcgaaagccagtgtctacaaaaaaaaatacaaaaaaattagccaggcatggtggcacacacctgtggtcccagctactcaggaggccaaggtgggttgatcatctaaacctggggaggtcgaggctgcagtgagtgagtcatgattggccactgcactccagcctggctgacagagtgacacc

SEQ ID NO: 700671 - DNA, 155 bp, Homo sapiens
cggtatacacgcgcgaggtggtcacgacggcgacgcccacctgcgccgcatgggcgcctcgcacaactggcatccgacctacgtgcgcttcggccccgactcgcagtcgccggcggtgcagcctaccgacttccagcgccggctgcgcgacgatg

SEQ ID NO: 700672 - DNA, 608 bp, Homo sapiens
  misc_feature (172)..(173): n is a, c, g, or t
  misc_feature (321)..(321): n is a, c, g, or t
  misc_feature (346)..(346): n is a, c, g, or t
  misc_feature (431)..(431): n is a, c, g, or t
ctcggaggtgtaagtgcatgctcaagcgcttttcttgtcttgcaactgctgcagttcgtagacgccttcgcgaatacggccagtcaaagtagtgagtacgggcataggtgtccttttaatggtgagtatgtgcctctaccatatagaaaggcaactaccgtgcactgtttannaaatagcatggctaaggcggaacgctatacaaggcaggacaatccataaaggaacataatcatgcaagacgctacccaaaaactccgcatcgaagcactgctgaaactgcacggcgcaaacacagcccaagtgtgggagtctatcgancgcaacaagggttcggtgcagcatntgccgttcttatcgacggtggagcgcgcctgctataaaacgcgggacgagctcaatcctctactggccctcaaggctatcgagancaaagacatcgacaggcagctcatggcaatgcgctatctgttgctcggcctgatgcaagactgcccagaatacaaagttgcattgcaggtgctggaggaagctgcgccatcggttgtagcactctcgaatgtgcagcacgcgatatggacctgtttggctacaaggcccgtgtctga

SEQ ID NO: 700673 - DNA, 257 bp, Homo sapiens
ataacagtgaggatggagtgaaaaacaaggataaatttgagaggtatattttgaaagccaaattcatggaatatagaggttgattgtgaccaagacatccttaatattcccctaagcttcactaaattttataaatgtttcttcctgaccataagcgctagacctcccttatcttagagcattcactttaaaaacttaacattgcgaattcttaccctgaccccttcgtgaaatgtatacatattgtcttgaaagcc

SEQ ID NO: 700674 - DNA, 180 bp, Homo sapiens
  misc_feature (4)..(4): n is a, c, g, or t
  misc_feature (10)..(10): n is a, c, g, or t
  misc_feature (17)..(17): n is a, c, g, or t
cggnggcgtngactacngtgttgaggatgaataggttgggtataacacctgcagtttccagctctatgaaacaggagagagagagaaatagcagtttgacttgactgtggaagatgatggttgcatgcttctcatttgtacgtttccatctttgtgataaaccgctttaataaagctcat

SEQ ID NO: 700675 - DNA, 217 bp, Homo sapiens
tttatagtttctctcttgcgatactttctctactaactccttcctgtaatcattaaactgcattgatattttcatccctttaaaaaaaacctcatctcaaagtcttgaagttttcactttcttctaccttccacacaataaccaaacttcttgaacacagttgtccacttttgtctccatttcctcactttctttctttctttttttttttttttgg

SEQ ID NO: 700676 - DNA, 393 bp, Homo sapiens
gtaaagcttaccctgagtcttattattttgccacattttcttactgagtgtgaacacttatacctgtgagctatccgagttaggtgcacactttgtgcttgcttaccccttgcttagtacttcggcatatgcttcaagttctagaacatgtcatataactagagtttgtgccaagatccttggtagcttgatttagatccacacgtatagagtacaggaccatcgaatctagtggatctcagtggtctctaatgtggaacagctccttagcctgtatgtgttccatgacctctatgtcttttggagtacatggtagtgattctatgagattgccactcatttcgcattatggatgctgattgcttaacgcccttctcggatactctactctgc

SEQ ID NO: 700677 - DNA, 155 bp, Homo sapiens
tcttcagattccttcctgtgcttgttcttagtcactgccgccgtgatacgcgacccaacatggcgtccagcccctctgccttggcgacttctccccgaccctgagcgggttcatcaccctgacgcctttgctgctctttgcctttctcggttttg

SEQ ID NO: 700678 - DNA, 1235 bp, Homo sapiens
  misc_feature (267)..(267): n is a, c, g, or t
  misc_feature (630)..(630): n is a, c, g, or t
  misc_feature (635)..(635): n is a, c, g, or t
  misc_feature (751)..(751): n is a, c, g, or t
cagacgttggttgccccttcgatgtgcgcgtgaagtggctgaccccgtgagtgtgtctgcgcccgttctttctgtgcgctcttttgaccttgtgcggccgtgggcacaaatgggtggcgcgcacccgagcctttggggcctctcttttgcgcttgtcaaggccgcccccccctccccggtctccgagggtgagagcccccccccgttgtgccccgtgcccccgtgcaaatggtcagacaccctcattcccgtccccttgtcagcccnttgggaaggggagccttgtacccctgcaaagttcccaggggttgagccttgcccccaagaccccttgggaacccccgcctcttgtgtatcaggcgttaaccctggatgagaagacactgggatataaaggaagactccattttggggagactcttaaaaattgtccccgctgggatttttggactttgcaatgggccgcctgtgaacccccccttggttttgcccacgagttctgtcccaactttggaaatggcctgtgattaccctgatacgcctgggaccccctccaattgtaatcttaggcaaatatacctatacacttgcgctctttggaatttttaaatagggcgctctcatataggntgganaagggacacttgccctctgttctctccaagaatgaagaccttttgggagcctcgttggacactcttttgggttataatgccctgaagaaatgaagttatatgaactcttgtggggnaccccacattgtggagaaggcacataagttgggttttttgagaaatgttgaggagacacaccgagaatttcgtgagaggggcccccgcgggaatgtgagaatgacacacatgggtttttgtctggtgccccccacctcacaatcttcacaacttgagaattgtagttcttcccccgagaattcccaccacatgttgttgggaagggagaccccgcgggaaggtataattgagaattcctcgggaggccccgctctttcccacatatactaattcttcactgaatatgtgaaataagtctcactgagagtctgaatgcactttatcacggggtttccgcttttgctttttcctcacatttctcttgctgctgccacatgttaaagtagtgcctttcacccaccccacatcacatcacatttctgagggcctctcccgccatatggagctataagtcccattaaacctcttttttttccccgtcca

SEQ ID NO: 700679 - DNA, 428 bp, Homo sapiens
aggagatcatacgtggaggagatcaccgtggtttggtctccatttttcaatgtcacaaaccacggagcactcatctaacagtctctggatgtcgcttttcttcgactgttaatccgaattcatcctttggacctgcctaagtccccatgaactgtgtccccaccgaagctcctggagtgttctcattccttttaacccactacttgcatagtacgcccctgtgtggctgagaactccagatttctggcaccttgagttcattcttctactggagacccatcttctttccttttcttatccccctttcttttatactttaagaaatgttcttatggtattccattttggctaggggcgttcccattaggccacaaggcatccaataagatttgctggattttaaacgtgtaaatttgtattggcccgta

SEQ ID NO: 700680 - DNA, 749 bp, Homo sapiens
cgcggtggctcacccctgtaatcccagcagttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaatgcttgaacccgggaggcggaggttgcagtgagccgagatctcgccaccgcactccagcctgggcgacagagcgggactccacctcaaaaaaaaaaaaaaaacagggggaaagtggagctctattctggtggtttgccaagacaggatggggagttcccttggtacacaattttctctcatttttactctaaaaggctacttggaaaaggtctggcctggggggcactcaatcaagtcctttaagccattacaaggtatcggggggacagaacgctggggtgtccaggcctggacaatgggcgcggggaatctcgtgggcaaagcttggtggtcaccttggaaaggggacctccaaaggtcttgcaggtgaacggtcagcactccaagggcgttccaaaggggagccaaccgcacggggaggttcatcacggaggcgcaacgtgcggggaaaattggaaccagtggttgagtttggtacgggaacgccttgaagccagacaccgggaaaaggcctcgggcaggtaccggggcggtcggggaccacccacagttggccatga

SEQ ID NO: 700681 - DNA, 224 bp, Homo sapiens
ttcggccaaccttcaacagcaagccgcaggacctggaccgtctgtttgacgcggtcggcgaagtgctgaacaagatcgactgatttctccttctatatagaacaatttttcaggagccctgcatgagccttatccagcatttgatcaacggtgaactggtcaacgacagcggtcgtagtgccgacgtctataacccgtctaccgggcaggtgattcaccaggtg

SEQ ID NO: 700682 - DNA, 886 bp, Homo sapiens
gtagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaggccgaggtgggcggatcacctgaggtcgggagttcaagaccagcctgaccaacatggagaaaccccgttgtctactaaaaattccggattaaggcaagggattgttggcgcgtatgcctggtagtcccagttatcttagagagcgctagaggcagagagaatctctgtgaaacccgggaggcggaggtcgagcgtgagccgagagtgcaccatggcactccagcctgggcaataagagcgaaactccatctcaaaaaacaaagcgaacagaaaggcaagaacggaaaatggcagtaaccatcggttgtactatcgtgctgtgagaccatgcggcagctctaacgtggaagtcctctccgttccctaattaagagtgttaccaacgtctaacaaacggaagaaaaagcgaagaactacctgcgcgggccctcccaatgtgcagggaggagcggaacacacgagagagcaaaaacgggagaaatgtgccaccacacatgtcgttgccaacaactctgatctttgccagtagaagcccccgaagctatcttccgtgaggagctacacactgtggtggacagaacagtgactgggcccgctttttctccacataatataagtgcgaaactcccgttatataacacttcgccagaactagctgcgcgtgtgtgtaataacccgggtactctaaatgacg

SEQ ID NO: 700683 - DNA, 458 bp, Homo sapiens
  misc_feature (366)..(366): n is a, c, g, or t
  misc_feature (391)..(391): n is a, c, g, or t
  misc_feature (428)..(428): n is a, c, g, or t
tagagtgacagtgggatgggaactaggactctttgtcattgccaggggttgccttgaaggactggagtctgagagtaagcaaactttatgacccacaaaaaaaaaaccagcttcaggaaagcttaatggagttcctggtgtgaacttagaagcaaggtttgataattaattctgacctggctatttgtgaataaacaaagattaatacagtgatttccattttgctgagtatttttcggcctctgaacaggacggtcacatggttttgctcttgtttgcatgaagcgaaattctggggtcctctcaataaacccacaagagttttctatcctcattaatgaggagctgggcttcttgtgtttttgnagggcagaattttgacagtgtttcntgtggcattcttcaccatcattgggagccaccacctnggcaacgtctgtagacaagggggtaaggga

SEQ ID NO: 700684 - DNA, 1051 bp, Homo sapiens
  misc_feature (210)..(210): n is a, c, g, or t
gcgaagcagcggctaggtctaaccctactagtctcaagtctccaacacatatggcctagactatgttagcatacctaaacctactccaagtgcttatactaatcgtaccaaagaatttcatatttacttactcacctgtactatgtactctcacataaaatacacgagcataaatttggaatcatacagcaatcacactccacagtcctnacttgattcatatatacataccccctgagctatcttattgagatccaatactcaaatcgaagcaaccactcattttaatcttgtctcgctcacaaacactattatccttaccaaaccaccgcataaacttattctccacccttccctgaaactactaataaattacactcggattactcctcacccaccctgcgacgatactacaaatgtgatatataaccatagagctcagtttaatacctacgctagagagacaagcctaattaatcgaaaaatagaatcttgctaagcctgctgctaactagataactctacgcgcatatcaattctcttcctttaacttactgaaacagttgcagccggcacattggaatctgatatttcaatagttatatactacttcttctatcagaaaatccatacatattaatgaccaagctttgagctatttgatttcaccccgattgacaggtaatgcaagtaatgaaatgcccgtggacacggtctgtgtcgaccaataccattacgcgtagtgtctaccattccatatgttattgctcccccttttcccttagtcctatcagccacataaattttaaacttacagacaacacattacgagctccacgtaatcatacttacatacgttccaattacttctacttagcctctaataacctatcaaaaacttcttttagccacatataccttgtgaattatagactgaaactttaacaactcaataagcttcccataaagtggaaataaataccctctttgaagtgactcctaaactatatttaatccttaaaaagacctttttttaaaacccccatttttt

SEQ ID NO: 700685 - DNA, 378 bp, Homo sapiens
ctttctagctcttctctctgcctttcactgtgttgatctaatgttaagatgagtgcctttgtagtcacgagatgacggctcacagtaatggaggcagcatacttaaatcaacaggcgattggcttttctttcccagaagcatctccttatctctctttagtccaaagatggttttccctgtgtgtccctgagtcagtcactgtgagaggggatgaacgtgccgtgattttcatagaatgatcatgtgtgagtagaaaggatgctgtgaagccactcagtattcaccacgatattgcttttaccagtggcgaagaattacagggatacttggcaggacattttccttataggctaatcaccggacaatagaggcctatt

SEQ ID NO: 700686 - DNA, 636 bp, Homo sapiens
gtgatctttgcgcccagtcgttgggtggccgagccatctgagggggaggcaccagcaccgacagggcagccgttggtgcttgagcaaggggtgctctatctgcgtcgctatcgtgagtatgagcggcgtttagcgattggtttgcgtcggattgccgctgcacggttgcccccggctgaatcggccgcggtggcgaccgtgtttgcggcgttgtttccacaggcacgcgctgggcaggatcggcaggcatcggcggcggcgttggcgttgcagcgtgcgttattgctggtcacgggggggcctgggaccggcaagacaacgacgattgcgcgcctgttattgctgcgtgtcgcccaggcgcggcaacaggggcaggcgtcgttacgtattgcgctggccgcgccgacgggccgtgcggccgagcgaatggctgaaagtttgcgtgcggcggcagggtatgtgtctgcggcggggggggatgcggcgttgtttgccgcgttgccgtcgggagcgagtacggtgcatcgtttgcttggggtgatccccgatacgccgcgctttcgtcattgtgaggacaatccgttgccttatgacgtgatcgtggtggatgaggcttcaatgatgtttacctcaagg

SEQ ID NO: 700687 - DNA, 515 bp, Homo sapiens
  misc_feature (281)..(281): n is a, c, g, or t
  misc_feature (308)..(308): n is a, c, g, or t
gggaagaacctagcgttcgaccgtgcagtcgtcaggtatgcgtactatccgatcggatcacaacgtcttaagtgcgacagattgcttgacgccccaggcagtgacggcacagccgggcatcgtctttgatacagctgtaccaccggcaattttgccccgtttgaccccagaacagccgcacagcgtcccccccgcacggaccgcacagcgtgccctgctttcggattggtgggtgtacagctttacccaattggcgcatgccaaagcggagcctgctcctnatgcgggtcgccgtattgccgagccantcaccggagggcaggacgaaccagcctggccacaggatgccatccaacagtccctgcctgggagcgaagtgcccgccgacccccgttttatcggcatccgttttggtgtggcactgcatgaagtgttcgagcgtaccgacttcctagcctggagcacttggcgcgccaatgcccccgtgcctgcgacggaacgtgccgtgttgctcc

SEQ ID NO: 700688 - DNA, 168 bp, Homo sapiens
aataagctcctagtccagacgccatggtgcatatcacagaggaggacaaagactactatcactaagcctctgggcaaggtgatgtagagatgctggagtagaaccctagagactctgattgtctaccatgaaccagagattcttgacagctttgcacctgtctctgcc

SEQ ID NO: 700689 - DNA, 512 bp, Homo sapiens
gccaaacagtgcactgtggctcgctaccggcaccttctatcagacggaacgcaccgccttatggccactgctgggtgatccccaggcagtgacggcacagccgggcatcgtctttgatacagctgtaccaccggcaattttgccccgtttgaccccagaacagccgcacagcgtcccccccgcacggaccgcacagcgtgccctgctttcggattggtgggtgtacagctttacccaattggcgcatgccaaagcggagcctgctcccgctggccgcgccgacgggccgtgcggccgagcgaatggctgaaagtttgcgtgcggcggcagggtatgtgtctgcggcggggggggatgcggcgttgtttgccgcgttgccgtcgggagcgagtacggtgcatcgtttgcttggggtgatccccgatacgccgcgctttcgtcattgtgaggacaatccgttgccttatgacgtgatcgtggtggatgaggcttcaatgatgtttacctcaagg

SEQ ID NO: 700690 - DNA, 571 bp, Homo sapiens
  misc_feature (18)..(18): n is a, c, g, or t
tatgtgtaccccgagtancaatgcgaccggcctcgaggtatcgagcacacaagatgtaacaggatgtacaggatcaacctaaatgtttaaggtccaaattgagcagctaaagcaacaaaactaccaacaggcatcttcttttccccctcatgaagaattattataagtaatttcagaaatgagagaaagaaataagtggtctctggaatgagtgagattcttgaaggatgcagtgaacaccagaggaagaaaaacaatgaaaggcagcaacaggtggaagctgttgagttggatggctaaagaagttctcaaaaaatcatttccacaggtgtctgtcccttctaatttgacgttatggtgaatggttgcatggatttgaaacaaaggcgacaagaatgtatggctggaacttcaggctccgaggaggttaacgttctagagcacaagttgaaacgaagctgatgaaaatgcaccacattgttacagctagagtgtgaaaaactacaaatccgtccttgcagaaacagaaggaatttacagaagctacaggagaagtgttgagcaagacgaa

SEQ ID NO: 700691 - DNA, 372 bp, Homo sapiens
cacaaagtcagcctcagtctctcctgcctggatcactatggggggcttcagcccagggtcactgaggacactctcaccagcatcaatgagttatttgagacatttgaggatgtccaaagcagactggggtcagtctgacaagaaagtctaattctggttccatttcagagaaagagaaatgacttatcaagggtttgttcctcccctcacagaaagaatctcattggttcataaccagataagagttgttccagttttctggttctggagactcaaactgattaataagctaattgcttctattttatatggtcattagaacatgaataaatggttgaattcagcatcatgtgttcagtacagagacagaaa

SEQ ID NO: 700692 - DNA, 503 bp, Homo sapiens
  misc_feature (269)..(269): n is a, c, g, or t
  misc_feature (296)..(296): n is a, c, g, or t
gccaaacagtgcactgtggctcgctaccggcaccttctatcagacggaacgcaccgccttatggccactgctgggtgatccccaggcagtgacggcacagccgggcatcgtctttgatacagctgtaccaccggcaattttgccccgtttgaccccagaacagccgcacagcgtcccccccgcacggaccgcacagcgtgccctgctttcggattggtgggtgtacagctttacccaattggcgcatgccaaagcggagcctgctcctnatgcgggtcgccgtattgccgagccantcaccggagggcaggacgaaccagcctggccacaggatgccatccaacagtccctgcctgggagcgaagtgcccgccgacccccgttttatcggcatccgttttggtgtggcactgcatgaagtgttcgagcgtaccgacttcctagcctggagcacttggcgcgccaatgcccccgtgcctgcgacggaacgtgccgtgttgctcc

SEQ ID NO: 700693 - DNA, 324 bp, Homo sapiens
gccaaacagtgcactgtggctcgctaccggcaccttctatcagacggaacgcaccgccttatggccactgctgggtgatcgctggccgcgccgacgggccgtgcggccgagcgaatggctgaaagtttgcgtgcggcggcagggtatgtgtctgcggcggggggggatgcggcgttgtttgccgcgttgccgtcgggagcgagtacggtgcatcgtttgcttggggtgatccccgatacgccgcgctttcgtcattgtgaggacaatccgttgccttatgacgtgatcgtggtggatgaggcttcaatgatgtttacctcaagg

SEQ ID NO: 700694 - DNA, 177 bp, Homo sapiens
cacttcaggtttagccatcccgccccacaatcatcatgcctgttacgcggataatcttgccggtacctatcaggtttgatcagccacaactgtcgatccgagtgccgaccgagttgtgcttgattgccaatgcatccgcgcagcacgatagctatctgctggcgatgcaacaatgcg

SEQ ID NO: 700695 - DNA, 697 bp, Homo sapiens
gccaaacagtgcactgtggctcgctaccggcaccttctatcagacggaacgcaccgccttatggccactgctgggtgatccccaggcagtgacggcacagccgggcatcgtctttgatacagctgtaccaccggcaattttgccccgtttgaccccagaacagccgcacagcgtcccccccgcacggaccgcacagcgtgccctgctttcggattggtgggtgtggttgcccccggctgaatcggccgcggtggcgaccgtgtttgcggcgttgtttccacaggcacgcgctgggcaggatcggcaggcatcggcggcggcgttggcgttgcagcgtgcgttattgctggtcacgggggggcctgggaccggcaagacaacgacgattgcgcgcctgttattgctgcgtgtcgcccaggcgcggcaacaggggcaggcgtcgttacgtattgcgctggccgcgccgacgggccgtgcggccgagcgaatggctgaaagtttgcgtgcggcggcagggtatgtgtctgcggcggggggggatgcggcgttgtttgccgcgttgccgtcgggagcgagtacggtgcatcgtttgcttggggtgatccccgatacgccgcgctttcgtcattgtgaggacaatccgttgccttatgacgtgatcgtggtggatgaggcttcaatgatgtttacctcaagg

SEQ ID NO: 700696 - DNA, 645 bp, Homo sapiens
  misc_feature (96)..(96): n is a, c, g, or t
ttcatattctagaagaaaaggatgtatggattaaaaacattgactttttttttaataaaacaaacaaaagagtgtggaataagaaaacagagcatnctatatatcccaaaagcaatatatccaaaagttttccttgagaaaaaaaaaaaccagcttgctcaggaaagagaatacagattgttttctctttgtaagtatatttgaattttttatgatcaaacatgactctcaatttactgcaaaatacgactgcagaatgtgtgagtcatgtatctaatctgctttgaaatattgttcctaaagaacataggtacttataatcctgtacaatccacagttggagtccacaccttgtgacaacaaaagacaactcaaatcagcttcaagcatggatcataactaaccgcggggctattttttccatctgtaataaagaatgttccaacatctttaataatcgaagataatcctctgtcgtcatcttgagcatctaggttataaaaatacatacagtgctttgaagaaaggttctggtccactggtgtcacgtgaaggtcagattatggaaaactggcattgttacaacaagaaatgaaggctgctcatgttttctctgggtatttggaataaagtatctcatagtta

SEQ ID NO: 700697 - DNA, 142 bp, Homo sapiens
acgtacgttttggaggtcctgtggggcagcgccacatggtgaagtgaaccaccgacgaatagaaaaagctaccttgtgagttgtgcccttcgccttgcccatactgctacgagtatcccgaggtcgatatctcgtaaatctc

SEQ ID NO: 700698 - DNA, 797 bp, Homo sapiens
tgagggccaaacattccttccagtgagaagattcaagactagctgtgacttgaatatatgtttcaaggtattataagatgtgatgtgttgtcagtataagaaaaggtcgacaggaaacaatctgatatgccatttatagaaaaagccatacgacttgagcattgctaattcggcgaagcttctgcacctgaattagagcacattaacctagttgctgtatataaaccaaatcactgtctattccttctctgaaatcatctctcctcttttaaaccttaacttatagctagaataaatcactatttaatgggcctctaataacttataaaaactacgggatggttaggcctggtttaactaatttatggagagctatttgcaaacttaagtggtgtaaatgtaatttctacttgtgaatctgagctgtagcagcccagagggagctaggcaaactattccagaacacaatgataagtgatcagatgctttgtaatgtaggatttttaacctgttgattatgggtggcgaccttaaatgtaataatgttcacctcgattttcctggagtaacaaccaagcgtgggtagtagcccacctgcatgaaggacggcagtgtaacaaatatttgtgcctggatttctcccatttgtgttaaggaaggggagattaacggcggatggggcttttatttaatatatcctattctttagccagtgactgggaagagggctgtaaataagacaaaagtcgggaataaaggcaaagctgggtttaagaaagcccggaagttgggttaaa

SEQ ID NO: 700699 - DNA, 472 bp, Homo sapiens
ccgccttccccgacagccctagtgttacactggttctggagtgtctctgcggtacaaagatgcacttttcttcatggggcaaagtctgcctcttctgccaggcagttcccatttgcccctgtccagactgtttcttttggcttagaccataatcctctgctgcccggggattggagccctgtgctaggaagctgtcagttttgagtatcattggcctttcagcacatgggtgagaaaacaggccacgacttgtcactcagcactaacccccagttcttgaacagcctcctccagccctgctttaggatgacacaatgaataacacctaggcatagaaaccagtctctttggtttgtttgtattatgttctacaatattaaagatctaaatacaaaggatataatacagtcttgaatctaaagtaatttgctaactattttgattcttcagagaactactaataaaaatctaa

SEQ ID NO: 700700 - DNA, 203 bp, Homo sapiens
tagaggatcccaatgatggcgtcagctcccaaatgggtaccctgcctatctgcgcttagtgcctcagaactttggtgtcattggtctcagagagcactttgccatccactatcctggcgggtggtggtctttttggattggtttgcctggatgttgcttgcttgtccaatggcatcaccaatgattaaacgtcctacgccatc

SEQ ID NO: 700701 - DNA, 430 bp, Homo sapiens
atatcacgcaccacacacactccttttgaggcatctccagctcagtcactgccacctatacactcatcttcaactatgagaacctcggtacatctagtaatcctccagccacaccacaaacatgtccactctaccttcaaaatggagccaaaatccctctccagacccatcgcccttcaccaagtctgttatcagctccccagtgcaagccagcactcccctcacctggactaatgtcacagctggcagttccccagtactaccctcctcctagctcttgcaccacctagcagtctgtatctcaacccaaatagccacagccatcttttaaaaatatacatcaaggtatggcactttttagttcaaaacctaacaaattctcattagatcaaaattaccatagactaaaaagctgtagaacatctggctg

SEQ ID NO: 700702 - DNA, 753 bp, Homo sapiens
taaaaccaggaaggagaggatgcagtccagttggctaacagggttaagtctgctatggctatacaaggaggcctgactgaacttcccggggatggaggactaaagagagcaccaggtgaaggacatctttaaggaagagcagcagaaaaattacgcaagatgatggtgggcaagggatctctcagctaagaggacggatgacagcctttagatctagaactagcccttagaaatggaagggctttttaggttatggtgtacggtatcaatggtttggtttcttattatggtcaaatcttttctacacgaatgatgcgtctcctacctctttatgccagaggcagaacctaacaggtgcccttatgggcttcgtcgcgtgttgtcaacatttagcccccatggattgtaacgggcggtttacctggcgttaaacacagattccggatttggaaacacgcggcatcactgggcgctgatgacactttggtcttggaacgaagctgctggacaggctgttggaatcaccgaggggatattccaaaaggccaaggtccttcggagtagctggccttctagcacataaggagatacctcggtgcgagcccatggcgccacgcgagcgacgaagggcgtgctcaacagggactgaccgctgaaacacaggtcagaccagggaaaatacgctgacaactagggctgccaacaccaggctgtgtatcccaggactgagagacactcctcaagttgtcgggc

SEQ ID NO: 700703 - DNA, 177 bp, Homo sapiens
ggctgggagagcggtcggcggggtttcattcgcttgcatgcctgagaggagcggagtctgccagtgtggtgtccatcatgtctctttcaagcatgttcgacacctcgtattcccaggggtcgttccaaaaccgcttctccacacagtaaccggtgcttctctggtgtccatgcatag

SEQ ID NO: 700704 - DNA, 642 bp, Homo sapiens
agcgggcgctcgcgcacggaccctgcactggggtacagctcggaagtcatcaggttccatggtcgagatgctgcctggtgccgagatgtctgctgctagtccgacggtctctcctcgctgctggtatgcctcgtggacgtgcgcgctgctggtattctagtcataggatgggatactgccccactactggaggcatcgctcacaacaccaataacccgttaagaccgttaacacagtcagtatcaaccacacgatatgtagtcacgaaggatcagcatacctcacgatcggcccaaatgtaaagcgctatatgacaggcagatcagacacacatgcatatcaacacataccgtcaactccctacatcgcaaacccgcacaactccctaagcctcacctcccatacctacacataaccacccacagcaattacatgccacacaactgacacagctcctcgaccatacctacaactcattctactatctcacatcactcgcccacagtacgcccttcactctatcctcctaacaacccactcatccacacgcaaactacatcaattatatactcagacacataccccacacctctactacgacattacacgccaccaaaacacattaactaactacaacaccta

SEQ ID NO: 700705 - DNA, 449 bp, Homo sapiens
agtaaaagtagagacgaggttagcaaatatgctcaatatcatgagtcatgatgaatgaaggatgctaaggtagaagcgccatgaacaagtcgcaaagagacgggatcgtgcctctgctgcgaacttctatctttatatcttaatgcctcatgctcgtatttgtaccccaatagcggtaatgcagaatgtaactcgactggtacatcacatattgtttcttccaacaaactggacatcgacaacctaatcatctcgtatttgaacgtatacatcatgatttaatacccatctctatatctctaaaaggtgtatgagttctatatgcaccccggggctccacttcattccatctctgtctctttctgctctttttatgcgtgtgctaatatgccaacgtggcactgaattaatttttgcaatgcccatttctataagtctaaatgcaatca

SEQ ID NO: 700706 - DNA, 750 bp, Homo sapiens
cgccctcaccaggttagacggtacgatgacggttgctccagatggccggtcgacccgtcggcaaggggcggtggctcccggggtggccggggccggcccggttcttctgctcccggtgtggccgctgtaggtaatacttagcgagcccggactgggtgccggggtagtcgcagtgcggacactgtagggcagctcgcctgtgtgcactcgcagatgcactttgaggtgatgtgctgagcggaaagattttccgcagaaaggacaatccttgcgggtggcgccccggcccccttcaggcggggtccctccaaccaacagcccattctcttcctgcgtggcggtcgatcttgcctgggccccagcagcagaggcagagtgccccggtccctcacccgggcgcgggtgcagggaagccagagagcccagcgacctgccccgggcccaggtttcctcctcggcctccaccacctcctcttcttcctcaggctcctccgcacggtgccggcgagcccgggccgggagagcagaggacagcgggcgaagccctccgaagctggcgcccgggccgggtcagcacctgcgttggccggcctgccagtgcaggtcaggtagccaaaggtggggctccgggtcgccgggtggacggggccaaagagcgctgggcccacggtatagccacaggccaggtcagaggtgggggcgcgggcaggcccgaggcaggccccggggcacgcagtgggcccagcttgt

SEQ ID NO: 700707 - DNA, 273 bp, Homo sapiens
ccgatgaccactagtcatctactgtgatctaaaaacacgtcaaggctggagcacgctgactcatgcctgtaatcccagcacttaagagaggccaagacaggcagatcgcttgagcccctggagttcaagttcagcctggagcaacaaagtgagaccccaatctctacaaaaagacttttaaaacgtggacacataaatataaataaatcacacaacacattcatatcatttggtatgtaggaaaagcagttagctgtagagtcctcaaacttg

SEQ ID NO: 700708 - DNA, 166 bp, Homo sapiens
tatgagtctgcacccagattgtctgatctgttcaatggaatgacgcgagcggattacgacagagagcgacctgggcagtgctcctgtgctgcgtatccacgatctgtttcagcaaaaccctgttcctgactggccaaccaactcgttcagcaaacaggtctctcag

SEQ ID NO: 700709 - DNA, 606 bp, Homo sapiens
  misc_feature (1)..(1): n is a, c, g, or t
  misc_feature (248)..(248): n is a, c, g, or t
  misc_feature (346)..(346): n is a, c, g, or t
  misc_feature (390)..(390): n is a, c, g, or t
  misc_feature (442)..(442): n is a, c, g, or t
  misc_feature (449)..(449): n is a, c, g, or t
  misc_feature (602)..(602): n is a, c, g, or t
ngacatatgattatgagattaaggaaccattattattaatctcatgggtcattttagtttcaggagcctcatggtaggaaaagttagaataataaataacaaagcatcattttagtgccgtttccagaaatttgtagtggtaagctatgcattaataaaattaatcctctggatgcagaaagacattttataggtagatgtctgtcatcccaggttgagtggtgattgatgtgttggtgtaaccatcntcctgttttgcagtgagaaatggttttagatgaagataatgataatgttgggcaacccaattgagtatgacctgaacgacagctttctagatgatganggaagaaagactatgagcccaaccagatggaaggattctgactngggaaccggaaaaggaagatgaagagaaggaagatgtggaagagcttttganagaagcnaaaaggtttatgaaaagaaaatagtaactaacttctgtagtcatatctgccctacatttactttttctttgtgggaaaacatttatgacctaaggaggtacttaagtgacagttatttccctcctttgatagttaatgacctttactactgcncctt

SEQ ID NO: 700710 - DNA, 715 bp, Homo sapiens
cgccacccgctggtctgcccagcactgcctgggacgctgcgtggccatccatgctccccgtgggtgcgttggtggggctccgcgtggcctgggcctcggtgattctgccctgcctgcttccccgtgggatgcctgctgctgcaaatgccagtgttgggtgctgcctgggcccggccagctgccactctagtgcatgctgtgaatgtgcagcttgctttacatcctgtcctcccctgcctcagcagagttggtgatgaatgtgcagtggtgtgggtggtgtggaaaaataaacagtgaaaagtccttgcaccatgtatgatcaggcgtcccccacctttgtgcatcccaggcccggccatggggacctcccatgtactgctgtgccatagaactgctgagcatgcgatggtgcgacgagcttcgacgggctcggtgcaaattccaaggtggcacaacggtgctggtggaagctgactccctgacatccatatcttgcggcatctgcaagcagcagtttaacaacctaggatagccttttgtagctacacaagcaaagtggcttgccagctgacatggcacatccgcagcagcccccagcactggtccagtttgtaatcggaggaaacatgtgcctgcagccagactcagaccagcaccagaaacatcacctcggagacccagacaatcacagttcagctccagaatttgttttgac

SEQ ID NO: 700711 - DNA, 1577 bp, Homo sapiens
  misc_feature (118)..(118): n is a, c, g, or t
  misc_feature (261)..(261): n is a, c, g, or t
  misc_feature (321)..(321): n is a, c, g, or t
gttcgtgtgccatgatgcgtacgctctgctttcgcagcatggggtcgctgggggcatcccacgggaagggccgctgctctagcggtagcacacaagtggccgccgtaagattgccagnacacatgggccaatgtggagcggttcatcttaggcagtagtgtctgcacacgcgctctaggcgtgtgagacagtggaatgacacgtgaacgagtacccagaaagcacctgctgtatctgcgtcatcatgaagtgatctggagncatgcctcccagctgagcgatgtgagaatctgagtgaaacgactatggatgagcacgctnttgatagacacaaagtcgagcatgcgagcaattccaagaaattgtcgtggattgtgaagagttggaagtgcttcggagaatatagctggaccatgaacattggactgcatagaatttgagagaacaggctggcgtgacacggcgatcacagagggaggcatctcgcgcaagggttccagagtataacatagcgtaggcttggggcacgcggccacaggaatccactcgcgacggcactggttgggccacccgtaagattacgtagcatggcgaactccactggatgcagtaagtaagacatctcttcgtcgaagaccgcgcgaacggagcgtgcataaacgaatatcctcccggcgcatggatgcggagacaccagttggggcccagcctggggtcaaaacgtagcgcagggttccgcacaagccatgaactctttcctaggccggcacgtcctgctgagcacttcgacacagaggtttcccgagagagcctcggctgtagacaggcggcactcggcaacccactgactattgcttgcttgtcccaattacaaggcattgagcgctctagtaggtggtggcttcccccgtcgtgctcccggaactacggggacgactgctggcctcaagctgaacttcagcacctacttctgcggtgtgcaaagcatgcgcgtacttcattgacaccccgagcggggcgggaccaccctagaggcgcgcacacggcccgcggccgaacgaccgagtgagcctacggagcaaggtggtactgccccatccgtggagccaacccgctggaccgaggccacggcggacgaccagctagcacgccacatcggcccgtgcacagcccagagacacaagcccagactcggcacccctggccacacacgaagcgcggcggaacccaccccagtgacacaccgccacaggcgacaaaacccccgtcggcgaccccaacgagcttgcccgtacgaacgcgcacccgacagccccgcaaacgaggcccggcacaaaacaccagccccgtgggccacacaccgccttagccacaagcaactaggaccgatcctcacacgcgcacaccacgcagaacacccaccaacaccccaacccaccgacgacacgccccccgcgccgcaccccgaccccccgcagcatccacacccccacacaaccaccagtcgtccctcgatcaccccgtcccctacccacccccccgctgccgctcctccgaccacgaaccgcacaccaccc

SEQ ID NO: 700712 - DNA, 100 bp, Homo sapiens
ttggttgcagcgccgtgtactcttcgccgagcaagaccacgtacagatagccttcgacccggccgtcgaccttcagcggcgcgacgctgaacaccttgcg

SEQ ID NO: 700713 - DNA, 119 bp, Homo sapiens
aagcagtaatacagactcaggttgtgattgatgcaggagccttcgccgtctttcccagcctgctcaccaaccggaaaactaacatccagaaggaagctacgtggacaatgtcaaacatc

SEQ ID NO: 700714 - DNA, 132 bp, Homo sapiens
tgaccccgcccgcgagaacccccccgcggggccgctccccacgtgccccccccgggcccccgcggcttgtttaaaaactgttgtggaaaatgagggcgtttgtccggaatgataaacttttatttattccca

SEQ ID NO: 700715 - DNA, 454 bp, Homo sapiens
  misc_feature (3)..(3): n is a, c, g, or t
gcntgtgatctccgctcgccgcaacctccgcctcccgggttcaggcaattttcctgcctcggctcctgagtggctgggattgcaggcatgtgcaccatgcccggctaattttgtgttcttggtcgagatggggtttctccatgttgatcaggctggtctcggactcccaacctcaggtgatccgcccccctcttggcctcccagagtgctgggattacaggtgtgagccactgcgcccagctctttttttttgttgttgttaagactgggtgttgcactgttgtttaggctggagttaagtgatgtgatcatggctcattgcagcctcaactttctggactcaggtgaccctcctgcctcagtctcctaaagtagctgggaactaacagctgtgcgcccaccagattctttgcttggtggttttgccccaaggggccttccggtttcctttttg

SEQ ID NO: 700716 - DNA, 560 bp, Homo sapiens
  misc_feature (441)..(441): n is a, c, g, or t
cagcagacggctacataatgtacatgggtcaattaaacattgcttctggtcctcttcgtggctcttaattaagaaaataatagcaccacaagcagaaggttactaggagtgatgcatatatcgtcatagtcctggacagtgaccatatgaagtttgatggccctcctttccttttcttctcttgattttctcatccatggccacgaagatcgcagcattctgatcatcagctcattatgcagaggctgtgaggaaggctgggaacagaaagatccaattggccagagagaggaagtctttgaacatctctcccaccatgcagctgctcaggctaacacatcattacaggtcgtgatgtttaggacaggactggaacgatggtctgcttcacgacatacaaagggatggtgaccagcagaatcagcagccatattgccaggnagatgccaatggcaatgtttgccttcttcctggagtgccccatgggggttcacgatgacccaatacctctgcacactgaggcaggtcatgaagagaatggaacagtacatgttgccata

SEQ ID NO: 700717 - DNA, 161 bp, Homo sapiens
aaaattttcccccaccccagggggggttttcaggcctgggggggggccccggggggggggggggggaattcaacctgggggttggaaaggacaaaacttcctcttgaaaaggggggggggggaaaaaaatttgaaaactattcccaaaaaagttttgttta

SEQ ID NO: 700718 - DNA, 604 bp, Homo sapiens
tcagggataggctgaggggtgactggatctaatcttcattcatgtgatttaaatgaaatacacagggttacctggacaccacactttttcccttgggaaaggattatagaatattccagcataatctatttggatatcatcttgttctatcctaaataacagaagagggaagtgacaattggcataccagtgcgaaacagggcatgcatgttaatgtttacatagtatttgtcttttcctaggataaggtttaacacttaccttgctggagggtacttcttcaaagcaatcaagtggtttatagttttccattaatgagaggagaataaattttgacttattatgtttatccacaatccaaacaaccagagggttcaaattaatacacttggggagtttcattgtgcatttgacggttttaagaacaagaacaagagtgagattacaggtcagcttcttaatgtattcaaagaataaaataagatttattttaatagacatcttttagattattacatgggctcaaacatagtttttcctaccgtctagttctgctctgagtcagggctatcaaaattaaatcatgtttaacctgtggaaaagt

SEQ ID NO: 700719 - DNA, 137 bp, Homo sapiens
tactgaagacaccttaaagcggactccaggaatatcaccatacagcatgacgctttgcggaccaacatccacgcagaccaggaacttcatcataattcctacaagtaagagttcatagcgagccgtcattagggtac

SEQ ID NO: 700720 - DNA, 277 bp, Homo sapiens
  misc_feature (35)..(36): n is a, c, g, or t
  misc_feature (38)..(38): n is a, c, g, or t
  misc_feature (51)..(51): n is a, c, g, or t
acgagatgtcaagagaaccgacgagttatacaagnnanagacgagatgggnaagttgctgagacaggaaagcctagggaaactttagagctagatacaaaattcacacagggaaaggcacggactctgggtgagactgggaagtgtcctcagaccattcatgcaccatgcgtgacgagctccgcccctatgggccctgtcacccctgacaggatatgcctcacacaacgcttcatagattgatacaaccattgctagtcctcatgccctgccaccag

SEQ ID NO: 700721 - DNA, 217 bp, Homo sapiens
  misc_feature (35)..(36): n is a, c, g, or t
  misc_feature (38)..(38): n is a, c, g, or t
  misc_feature (51)..(51): n is a, c, g, or t
acgagatgtcaagagaaccgacgagttatacaagnnanagacgagatgggnaagttgctgagacaggaaagcctagggaaactttagagctagatacaaaattcacacagggaaaggcacgagagaagagacgagatgatttcaaatactttactatcagctccacaatagagctgccagtcactctatctgcatttcatctactaacaccagtctt

SEQ ID NO: 700722 - DNA, 918 bp, Homo sapiens
ctggaagggaggcctggagctctgctatcaccaatccttcccttccctctactccacatccttctaaggagcatgatttgaaaactactttcctaggttaatgggcatgtgcatcaatggagagaatagtataagcaagtgagatgtagactaacgcaacaatttagatggagaagcacattttataaaattaataacttaaaagtctcaagttattaattgttgttgttcttcgctaactcaattggaagtaagactatgaacatatttcatgtgtgtttccacattcccacgttgaatgcgggtgtttcaggaagtttcaggtattctcttaagatcctcggaaaacactggtgctgtcaagtccagagttcctcgtacacggaattctatatctctgggctgtacatctaacaagaaagcacattatgaatacaattatactagaaggccttgtggtaaaatgccactgttgtaagcttctctttatctatccatctgtacctaaccgtgaagtcagcaatttatggcaagaatactctcattgcgagagagaggcagaaggcttccaacaattaagattgacttattgtctttagcagagctcacgtatcagttcccgagagagacatttctcttgagttgcacagtgtgccttcctccctcctgggtgtcaccattgatcgacattgtgaagtggcttggcataaacctgctggaccctggaatgtgaacacctgttctgtgggaactgccggaaagggctgaaaatacctttgggaaacccataatattgcccgcgaattaaaaaaacggggtaacgggaaatgtaaccaaaactgggtctggagagaaccccctcttagtgtatataggaaacccaaaatggggcgaatcacaacgagggacatttacaaa

SEQ ID NO: 700723 - DNA, 120 bp, Homo sapiens
cctctgaagaccgtggcttgggttgagaaatattatggcacttaagacagtgctttggatggaggaatatcatggaactttagttttcccgctttattgagctttggctgcgtaaaagtg

SEQ ID NO: 700724 - DNA, 200 bp, Homo sapiens
ataatggagctgaaaaattttttctgcctccttgcagtcccaaccatgatagtgtcatagtgccaccccttactcatgtgtttgtggtgatgctggtgtaaacaaacctgtgctacccgtcgtgtaaaattttagcccccccggttatgtatagttcataacccttgatccttataataaatgattatgtccctggtcca

SEQ ID NO: 700725 - DNA, 514 bp, Homo sapiens
  misc_feature (48)..(48): n is a, c, g, or t
  misc_feature (51)..(51): n is a, c, g, or t
  misc_feature (58)..(58): n is a, c, g, or t
  misc_feature (60)..(60): n is a, c, g, or t
  misc_feature (69)..(69): n is a, c, g, or t
  misc_feature (82)..(82): n is a, c, g, or t
  misc_feature (85)..(86): n is a, c, g, or t
  misc_feature (92)..(92): n is a, c, g, or t
  misc_feature (284)..(284): n is a, c, g, or t
  misc_feature (286)..(286): n is a, c, g, or t
  misc_feature (323)..(324): n is a, c, g, or t
  misc_feature (374)..(374): n is a, c, g, or t
  misc_feature (381)..(381): n is a, c, g, or t
  misc_feature (395)..(395): n is a, c, g, or t
  misc_feature (417)..(417): n is a, c, g, or t
  misc_feature (445)..(445): n is a, c, g, or t
catgaatcatcagtaaggagctcgaaacgtcgttacgttgaaacgatnatngatcatncncacaagganccaagctactggntgnntcgagnagaggggtgaagggtctgtgctagatcataaggcacggggtggcgatgtggcagagaagttgcttgtggggagaccttgcttttaacaggcttctggaaaagctagggaaaagtggttgcccgctttccccctttccctccccttcaagcaccgctgagattgggctttattattaagagctgctataaaancngcttgcttaaatgttaagagaagcccaggggtacttnnagcattccttcggatgcttcactccagaaagagggagttgaggcaagtcntcattantaataaaaatcagntgaggctgacacttctcttgancttaggataatagcgctttgttgtctcncctgccacaggaaggctccatggttgtcctactttaagccttcggtgcctttagtgggggttaataggg

SEQ ID NO: 700726 - DNA, 136 bp, Homo sapiens
  misc_feature (20)..(20): n is a, c, g, or t
gtagggaatttcccccaaanacctgacttcccaccatcagcctacctgagtagctgggactacaaatgcgcaccagcacaccaagtaaatttttgtatgttttcgtaggacggtctatgccgtgttgcccatggct

SEQ ID NO: 700727 - DNA, 132 bp, Homo sapiens
cacgaggggtcaatatggtctctctatcaaatgaaacatcggtttcttcacatctggatcagttttggtctgttacttgcatctgcacagggacacatcttcacacctgtgcttgatgctgcgtttaaaatg

SEQ ID NO: 700728 - DNA, 273 bp, Homo sapiens
cctgaacctcatccgcgcgttcacgcagggaggattcgccgacctgcgcgaggtgcactcgtggaacaagggcttcgcgcagaacccggcgaaccagcgctacgagggtctcgccgccgagatcgaccgcgcgatcaagttcatggaggcggccggtgccgacttcgacgagctgcgccgcgtcgagttctacacgggtcacgagggtctgctcatggactacgagcgccgtatgacccgcatcgacttccgcacgggcacgccgtacagcgc

SEQ ID NO: 700729 - DNA, 1352 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtggggagacagtctctcattctgtcacccaggctggagtgtagtggcacgatctcagctcattgcaacctctgcctcctgagttcaagcgattatcctgcctcagtctcccgagtatctgggatgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 700730 - DNA, 1140 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 700731 - DNA, 364 bp, Homo sapiens
tggcagaggcatgcatgtgctgtcctagttccagcacaggtgagaagcgccaggaagtactggtagcttgactagctggtaagatagttatcattctgtcgtaactgggttgaaactctgacttttggcacagtaattcctggggttctggctttgggtagcatcaccagggctatttgggtggggcagacagaagacacacagctggctgtcctctctctcctcgtcatgatgggtgcaccagatgatgctgttgtccatcgagatagggggagtgtaccccttctcagaatgggccatttacaggggagcttgggagaaccaaaagattggggagccccttagagatgagcgcctactcctt

SEQ ID NO: 700732 - DNA, 324 bp, Homo sapiens
  misc_feature (197)..(197): n is a, c, g, or t
gcaaaactgacctgtgttggttgaaagcagtgtattaagggcaaaagaggtcacctgggtataaagatggcaagaaactgaaggaaaatgggcatttcagtttcattattcagcagatgggtacctattagctcaaaatcaataacctcactgaatctgatcaaggggaatatgtttgtgagatttctggtgaaggnggacgtctaaaaccaacttacaatttatggggcaagctttaagagtatccatgagaaggtatcaaaaatttccagtaactcaggaatccagttcaggaaacccctgagtcaacaagtaacccagaaa

SEQ ID NO: 700733 - DNA, 1554 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtcttcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 700734 - DNA, 1517 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtcttcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 700735 - DNA, 171 bp, Homo sapiens
  misc_feature (80)..(80): n is a, c, g, or t
  misc_feature (87)..(87): n is a, c, g, or t
  misc_feature (96)..(96): n is a, c, g, or t
  misc_feature (143)..(143): n is a, c, g, or t
  misc_feature (153)..(153): n is a, c, g, or t
ccgcgccgggagtccccttggtttaaaacccggctttaagggccctggcctagttccccacttgtttttcaggggggaancaacttnttgggcctnggctttgagttggaaaaggttttaaaaaaagtgaaaagctggaatgngggggaaaanaaaaagcttttttgccca

SEQ ID NO: 700736 - DNA, 239 bp, Homo sapiens
cctccagagaggctgggagtacaggcgccacctccatgctcagctacacttgtttgtatttaatcgtaaaaacagggttcaccatgttggcaggtgggtctcgaactcctgacctcaggtgatccacccacctcggtctcccaaagtcctgggattacagtcatgagccaacgtgaccagccaatgaaaaagcaggacgaggacttgaaggaacggatgagcacgctgggatcccaggg

SEQ ID NO: 700737 - DNA, 433 bp, Homo sapiens
acagagcacagtttattccacaatcccattgtttatgtacctgtcatgctgtttaacaaattgaagagagagagagagccagaaggagagatagataaagaagagagagagagaacaaaagaaagagcttgattctaagtaatatcttgtcactagggtattggattgttcaataaagatgctatgttttagggatttatttagattacatcaatgctgttggtctgattgactaagagtaagctagtcataaagtagtcataaagatgcatgatggttcttacttggagaggaataacctcttccctgatcttcaccctctccttgtgcttcttcttccttgttctcttggctttcagtaggaagtcttccatcttctcctcctcttcctcacccttgacttgcaggtctggtcgacgcggccgcgaattta

SEQ ID NO: 700738 - DNA, 1228 bp, Homo sapiens
  misc_feature (1045)..(1046): n is a, c, g, or t
  misc_feature (1049)..(1050): n is a, c, g, or t
  misc_feature (1055)..(1055): n is a, c, g, or t
  misc_feature (1064)..(1064): n is a, c, g, or t
  misc_feature (1068)..(1068): n is a, c, g, or t
  misc_feature (1070)..(1070): n is a, c, g, or t
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgaaaaaaaaacccgggnnttnnggggnggaaaaagnaagngntggccttgggaagtcttccctgcccccttctgaacgggggaatccggcccctagggggggaaattccagccggcatctgcacgagaatcaacagaagtatgaacgagctaacaaccgcacagggggggcccattagccccgaatcacatataagcacg

SEQ ID NO: 700739 - DNA, 154 bp, Homo sapiens
  misc_feature (63)..(63): n is a, c, g, or t
  misc_feature (70)..(70): n is a, c, g, or t
  misc_feature (79)..(79): n is a, c, g, or t
  misc_feature (126)..(126): n is a, c, g, or t
  misc_feature (136)..(136): n is a, c, g, or t
cattgtgattttaagactcataactagttcccatccaagcatttgggtaacaatggtgtgaancaacttnttgggcctnggctttgagttggaaaaggttttaaaaaaagtgaaaagctggaatgngggggaaaanaaaaagcttttttgccca

SEQ ID NO: 700740 - DNA, 552 bp, Homo sapiens
catgaactgggtctttcctcaattttccaacaaaacaaaacacttagcggtggagtaaaagaaacttaactggaaggttggggagaagacacagggaaatgactatccaaaagtaagtatcagctctcaccacacccagaatccatgcaacatcacagcatgttctttcggccatatccggagctctgagacttcaccaggtggcagaggccagggccctccctctttcaacaacagtcctctctttctatgaattcacttctcccttcccaccccatgaagaaggggtcttagagggtaacaacccaaaggagtctatcggcctggggataataatctagtcggggcggctggccatccatgagcctacattcattcattcattcatgcaggaactatcacttagttggtatcaggcatggtactaggggaggaggttatagcaacaaataagacggacaggaccctccttcataaagaagacaaacaataagctagtaaactaaaaactatacctgacaattacaagtggggaggctttctatgaaatac

SEQ ID NO: 700741 - DNA, 315 bp, Homo sapiens
agttgttttacgtcaccatagatcaactaaaaaaaccacagcttgtgtccactcaccaggaccctggatctcacaggtgtctcagaattccttctcctgggactctcagaggatccagaactgcagcctgtcctcgcttggctgtccttgtccatttacctggtcacagtgctggggaacctgctcatcatcctggctgtcagctctgactcccacctccacacccccatatacttcttcctcttcaacctgtccttggctgacattggattcacctcggccatgtatcccaagatgattgtggacatgcaatcg

SEQ ID NO: 700742 - DNA, 1171 bp, Homo sapiens
  misc_feature (988)..(989): n is a, c, g, or t
  misc_feature (992)..(993): n is a, c, g, or t
  misc_feature (998)..(998): n is a, c, g, or t
  misc_feature (1007)..(1007): n is a, c, g, or t
  misc_feature (1011)..(1011): n is a, c, g, or t
  misc_feature (1013)..(1013): n is a, c, g, or t
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagttaggtttcctcttcattcaacacttaatgttgagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgaaaaaaaaacccgggnnttnnggggnggaaaaagnaagngntggccttgggaagtcttccctgcccccttctgaacgggggaatccggcccctagggggggaaattccagccggcatctgcacgagaatcaacagaagtatgaacgagctaacaaccgcacagggggggcccattagccccgaatcacatataagcacg

SEQ ID NO: 700743 - DNA, 148 bp, Homo sapiens
tctaacttgtgttgaggagatgtataagaaagctcatgctgctaaacgagagatcagtctataaaatgagcgcagaagaagttacaagaagaggtggaccgtcccaaaatgttccttgctcagaaagaagggatggggtagcgtccaa

SEQ ID NO: 700744 - DNA, 984 bp, Homo sapiens
atgatgtgctagaatgattttattaacatcatgagctgggggagggggggagaagaaaggtgtgcttttgtgttgttgtgtaaagaaatatggcaggtataatgtgtcaccgttggtattataagaaagggtgagtataatatatcacagggcagatattatatctgtggtagagatgatatatatgatatctgttgtgtgtggggttgtatatatagggtgtttttagaaaaaatattgtgtgtttttagagagaaaaccacacactgtgggatatagtagagaagcaatatttgtaaagaagcgctctctcacaatatgtgtgaaaacacatgtgggtggctctgtgagattatgtagagagagagagaaaaaaatatatatagggccacatattataattggtaagtagctgcacgaggtttttttctcttgtatatcagagacacttctcccacaaatagagctgtccgctgtgggagagagcgcacgagaagtgggggaaaatactattgtgagaagcgcgctgtctcacagagagagcgcacacagaggatatatccacactatgagaggaggagataatacctcgttgtgctctttaaaacattccctcctcgcgcagaggagagaatattaagatacgctcacatttttaagagaaatatttttgttatataaaatatttaccggtctcttaagaatatgaataaggcatattgtgaagaaaactccccagacttctataggataacatcaggggatagaccatttaaagaggtggaaggacacacaataggatccctttctacaacacatattgcccttgacacaaacattttttctacatccacaatttttttctcacatgacatattttttgtggggggcggggccgcgggggaatttgggatttaaatttttaaagattctcctataaatttaatccccagtccaaaaaagtgggccaacaattttacttta

SEQ ID NO: 700745 - DNA, 215 bp, Homo sapiens
tcgctctagaggatccgcgtcaggcgaggactgtggactgccacccttagtacgagcaagtcaaagatgccctcggtttacttctcgttccttctcgtccgttaatgacattaacactattctcagcagagctcctaggggagccagagaattataccctagccaatggcttacacacccctccccacagtcttcgtctgatgggtaccgagctc

SEQ ID NO: 700746 - DNA, 232 bp, Homo sapiens
gcgactctagaggaccccaacaccgtctgagaactcgggtcttactttcggctctcctctcaagtatactagttaatcattactgcaaaagtatagagggttattccttgctatattatgcttggttataatttttcatctttcccttgcggtactatatctattgcgccaggtttcaattctctatcgcctatactttattttgggtatatggtttggcttaggttgtctg

SEQ ID NO: 700747 - DNA, 92 bp, Homo sapiens
  misc_feature (45)..(45): n is a, c, g, or t
  misc_feature (47)..(47): n is a, c, g, or t
ggtcagcccagctcacagcccaactccaacgtcagctctggcccngncccatctcccagtagcttcctgcccagcccctcaccgcagccctc

SEQ ID NO: 700748 - DNA, 366 bp, Homo sapiens
acttttccccggcaggtttgcctccctaagtttgtgaagccgcagccctgccctgtcctgtcctgtcctgacttcatttttccttttggccaagtttgtgtcccatcagacttgcagcctttcagcttaacagttggccggtcctgctggccccttttcctttggcccccctttttttaaacaggatgtgcacacatgggccatagccctaaggactcctgccagaccccccagcccacacctgggcctgtttacgggtgttccccccccccctttttattttggagcatatcagggaaaaaaaagtttatgatagattgccttccccctcccagggcccaaattaaggttcgatgcccactttta

SEQ ID NO: 700749 - DNA, 334 bp, Homo sapiens
ccgcggcgtgttcatgcaaaataaattgaaaactttctggaaaagctttatcattctagatgccattaagaacatttatagccaggtatggtgtctcatgcctgtaatcccaactcttttggaggtggaggtgggagggttacttaaggcctagagttcaagaccagcttagacaacagagtgagacccaatcgctacaaaaaaaaattccaaaaaaaaaagtgggccttggggccacatgcttgtggcccaaacaactgggggggttggggcgggggacctgcatgaccacaccaggggggacccgggctggatttcgaaaccatggccatgg

SEQ ID NO: 700750 - DNA, 421 bp, Homo sapiens
gacgacttttaaacaggaaacagtatactactctgttgtcagtcgaaaaccctctgtgacttgacagtcaaacatccttttctgtttggtgggcaacctatcagatgtcagtatctggtcagtactttatctattctagcattacctggcacatcgcgaggcctccgtaagtcctgtcgttgggactcaggtaagtcctgaggttgaatgaaggcataagcgtccccttaaatatacttagagaatcttaacttagttcgaacttatttcatccccttctcagatttcaaatgtgaaaggtcagtgtactttagtcatctgtctgccacgtaaagccaagaatatcaaatatactcaaatggagaaaagtatgttcttatctctttcattttaaaggagatatttgaagtatcagtactca

SEQ ID NO: 700751 - DNA, 394 bp, Homo sapiens
tcttatcagggcagacaggcaggacaggtagcacagggcagaagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccttcctagtgcggccgctctcctaccgctctggcgcactgcaatctccgtcactgccacccacccgcagcaaggcaagccgtggtgtcgcaggctcaaggtgtctccacatccgtactggccca

SEQ ID NO: 700752 - DNA, 245 bp, Homo sapiens
  misc_feature (226)..(226): n is a, c, g, or t
gatccaaatcagagcgtagtgccggtctgcacactagagactagacagataacgacgctactatagaactacgtgcagcgcatccttgaagcaggctgttgtcgtgatggctgtgagaaccagccattggtgattacattgtggcagagccagggcttgtcatgatatttgcgccttgtgtgtgagagatataagagaactcgactgggtatcaggaagagatggnaatcagagaaatcccatca

SEQ ID NO: 700753 - DNA, 250 bp, Homo sapiens
atcacactgacctggcagtgggatggggaggaccaaactcaggacaccgagctttttggagaccaggccagcaggagatggaaccttccagaagttggcaacttttgtggtgccttcttggagaagagcagaggatacacagttccatatttcacacacagagagggctctcccgagacccctcacaccttagatatgaagccctgtttccagacccaccatacccatagtgggcatatctttctctgcc

SEQ ID NO: 700754 - DNA, 80 bp, Homo sapiens
ctggtggtctacccttggacccagacgttctttgactcctttggggatctgtcctctcctgatgctgttatgggcaaccc

SEQ ID NO: 700755 - DNA, 261 bp, Homo sapiens
caccagcaggttcctaagggtttcagccataaaatgtaaaacctggataatcagtgtatgttgcaccagaatcaacattttttttaactgcgaaaaatgatgttctcatctggaatttattttctcattcttttggcatctatagctaatatattttatgttgtaaattgttctatctagcatgttaaacaaagataatatactttcgatgaaagtaattataggaaaaaattactgttttaaaaagaacttgattatgtt

SEQ ID NO: 700756 - DNA, 131 bp, Homo sapiens
gcagcaacatttgttacaagagacatctgaaccttatcccaggctggacagaaggcctcagctgctttttcgcgttttggctcagtcatcaccaaaaagctggaggatgtaaaaacctccccaccttttaa

SEQ ID NO: 700757 - DNA, 1204 bp, Homo sapiens
  misc_feature (400)..(400): n is a, c, g, or t
gtcaagactctactggttccgataaactgtgggtcaccagcagtcatatctcatgaactggagccatcagtggtttggtgtcctgggtcgataatggaatggggcaatgatattctgcgctgtcacgtgaggcgtccttggcaaaatacgtgggaacattatcgctcgattatactcgtctacatcacctccaagaggcatcgccatttggatggatcgtaatctatgtgacatgtgtagtgattggaactaattacgaacgagtgcttatgaatcctatacctcgggcctgattctccaaaccaggcggggagaacacaccgatctcgaacatatcaggagcactcgttgtagatggataggttgacgctcactagatagagggacagcttggtacttngtggaactattgctcatagaggaacttgtgctggaggttgaaggagtgaccattccggagcagatgcgaatcacaatgtcgacgttcaagtcttatgaggcaacttatcccatgcgttatctatgaagatggatgcctaagggacatgtggaacgtggattctccggttggcccgcgcaaactctgtgatcatatcactacgcttgtggtgtgtagggaaacaccgcttggagtccctaatggattccctgcggtcgtgcatcctagcggctggggttacccggtgctctggctaaaggggcaataagacttacacgccccagcgaagggcatttcgccctgtacttattggaacgcgtgttagatacatttgcccacgcacgtgtagaaaatacgcatgccattggcattcgtacttccaccaatatggtgcacttttccccgaagacagacacatgcggcacaatccttcttttatggcacccggatgggacttagcctacgcccaagatacgtgcgagttggttccaaagggcctttccccttccgcaagcggaatgcccgccgttaacgttctcaaccgctacccacagtgtcatgcctcaggcctatccgttgcacacggaaagctggaacacaaattggtaatgcgtgtcccgtgggggatggacacacatgtgcaagccccaggaaggggccttgatgcgggaaggtgcggcccttcccgaacccattaaacctcggtcatacctgagatagaattcaacccccaggacgaccttggtacatacagtacggatccac

SEQ ID NO: 700758 - DNA, 82 bp, Homo sapiens
gcagcggcagcgggagctgtccggaggccggcgtcgagggtttgccgctgtctctgctattcccatcctccccataggggct

SEQ ID NO: 700759 - DNA, 571 bp, Homo sapiens
gctgcctcacttctgcttaggaaagcggctgttgctccataactctaaccagcacagggctgaggcctgcaggtgcacacctggcagggtaggcccttcccaaggtgtggtgactgtgccttactgcaggtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgagaaaaaaaaaaaaaaaaaaaaaaaaataagaaaagagaaaaaaaaaagaaaaaaaaagaaaaaaaaagagcaggacagagaccgagaacaagacgataacggaatgaccagtctcgaagaagagacgaaaacaagacaacaatagagtaaaagcatcacgaaaacaaaagccacacacgcgcgcagaacacgccccaactgccagggagagaaacgccacaagaggagaagcagacgctcacgggtcagacgaagacatgaagcagccagcccaccaaacg

SEQ ID NO: 700760 - DNA, 372 bp, Homo sapiens
  misc_feature (366)..(366): n is a, c, g, or t
  misc_feature (370)..(370): n is a, c, g, or t
  misc_feature (372)..(372): n is a, c, g, or t
gaacaacaaagcctagatgaccagccaccacctgtttaagggccatgatttattgaaatattttgaggcccactgttgagaccctcttgcctcacaaaaaaagatttccttttaaaatatccactgtcccattgacaatgaaccctagacaccctgagagcctctgatggaaatgtacaaggagattaatgttttcatacctgcccaacacagcatctgttctgcagcctgtggatcaagaagtcatttcaacttatgagtcttattatttaagaaatatatttagttatttagtaaagctatagctgacatactttcttgagatggaatctactcctggtgaagatgctgtgaacatttgaaatntttngn

SEQ ID NO: 700761 - DNA, 120 bp, Homo sapiens
ggaacaagcacgttggtggatggtcttggctgtacataagctttttcacttcatgtaatcctattggttcactttggctagtgtgcctagcaaaagtgatgtgttccccgctgggtaccg

SEQ ID NO: 700762 - DNA, 372 bp, Homo sapiens
  misc_feature (259)..(259): n is a, c, g, or t
  misc_feature (266)..(266): n is a, c, g, or t
  misc_feature (326)..(326): n is a, c, g, or t
  misc_feature (371)..(371): n is a, c, g, or t
aggggcacgagattccttgaaacccaagaagttgaggctaatgttgagctgagatcacacccactgtactccagcctggatgacagagttggagactctgtttcaaaaaagcagaaaagaaaatatagtttgattctcattttttaaatttgcaaatctcaggataagtttgctaagtaaattagtaatgtactatagatatactgtacaaaaatgttcaacctaaaacaatctgtattgcttatgttttatgtatacncttgtcntttaagactcccaatagcctttgtaactgatggcttacttaataaatcggccattcttcnatcttgccacaaccatctattccaggcaccattataaccatccgng

SEQ ID NO: 700763 - DNA, 194 bp, Homo sapiens
tccataagttgaggctcagtagagccatgattgtgccactctaccctagcttgggtacacagtgagacccggtctctgggacaaaaaaaagggcaggaagtttatggtggcctaaacagtgttccaatcctagtaagtactttggtactagacacaaaattttactttgaacaagccgcagaccgcggcccgtt

SEQ ID NO: 700764 - DNA, 403 bp, Homo sapiens
gacatgtgtatagcggtggacatagtagaatgagtgccgatatagccattatatggattggctatttggataatgcaaaagtatatgacttggtttataatgtgatacgccataaatattaaagtgttgaatactaacagtgctgactacaagaaggatgtagtattttggctttctgcattacaacgtcttctggaggaagggagcaggatgggtttcattggtatctagtgtgtgtcttaccatctttctaaatcggcagtgtaactgcatagtttaacttcctgtctgtctccctcatttaactcttccctccttgtcttatgtatgggctttggtgtatcagagcatctttcttggcagcatcctagtcttacggtttcaagtggtcgggtaccgagct

SEQ ID NO: 700765 - DNA, 370 bp, Homo sapiens
ctgacctcactttgcgagtcagtccggtgaggacttcaatctctgtctcttctagctgccttcctcgaccgcactctcagggctggccagtgaggatgaggagggtatgagagtggatatgcgttcctcccggtaccttctcatatgtcaaatggtcatcgttggctcagtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagcaaagagg

SEQ ID NO: 700766 - DNA, 310 bp, Homo sapiens
ggtcggacaggatgggtccccaggttggggagagcccaagtgagacaataatgaacaattactgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaagcggaccctagg

SEQ ID NO: 700767 - DNA, 160 bp, Homo sapiens
tcgagctcggtaccagtgaaaagcagctgatacacatttcgccccctttgttcccccaaagtacagtgcttgtattactgggatattctaagtaatcttttctgtttctttgcagctgtgtgatttattgttcatttaatggggaaaagaccctgatgat

SEQ ID NO: 700768 - DNA, 254 bp, Homo sapiens
ctctggggaggagggtgcttttctgagacactttctttttctcacacctgttcctctccagcaggccttggctctcttgaacttttggccgccatgtgcttcccgaaggtcctctctgatgacatgaataagcttaaggcccgaatgcaccaagccattgaaagattttatgataaaatgcacaatgcataatcaggacgtggacaggtgatgtctagcctgacagatcttgaggacgactttcaagagggctt

SEQ ID NO: 700769 - DNA, 119 bp, Homo sapiens
gaattgtatattccggtcggttccaggccagtaatagtagcctttgtgacaccagtgcggggccgagggaccacttctctgggaggagacccagttcctcatccttgggacggggtacc

SEQ ID NO: 700770 - DNA, 645 bp, Homo sapiens
gtggtaacctaggggtggcagatggctgtgatcctggcaccaaagaggcccgcggatgcggtgcggagactccatgaggccctggacatgaacaagctgagtggaggcggctgtggcgcaggactctggtgtgtgaacgtgtgtgtgccatgcttgggaggcgagtgaatgtggaccctgccactgggagcttatgtcaataagcccatgcggggctggctgcatcccaactgacaaagtcatggtgacccgttggtttcctacttggttcggtacatgggttgtgtggaggtcctccagtcaatgcgtgccctggacttcaacagccggactcaggatcaccaggaggccatcagtctggtgtgtgaggcttgtgccgggtgctaagggggcgacaaaggacggagaaagcccatgtagcctggccgctcagctctatcctggggaggagtaaactgaaatatgctggaatgccaaatcactctcaccgtgtccaccagacaggcctcaacgtcatgggcggagaagtgccagaccagaatcatcggcaagcaagcagcatgcaaatctatactcatagtgcgatccggacgggggatccggagcaaagagcgagtatgtcggcgtatgttggcaaaagaccct

SEQ ID NO: 700771 - DNA, 1096 bp, Homo sapiens
agcggcggaggttgcagtgagccgagattgtgccactgtactccagcctggcgacagagtgaaaaaaaaaaaaaaagaacatcttatatatatgtaaagattatagactacggggccgggcacagtgggctcatacctgtaatcccaatacttgggggaggcagaggcaggaggatcacttgagcgccaggagtttgagaccagcttggacacacatggaccccattctctaaacaacttgggcaaaatttgggccaacgtgcacggggtgtacaacaataagattccagggtactcgggaggctgcagggacgcgaacgtgactagcttgcgctccacggaagttcacggccttgtacacgcctggccgactgtgtgcacaccacgggcacccctccacagcacagtgcgagcccacaaggcgagcgaaaacgatcaccatacataaccaacaagcaatacgcccaggtacccgccgaccaacacccccgacagcgccccacagacacgaccaccacagacaccaaacaacaacaacacgaacgaagcacaaccaacacagacaagtgcaaggactacacattaatacacaacaaaaagtagagttcataaccatcagaaaacagaaaggagcaagatctacctccatcagagaagctcgaaccacaagtgccaagacgcacaacgtaaccagagacgacgtaagacttcgcgaacacagagcagacaccaagtaccactacacccacacaaagtgatcagcagacagcaccactgtgcaccactttaaccacgccaccccccagcgcaggacgaagcggcgcacacttagcaagtctgcgatcaagcgcaaacaggggcgcgctatgtcgaataacctaacacatagaatgcgcctctctcggcctcgcaaaccatacggccgagcctcacacgcaccaatggagacagaatcacagaggcggcgacaatcataacccaccgcacatcaatatgaacgacccacgtcgggccctcacccaaaccaccacacaacaagcgcacatacagcacaacgggacaggagcattacccaagacgagacaccgatgcaaaa

SEQ ID NO: 700772 - DNA, 519 bp, Homo sapiens
cccgggcgttgtgaaaagaggaaggaatcgggacacaggattgggtcctcggctaggtgtggttgctcaggttgcatctagagctgaagcctcctcgcgaggcccccagtagcgagtgggcgaacgagctgggggttcacagcagcgccccaggcgcgggcgcaggagcgggcgggggcccggcgggcgcgcggggaggtgcaggcttcaggctagggcggcgccttcgtctccggctgctgtaggaccgcggagccaccgctccatcggcgacatcttggtggaggacgcgcaaggagaaacgctgttcgcgctatagctgctgcgccacgatctcagctgacctccggagagcggaggatagaacaggcaggaggcggcagcgcggagcaggcagtcggcggcgcgcggcaccatgtccccgggcagcggggtgaagagcgagtatatgaagcgctatcgggagccgcgctgggacgaatacgcgccgtgctaccgcgagctgctgcgctaccgcct

SEQ ID NO: 700773 - DNA, 141 bp, Homo sapiens
cgcaaaatatttgaattgtcaaaatatgtgttcccagctgaggctgaacaaggtgacacacaaatctcttgtatcagctctcatactgtaaacaagcgtccttacttgtggtactactatagtgccagtgtttctagtatt

SEQ ID NO: 700774 - DNA, 407 bp, Homo sapiens
  misc_feature (8)..(8): n is a, c, g, or t
  misc_feature (17)..(17): n is a, c, g, or t
  misc_feature (39)..(39): n is a, c, g, or t
  misc_feature (47)..(47): n is a, c, g, or t
  misc_feature (53)..(53): n is a, c, g, or t
  misc_feature (57)..(57): n is a, c, g, or t
  misc_feature (70)..(70): n is a, c, g, or t
  misc_feature (105)..(105): n is a, c, g, or t
  misc_feature (142)..(143): n is a, c, g, or t
  misc_feature (156)..(156): n is a, c, g, or t
  misc_feature (182)..(182): n is a, c, g, or t
  misc_feature (203)..(203): n is a, c, g, or t
  misc_feature (217)..(217): n is a, c, g, or t
  misc_feature (220)..(220): n is a, c, g, or t
  misc_feature (237)..(237): n is a, c, g, or t
  misc_feature (242)..(242): n is a, c, g, or t
  misc_feature (245)..(245): n is a, c, g, or t
  misc_feature (263)..(263): n is a, c, g, or t
  misc_feature (287)..(287): n is a, c, g, or t
  misc_feature (295)..(295): n is a, c, g, or t
  misc_feature (300)..(300): n is a, c, g, or t
  misc_feature (307)..(307): n is a, c, g, or t
  misc_feature (333)..(333): n is a, c, g, or t
  misc_feature (375)..(375): n is a, c, g, or t
taaggggngcccttttnttcaactgggctcaagtcagtntccagggnagcccnggcngcctccccccccncccagggggaccaaaagccttcatacatctcaagngggggggcaaaaaagggggggggggggggccgggggnnccccattcaaaanaaaacaaaaaaaaaaagtttttaggngaagattaaaaaaattttgcntttcataatttacncgnaagccatgctatccccnccccngtntgggcttgggggggggcngggcccttctcctttggggggggngggggggnttttngggtggnaaggggcttcctgttacaatgcctcncatatttgggatgacttttaaaaaaacaacaatgtgccatcnaagtcctcggcccccttgtgaactttgggggg

SEQ ID NO: 700775 - DNA, 132 bp, Homo sapiens
tcgcaccgcttcgtgagactcacctgcaagaagggaacttgagaagagctgccatagtagcgggggctttggcttaggaatctgggaccccaaggagaaagtagatgagccatcttgtcaagttcctgtgcc

SEQ ID NO: 700776 - DNA, 641 bp, Homo sapiens
taggccgtgcagttgtccggtaccaccctttcctctcgttgcggccgagcttgggtgtttggattcctggaccgtttctccctccacgtccgatgtttccaaggggttccgttagggcgactctccgttggtccctcggttggatcttctgctcggcgtgcccgcgcgtcgctgtagctgttggagtcgctgtcccgctgacaggatggtgtgtgtggtggtcgtgaccttgcgtcgtgtgtgaggactgtgccttattcaggcctcccgcgacccctcgctttcctgtttgctgatgagcggcagcacgccagtgtcgtctgttcgtcctctttgcgctcgcgtcgctgcgggcgcggtgaagcgcgatacatcttatttctctctctcttccttcctctcctctctctccctctcctctctccctctctctctctctcttctctcttgtcgacgcacgccctcccctcccctctctccacttgatcagacgatccatgtaaataaatatatcaaataataaaaaaataaaaaaaaaataatacatcaaataacaaaaaaaatacaaatcatacaaataattaaacaaaaacacacaaccacaacaaaacaaacaaataaacaaacacaacatagtcaaa

SEQ ID NO: 700777 - DNA, 285 bp, Homo sapiens
  misc_feature (215)..(215): n is a, c, g, or t
  misc_feature (265)..(265): n is a, c, g, or t
ttcggcctgacgccggtggagcgcagcgagacccggctcatctgccgcggtgtcggttcggcgcccgtgatccacgtcacggaaaagggagagcccggcttcgccgccatcggcttccgcgccgagagcctcgccgatctgggacgcatggccgaagctgaaaagctggctgtagaagacctcgactggcccggcggcggcaaggtcgtgcgtcncaccgaccccgacgggcacttgattgaagtggtggccggccagaccccgncgccagccctgcccctcccg

SEQ ID NO: 700778 - DNA, 500 bp, Homo sapiens
accgcccattaaaaaaaaaattaaaaagaagtgttttttgcctttttcatgatcctgaggccttcccagcctggtggggctgttagtgcaattaaacctctttttcctcccagtctcaggtatgtctttatcagcagcatgaaaacagactaatatacctcttctaatgaaggaagcagagatatggaccataccctgtgttcttcctataatatacgggatgtgtactgccagtaccacaatttgctaaacctcacaaattgttgggtgttgtaaggaggtgaagaaagttccaatttataatcatctactgtatttggcctgcttgagttgttgctctccaagcattgttcctaggtagattttcaggaatgaagatgaattatatattacaaactgttgccgatggcagtccagatgaatttatatggacaactggctacctggccatataccaagccagcttgacccagtctttttcaggccacttcagagagaga

SEQ ID NO: 700779 - DNA, 113 bp, Homo sapiens
  misc_feature (17)..(17): n is a, c, g, or t
  misc_feature (39)..(39): n is a, c, g, or t
  misc_feature (97)..(97): n is a, c, g, or t
tacatatagacttgagntagtaccctcggataaggggcnagccaagacaggagcatgtgtgccctcattttgtttctacttttaatttctgtgtgtnggccttatcgaggagt

SEQ ID NO: 700780 - DNA, 354 bp, Homo sapiens
gtcccttttccccttttggggcccccgatagaccagttgtagctcattccagcctgtcccttggatgaggggtagcctccccctgcatcccctcctgaatttcctttgcacctccccaagggggcttttttaagggttaatccttttaagagaactgcggcgttttattgtggttctccccctgccccttgccggcttggggggcccccctcctcccgccccaaaggaaaggggggccgctccggggcccccagagggggctgttttcctgggggttcccttggcggggggggggtttactggccggcctggcaaggttgcatttgttataaaggcccagctgtttaaaaccca

SEQ ID NO: 700781 - DNA, 366 bp, Homo sapiens
caggaattcggcacgaggttgaataaatttttttacttatataaaaaaggtcagctggacacggtgcctcacgcctgtaatcccagcacttcgagaggccaaggtgggcggatcacgagctcaggagatcgagaccatcccggttaacatggtgaaaccccgtctctactgaaaatatgaaaaattagccgggtgtggtgacaggcgcctgtagtctcacctactcgggaggctaaggcaaaagaatggggtgaacctgggaggcggagcttgcagtgagctgagatggcacccctgcactccagcctaggcaacagaacgagactctgtctcaaaaaataaataaataaaaaacaaaaaatataa

SEQ ID NO: 700782 - DNA, 945 bp, Homo sapiens
ctcttgcttcaagtcagagcggtatgtgtgataacctctcaataatgttgggtttacgatgcccagtaattaatttacttcaacatgaaattgagtatgatgaagtgggcatctatccaagtatttgggttgtggtcaagtttgtatagttattattgagattggagatctccagcctggggcagacagagtgagactcataagagatggaaacagaaggaatacacggaaagaaaagttggcttcgggagccataaggggggacttaattcatagcggggtagtgtaagaaaagttcctactgtgaatgatgagttgaattctcagggcaggaacttttgagaaatacaatttagtagattaggcctgcaatgggagtagaagatgggagatgatgtcaggcagaagacgataagtacataaatgcgactgaggaacaagaagaagaagcttatggtgattgtacagggaagtgggggatgtgccaatagaaaaggctatggcgatggttgtcgatctgtattcgacgccgcttttgggcttcgccaaggtggctgggtttgacaagagggttgatggaattgggactctggcacacgaaagttgaggttttgtatgatggtcctttcatattttcagataaaacataatgattatggagagaacttatgataaagggcataaggccaatatcttgggcatggaaaaattttactagaggtgggaaaactttacgggcctttaactttgtgccaaggacaaccaaattcatcttggtaagctgaggtttgaacattgcatattagtcatcgacatatatatgggtgtcgtcccgaaatttctgggttactatgaaatcgcttgatgtgacttggccacccgtgaatgtcgttctttgaaaaaagtattggggaaatataggactcagttgagatgaccaattag

SEQ ID NO: 700783 - DNA, 475 bp, Homo sapiens
gtagggcagatgcgacccacggcgctcgggaggaggaagaactacgtcggaactccagcgccggcggcggcggcggcggcggcggaggaggagaaaggaaagaggaagggggagcggcgagaggcggagacggagcccgacaggggcggcaccacggcacgagccccgcacagtccagtgtcagggagagcggctgctaagagcatggctgactgcctgcctgtctgccactcgacacctgccatagatacatctctcaatcctacgtggccacgcctggtccttgcttgccaggaacgcttcggccccgcagcttcggctttgctgcgtgtctcgaggtttctttaccttccaggaacagacggaatatttgggccccttttaaatttctgggaagttcactttgcacacgaagtcgtgacacacttacggggacctttatttcaacatttgcgaccatggccttaggtcggag

SEQ ID NO: 700784 - DNA, 790 bp, Homo sapiens
acctacagtggaactctgtcaaacgagctatctagcagacatggagctgaaagaccgtagccctttgatgagcttcctgtgtctcagcatcatccaggcccaggtggtctctgagacttgcccgctccgtgtcctgtacatggtacctgatctggtgtccttactatgctgctgagctgggagcctctgcacagtggctccctggggatggggcccatggccgacggatgctggtagcccctgtgtcgctccggcttggtcacctggttctccctcgtcgtgccgctgtcttacgcgtcttcgcttcgtcctgctacgcttaccccgaggcttgactccttccccatgcgtgtgcagtgtgctccactcgtcctgggtcttgcttgctagctaattgagtccttccgtctgacttcgcctcaggcttcacaccgtgcgtgctggcccgtgtgtagggggcagggaagggggaggcaagccggcacccaacagtgccactgccgacctggtgcttcccccgacaggagaacacacactctttccctagaagggttcctgtacacctaggggaggacccttatctagtgcgtgacacacaccaggctgtgtcccctcccggccttggacagcatccatgtgtggccctcaagtcctaactcctccggactatgtgcaacacgcttggagcgagctacgtacccagatgctccacagagcggcgggactacaacctgtgagccagcatggcagaccactactctctcatagacagtcaacagacacccaaggt

SEQ ID NO: 700785 - DNA, 623 bp, Homo sapiens
  misc_feature (623)..(623): n is a, c, g, or t
agagagagagagagagagagagagagagagagagagagagagagagagagagagagagagagagagagagagagagagagagagagagagagagagagagagagagagagagagggacagagagagaaaatataaagaatggagcaagatgaaaaaagattaaattgaaaggggagaaaactggaggagggcgaaacagaagaccacaaaatggccaataagaaagcgaaaaagtgtgagaagggagggatcctaaaggaactgcagaggaaaacgacaaggggctgggaatatagacagcacaaagatgaagaaatttaaatgacaataagaaggctgactacagaggcctgaccacaaagaaggaggaaaagggagcgaggggaaggatatggcaattagctagacataatccaggcagatagaatacaggtatgagaacataacatggacctgcatcaatggaacacaaggaatgttggacaattaaattttaatggaatcatcagagaaagcgcgtctttaaaaacttgcttataaagatggggcagaagatgaaggctggggcacatgatatcgtaaccgaagggagaggtggtttttggcggcctactgggggggcn

SEQ ID NO: 700786 - DNA, 789 bp, Homo sapiens
  misc_feature (764)..(764): n is a, c, g, or t
tggggggggggggaaaaggggcggagaaaaccttgggcgggaaacccaaaaaagggggttgggcccctttttccccccccccgggggatttccatatttaggaattgccgcaatcttcaagaaaaacagcctttcatacccggcgcggggtgctccccccccgcttttataactgcccggcccccgcttccttctctcggtgtcctcccccgccgccgtgaaaataccctgccccacctttggtgtgcgcacgccaaaacggcaatctaccatcattatgtggcgacaggagaaaaatacgtggcgtcttgaagaacacaatattcccacgaaacacatgtgtgtcccttgcgggggttagctctgcacaaaaatatgtttcttgcgaacaactatcaaccgtgtcgttgcgaaccccaaacctactcgccaaaataagaaaaatattcgggctcgtgtcccatctatctaactcaccacacagaggtggcggaaatagagcaggagaaaaagtgtggctcctctgcagtcattcttgttattggggggtctcccccacggatgtgtaaacactctctggccacacaagagcaaccaaatttcttttcttttctcactcaatgcttgcgcctgttaactacacacccagcgtctgtgtgttctcaacaaaaacctgcgggtctccctgtctgtgtgtgtctcttgtgggccccccaatgatatcccaccgcccctccccgcggggggtcccggccaaattttanagaggggcggggacaacaatcacca

SEQ ID NO: 700787 - DNA, 274 bp, Homo sapiens
cccccggggcccgttaaaattttaggccggagggcttttaaaaagccaagaacccgggcctaaataccccccatggttttccagggggggtttccccccccctttttccccaaggccacccccttttcctttaaacccccttttcggggatttttttgggggggggggttttccttttggcccaaacccccataaaaggggggggggccttggtttcttggggttccccctgggggctaggctttaaaataaccccgggccttttggaccccta

SEQ ID NO: 700788 - DNA, 439 bp, Homo sapiens
  misc_feature (12)..(12): n is a, c, g, or t
  misc_feature (69)..(69): n is a, c, g, or t
  misc_feature (87)..(87): n is a, c, g, or t
  misc_feature (100)..(100): n is a, c, g, or t
  misc_feature (297)..(297): n is a, c, g, or t
  misc_feature (300)..(300): n is a, c, g, or t
gaagggaagggncggtggagccagtgggaacacaccaacatttatggattaaatttgccatcttctaangggcacagttcatggcangtcttcacttctngttttccctgtctcatctttttattgttctattccttctttactgttttctttttcactgagtgaatattttctaatgtagtattttaattttattaatgattctttcactgtattttttgagatttgtttttaatggtagctttagcgtttcatgtatatatatataacttaccagcatcaacttcagatttaatnctngcttaattccagtaatatatagaactattactcctttatagctctattcccttccccctttttgtgtggtatgattgttatgcatattatacttatcaatgttataaagccagcagcacattagtaaaatgattactct

SEQ ID NO: 700789 - DNA, 362 bp, Homo sapiens
tagaaggattgcaggtatcagtatatggcatcagcgatctactggagaggatgggtgacgcaggtagtggagagctcgatcctcagagacgaatctgagtgatgcgcacgtgcttgatgggaaatgggatagggataaggaggtaacctacgcagagcttcgtgtataatttaaatcatctctagatttcttataataccaaatacaatataaaggctatgtaaatatgctacaccatattgttaagggaataatgtgcaagaaaaaaaggtctgtacgtgttcagtaccagtgcaatttcttttgtcaaatatttcctatccaaggctggttggatctaaatgtggagaccacagttacag

SEQ ID NO: 700790 - DNA, 749 bp, Homo sapiens
cacggaggctcacgtctgtaatcccaacactttgggaggccgaggcgggcggatcacaaggtcaggagatagagaccatcctggctaacacagtgaaactccatctctactaaaaatacaaacaaattagctgggcgtggtggcaggtgcctgtactctcagctactcaggaggctgaggcagctgaatggcatgaacccaggaggcagagattgcagtgagccgagatggcaccactgccctccagcctgggcgacagagctggactccgtctctaaaacataaataaataaaaatatttaaagagtattgtcactttaaagaatacaatggctgggcgcggtggctcacgcctgtaataccagcgctttgggaggctgaggcaggagaagcgctcgaaccagggaggcggaggttgcggtgagccgagatcatgccattgcactccagcctgggcaacaagagcaaaacttccatctcaaaaaaacgaatacacaatttacacacgtaaataacataatacattacacttttaacatgccatactccaaaataatctgaaaatctacaagtatgacaagttattctcaaatattctttttattgaacaccacttgaatattaccctaaaaattgagcaactgggaggagcaatctattattctgagcaccaaccatgtcccaggcactaaggaacattcgctaagcattttaccaaaaaatctcatttattctccaaaaaatcctga

SEQ ID NO: 700791 - DNA, 365 bp, Homo sapiens
ggatactagagatacccaatgcagctggatcggctagggtgacgccatagtcccagcactctgggaggctgaggtgagtggatcacctgaggtcagcagttcgagaccagctgggccaacatggcaaagccccatctctactaaaaatataaaactagccaggtgtggtggtacatgcctgtggtcccagctactcgggaggctgaggcacgaggactgcttggacccgggaggtggaagttgcggtgagccgagatcgcgctactgcacttcagcctgggtgacagagtgagactccatctcaaaaaataataataataataattaacagtttattaaattcttcctgccgagtccgctgcatt

SEQ ID NO: 700792 - DNA, 405 bp, Homo sapiens
ttaaagtcccatgaacacacctcccagcaaagtccagcatctcggaacggtcggcaggccccacagcacccacagcttatgcgttatgagtctgagacacgcttatatgctgacttcccccatctaagggggccagaagcagactcttgggcagctgtgtttatcctgccggtcgcacatatttgctgcgttccttattctcatcgtcatgtcctaccttgttgggactgagctcctccagcggtgtgtgagttccaggtgtaagcgtccccgtgtccgctaaggtaatgtaccctaacaaggttaaaaagcccccagttagccgcgtgcggtggctcatgcccgtactctcagcaccttggcagacctagacggtctgatcacctaagctcaacagcttaagtc

SEQ ID NO: 700793 - DNA, 229 bp, Homo sapiens
  misc_feature (182)..(182): n is a, c, g, or t
caagctgggggatatcagaggatctggcgtggatccgtaccagtcatgctgcctgaacgccccggatggtgcccatctgtaaccgatcacgtacttgccctcttgcagctgtttatccgagaagttccgaggattctccttggattgcttagggaaccagttgggatccccagagaacttancttcatctcgggctactgccagcccagcacgagcacgagcaccagca

SEQ ID NO: 700794 - DNA, 1102 bp, Homo sapiens
  misc_feature (42)..(42): n is a, c, g, or t
  misc_feature (151)..(151): n is a, c, g, or t
  misc_feature (198)..(198): n is a, c, g, or t
  misc_feature (221)..(221): n is a, c, g, or t
  misc_feature (226)..(226): n is a, c, g, or t
  misc_feature (774)..(774): n is a, c, g, or t
  misc_feature (778)..(778): n is a, c, g, or t
  misc_feature (784)..(784): n is a, c, g, or t
  misc_feature (831)..(831): n is a, c, g, or t
  misc_feature (849)..(849): n is a, c, g, or t
  misc_feature (854)..(856): n is a, c, g, or t
  misc_feature (867)..(873): n is a, c, g, or t
  misc_feature (875)..(875): n is a, c, g, or t
  misc_feature (877)..(878): n is a, c, g, or t
  misc_feature (880)..(880): n is a, c, g, or t
  misc_feature (882)..(886): n is a, c, g, or t
  misc_feature (888)..(891): n is a, c, g, or t
  misc_feature (894)..(894): n is a, c, g, or t
  misc_feature (955)..(955): n is a, c, g, or t
  misc_feature (966)..(966): n is a, c, g, or t
  misc_feature (970)..(970): n is a, c, g, or t
  misc_feature (979)..(979): n is a, c, g, or t
  misc_feature (982)..(982): n is a, c, g, or t
  misc_feature (1049)..(1049): n is a, c, g, or t
  misc_feature (1080)..(1080): n is a, c, g, or t
gagaaagactggcagggttaacaatatctgaaaacacaagtnagagaaaataaaagcgcgtcaattgacatccagcaaacagaaaggaataaaatgccaaaagcagtgtcttggcacactccccacatcattctccaacttgggccttccnagaatcatccagcccctcatcccagccccataagccccagatgtccncaccgaaaccaaggcagaaaccnaaaancacacttgtaggagagaccacaggcaccagagctgccactggtgctggcaccagctccaccaaggccagcgaagagcccaaatgtgagagtggcggtcaggctggcaccagcactgaagccaccactggtgctggcactggcactggcactgttattggtactggtactggcaccagtgctggcactgccactctcttgggctttggctttagcttctgctcccgcctggatccgggctttggcccagggtccgatatcagcttcgtcccagttgcagggcccggcagcattctccgagccgagcccaatgcccaattcgagctctaatctcggccctagccttggcttcagctgcagcctcagctgcagccttcaaatccgcttccatcgcctctcggtactgagctgcccattccttgggatccttcttttgtaccttgcaggcaaacttgaggactttcatcttgctggtctcatagtaagagcgcaggccccagaagaactcatattcagggggattgctattggggactctggcatagtccangtanttctanttcacaaactcatcagtgatgagcttcttcacgtccccaaagagtgnatgatgtatcccagggcncaccnnnacttgcgccannnnnnnanannanannnnnannnnacngatttccattcatgaagatgatgctaagaagcaccatgagcagacccagcttgggtgagtncttagtcgttnccantatgcctgnatnagtgggctctaaggtgctgagagaatgtacaagtggtcattcttatcaatttccttcattgaatccnaataccttctcaaggaatagctgctcgttcnatggattcggggtacacatcat

SEQ ID NO: 700795 - DNA, 451 bp, Homo sapiens
  misc_feature (14)..(14): n is a, c, g, or t
  misc_feature (62)..(62): n is a, c, g, or t
  misc_feature (72)..(72): n is a, c, g, or t
  misc_feature (121)..(121): n is a, c, g, or t
  misc_feature (143)..(143): n is a, c, g, or t
  misc_feature (157)..(157): n is a, c, g, or t
  misc_feature (168)..(168): n is a, c, g, or t
  misc_feature (180)..(180): n is a, c, g, or t
  misc_feature (212)..(212): n is a, c, g, or t
  misc_feature (215)..(215): n is a, c, g, or t
  misc_feature (221)..(221): n is a, c, g, or t
  misc_feature (246)..(246): n is a, c, g, or t
  misc_feature (259)..(259): n is a, c, g, or t
ctcgccgtcaaagnccattcacgattaatgataagctactgcaacccaccagtcttctcatnaacgaatcgnttcaggtgacagaacgaggacaggagggagtttttccagagtcactctncgacttatctcaacctctggtntggttttggtggtntaaccttgganagattctcttgncaccaagctctccagtgcatcctggactgtgngtntcttgnctgactggatatccaactgcaacgngaaaaatggctgnaaagtggaagattctttggaactctgctggtaaaccacagacctgatgtgtccaccaaaaatgccggtgattggagtcttgaacaaaatccgctggcggggtgacggaagtcttggttcccgggggccacttgttcccattcatcctcggttcctcaactggtcttcctgtcttcttcaatcgaccagtggt

SEQ ID NO: 700796 - DNA, 759 bp, Homo sapiens
tgatagtcaggcagtggtaaccacagcccttgggtgagaccccagtaccatactagtttcaggtctgacccagcacagtcctaatagtggtgacaacaggagtatttgtgtcacctctcttctagcctagttagctcagcacagagctgagctgttgggagaacgtaaggaaagagaacatgagtcttttcctggtaatccagacaattcttccagatctgatccaagaccaccaagaagtatctctataagtctgcaagaaccatattgttactgggcttggggtgctccctaatacagatggggctgcagtgaccagaaacttagagcacaacacccaagtgcctttgaatgcttggaaagccttccaaagaaggacaggtggaaacaacaacaagactgtgaagactacaataaatacccaactcttcaatgcccagacactgacaaacatccacaagcatcagattatccaggaaaatatgacctcaccaaatgaattaaataagggagcagcaattaatcctagagagacagagatatgtgatcttttcatccagagacttcaaaataggctgtctggggactcgcatgaaattcagataacccagagaggatttcagaatggcatcagatacgttacaaggatcacatatttaaagatttgcgaattctgagtgaaatgcatgaattctgagatggtcaaggtctatagggaaaaaacgggagaaaatagggtgaggagaatggaatcggcgc

SEQ ID NO: 700797 - DNA, 124 bp, Homo sapiens
atgagagtgcctgatgtagtcaggactttcactcactttaaacgaacacagacataggagtattgtgttaaaaccatatagtgtggacataaaaaatgatgcttatgtttactacacagtgaga

SEQ ID NO: 700798 - DNA, 326 bp, Homo sapiens
agattggggaacgacacccctcagccctcgccatcataggtcaaatgcgcaaggtactggccctggtatgccagtatctgccagacagaatggcagtagtgccatcgtggagcctgagatcctccctgatggggaccatgacttgaagcgctgacagtatgtgacgcgagaaggtgctggaagctgtctacaagggctctgagtgaccaccacatctacctggaaggcaccttgctgaagcccaacatggtcaccccaggccatgcttgcactcagaagttttctcatgaggagattgccatggcgaccgtcacagcgctgcgccg

SEQ ID NO: 700799 - DNA, 333 bp, Homo sapiens
attgtagtgtgtcggtgagggtatttccagaagagatggatatatgactgaaggggctaagagggaaccatccgccctcaaggtgcagtgggtgggaacaaaaacggaagaaaggcaaatgggtcttactctctgggagctggaatacacgcttccattccggccctgggatttcaggatcccaggcggtggggtctcaggacgccaggacctacaccagcctttccgtcaccgcgggggttctaaggccttggggctaagaattatatcatcagctttccggattctgagacttggggactgggacggagccaggccaccagtatcccgggg

SEQ ID NO: 700800 - DNA, 818 bp, Homo sapiens
gcacggcccggcgtggtaaccatgcccatcagcacacggactcccacggagcatctcagaagataagggccagctctcctccatcttctggcgaaggacagaggcgaggggacagcccagcgccatcctgaggatcggagtgggggtggacgtggcgggcttccaggtggacccttctcgggcacatcattccagttacgtagagcccgaggtcctgtcccctgaggctcagcgtcgttaagcgcctactcaaagagacagccgcgtcagacgctgcaaggggggtaccagtggagccctcgatggatcccttcgatgcgtctcctggcatattcggacgtgtgcatgcgtgcggccagtgccgctagttcgtatgacaacgcacacacgtggaagaatacccgtgatgcacagggtacaacgcactggggaagtgccgagtagcgactgactgtagacccctatcgtacgggccatttggcaacgaaaagtcccttggagcggacgggttagcgtaccaaacttgtatccgcggacgttacctctggcgtagccaaaagaacaactgggggacgcacttgtaggacgaggactggcttccccacggtcggtgcattcgtacgccacctgtggaggtcaacttgaacagctcttttgcccacctacgggtcccggatcgcgtaagagaagcacccacctcgtggacccaagaggaacagtcacccgagcacgcggaagcgttccctgacggaaaccccttttgtagtgtacggtccttacctatctgtgcacacacgcttgaggcaaatttcgacccg

SEQ ID NO: 700801 - DNA, 106 bp, Homo sapiens
tgattttacccgggccctatattttgggtcccattggcatggacattatgaccgaactgggccccaaccaatttaacgctttaaaattgggcctggctactattgg

SEQ ID NO: 700802 - DNA, 189 bp, Homo sapiens
tcgctaaagtacattttttagtaaagaccctttggacatcagctgtgtcaaatgtactaagaagtgggggaaaggagatatgtgaagaattttcagaactgacgttcaaagtgatacaggggaaatcaaaatgaaatgcacaaaaagaaaggagaagggccgggcgcagtggctcatgcctgtaatccc

SEQ ID NO: 700803 - DNA, 170 bp, Homo sapiens
taagcaacacatgctgcgtatgacggatggtatgtaagcatctttgttatcagcacggacataacgccgtaaggtctggagaatgcgatgaggccgtggcgtgtcagactgcaaggcagccaggtagttctccagcagccatccgacgagcggtcattcacgcatacatg

SEQ ID NO: 700804 - DNA, 325 bp, Homo sapiens
cgggtctgaactgctccaacaacgaagataaagattcaggagagtaagaggtgagagagcggtgaagcagcgaccaaatggcccggtggatgagccgcggaagcaggcccctccgtgaggcacagccgcccgggggttccctaggggaagcaggggctgcggcagacgcctctcgggcaggtcagggtatgcaccctcccgcaggggctcccaaggccgggcgtgcgtgaggccaggtccacgggcacaccactgtgaacactgattaaacgtggcctccacggcttccaacccccaggacaggaccaaccctctgcccccggct

SEQ ID NO: 700805 - DNA, 641 bp, Homo sapiens
agagctaattgggtttccaaattaattccgcttttaaaggcccaggggccggtttatccaatccctcaaggaaaacttattctgtgctccacaacctctaaactcccccgataaaacttctgtaggcttccgaaaggcaatgttatttcaacggccaggcataaatgacctcagaccgttgtggtcagtgtttcccctaaactggtttagtctgtccagactttactcctgcaagagcattgtccatcacctcctcagctatgcagcatcgcccatcgaacagtctttcatcataatctctcctcttgctagacgagcacaaatccctcattccgtaaactatctataatatgttctacatttttggtgtgaatatgatgtcgttcaagaagtccgctgtaactagagcctttcaatgcaagcagctgcttcaggtcctcctcgaagagctccgcgtatcggttccgctcttgctcgaactcgtccggggtggttttggccaccacctccacccggaaggggcgaaagccgccgtccgcgggcttgccacagccggccagctcgtgcgcctgcctttgccccaggtgccgccgcccgccccggcactgccaacctgggcccccgcctcgtcctgaattctt

SEQ ID NO: 700806 - DNA, 584 bp, Homo sapiens
  misc_feature (1)..(1): n is a, c, g, or t
  misc_feature (584)..(584): n is a, c, g, or t
ntgctgctttagttgttatattacatgggcgttggccgaccactacacaagatcggcgcggagacgtgcacgacacatgcggagatggatcgacacacggtttgaagctcggcgcgagctctgttggcttacagcttctcagtgtcaccagccagcagaaaataagactttccgatttgtaggcacccactctcagagacagatcaaagaagtgataacctttcgggagaagaaccagaggcagcaagtatgtttaatcacctgtcagctgtcagcgacagtatccaggccctgggctagggtaggctataggctcccaagcctggccctatatgtgaacagacaatgacatgatgccgccatgttttatacacaaccgagtcctcaaagagtacaacagatagtaggataagaagcatgtagactgggtcaaagctatatattaacgtatatggacagagctagcaggcttaccttaaggagttccataccaccggcactggcctggcagcacaacggggcctgtggcaacaagaactgagcggactgacatactaggacctctgccggcatcaagtccgccn

SEQ ID NO: 700807 - DNA, 377 bp, Homo sapiens
gcaacttcaccagttgcagtaaacacttgggccacacagtattaccagataacatcagtttatcaaactctaatttcccatgatttgcctggcgtggtggctcatgccgtgtaatcccagcactttgggaggcagagcggagcggatgacctgaggtcgggtgttggagaccagcctgaccaacatggagaaaccccgtctgtactaaaaatacgaaattagcacggtgtgctggcgcatgcctgtaatcccagctacttgggaggctgaggcgggagaattgcttgaacccgggaggcagaggttgcagtgagccaagatcgtgccactgcagtccgcagatctggcctgggcgacagagcgagactccgtctcac

SEQ ID NO: 700808 - DNA, 334 bp, Homo sapiens
  misc_feature (58)..(58): n is a, c, g, or t
  misc_feature (81)..(81): n is a, c, g, or t
  misc_feature (84)..(84): n is a, c, g, or t
  misc_feature (88)..(88): n is a, c, g, or t
aggtagagtttccctgggttatgataccccccagtttctccccccgcattttcgagcnactgccattcctcacccttccanaanacanaaagaaaagaaaataagcaaaaaacaacagagataaaagaagctccctggtttttctctgagaatttcactggggatctaattttaaagaaggggacatgaagattgaagaatgaacacataatttcaaccattttgttaaatgaaatttgttggctctataaaaacgcttctgttttggttatgtcctctagttttccccggttttccttacaaagaataataactctgctctgtcctcttcaag

SEQ ID NO: 700809 - DNA, 109 bp, Homo sapiens
taactcggcagtgcgccttatggttttatactctcttcacagactcaaatgactccaaaaagctatctgcctgtagtgaatctatgatatgccactgtccccgctgcat

SEQ ID NO: 700810 - DNA, 194 bp, Homo sapiens
  misc_feature (14)..(14): n is a, c, g, or t
  misc_feature (188)..(188): n is a, c, g, or t
gtagctggaccacnccacggagaaggacgcggtattgatccaatcggcatacgatttcttccgttgccgccatgctacggcatcggccgtcgtaccgggaaccggggcggaagaaagcggcctgctcatgcgccgatggaatggggcgggagcaggccgtaaatgggggtaggggccttctccggtgncgtggt

SEQ ID NO: 700811 - DNA, 114 bp, Homo sapiens
aaatctgggctaagtgctggcaagagcgatgtctactactcagtccaagtggtaagaaggtcagaagcaagcctcagttggcaaggtacctgggaaatactgcttgatctccag

SEQ ID NO: 700812 - DNA, 477 bp, Homo sapiens
  misc_feature (82)..(82): n is a, c, g, or t
  misc_feature (87)..(87): n is a, c, g, or t
  misc_feature (421)..(421): n is a, c, g, or t
  misc_feature (440)..(440): n is a, c, g, or t
  misc_feature (442)..(443): n is a, c, g, or t
  misc_feature (445)..(445): n is a, c, g, or t
tttggaacaacaagcaccatgtttccaagaagagcacgggggttggggggtaaaggttaataagattaaacaagcatccccnaaggnagaaagaattttccttaagtaacaagaaaaatggagtctccctatgtcctacttctttcctacacaagacacaagtaacaatctgatctctctttcttttcccccacatttcccccttttcttttcgacaaaaccgccatcgtcatcatggcccgttctcgatggtcgctgtctcttcacagctgttggatacacctgcagaaaggctgtcacttcacacttggaagattgcacagcggccaggcagaggcactcctcacttcccagacgggcggtggccaggcagagacgctcctcacttcccagacggggcagccgggcagaggcgctcctnacttcctagatagggtggncnntnggcagaggcgctcctcacctcccagacgatgg

SEQ ID NO: 700813 - DNA, 163 bp, Homo sapiens
gggctcggtaccaaagcctttacgaggggcgctgggcgtcgctgatgctgggcgaacaggtggacgccgatctgatcgcacaggatgtgcgcctgtaccaccggcggcgagccgaccttcgtcgcggtcgacgacccgcaggcgggcgaatggaatggcgatg

SEQ ID NO: 700814 - DNA, 204 bp, Homo sapiens
cccagatatgaacattataaaccttaaaggcgtttgagtaaacaggcttatctaaaaaacacgtttgttagttaccaaacaagagacgtctttaggtaaaataagtaaaaaccccatgctgcatagatatgcagatagttctatttatctggtcgacgggcaaaacgcaagcactttaggtcttcagctccaatcggtcaatca

SEQ ID NO: 700815 - DNA, 413 bp, Homo sapiens
gagacggagtctcactgtgtcgcccaggctggagcgcagtggcgcgatctcggctcactgcaagctccatctcccaatttgtgcatggcctcatacatcatagagtggttttgactttatcccgaaggtaatggagtgtcattaaaatagaaaattccctattttccctttcctttgcctcatttttttgctcacgttttgtagacacacacacaagtgactttaaatcctttcttgaacaaagtggttcacaccattctcctgcctcagcctccccagtagctgggactacaggcgcccgccaccacaccaggctaattttttgtatttttagtggagacggggtttcaccgtgttagccaggatggtctcaatctcctgaccttgtgatccgccccttctgtcgtcttctc

SEQ ID NO: 700816 - DNA, 125 bp, Homo sapiens
caggatccggcgggcatttatgccgcttaccatcttaacaagctttgagtgcaagagactgaagacgttcaatctgaccaagatgttgatgttggataagagaattctctgtgtccccacctcta

SEQ ID NO: 700817 - DNA, 160 bp, Homo sapiens
tacggtgagcaagtggtagcagcagatgccgagttcgggatattattgtgtcaaaaacaacttcttcagctctgtgtaagttcatatgaacatcaagtgatcgacctgtagtagttctgacttgattatattcagatgacattttttctattatttttgt

SEQ ID NO: 700818 - DNA, 461 bp, Homo sapiens
  misc_feature (68)..(68): n is a, c, g, or t
  misc_feature (77)..(77): n is a, c, g, or t
  misc_feature (129)..(129): n is a, c, g, or t
cctgtgactctaaggatccttgtgaatacaccagcgtttgacatacctgacgtagtgctttcctacanatacagcgnctctaacaaaactatggctgtccctgaacccctgtgtattatgaattgtttnacctttataccaaggaaggttgggaaagggcaccaaaattctgcatgtggtgctgtgcccatggcagacttcgaggtggttcgtgctgtaaggacctaaagtttcttattgagatttgtcccaaaacaaatgaaacattgtcatgcagggcctaatggttggttccattgtgtgctaaattggtgttcgtgacagggatcaagcgtgctttccttatcgaggagcagaaaatcgttgtgaaaggtgttgaaggcacaagcccagagtcagaaagctaaataaaaaaattgaaacttttttgagtaattcaaaatgacaagacgctgtgtatt

SEQ ID NO: 700819 - DNA, 468 bp, Homo sapiens
aaggtatctctacaacgctgcatgaatcacagcattcctgggcttggggtgccccataaagcagaaactgcttagttcacaacacccaagttctttcaaatatctagaaagttttcccaagaagaacagctacaaataatatgaggcggtaaagactacgataaatacctaactcttcaatatccagacactgaagaacatctactagaattaacatcatccatgaaacatgacctcaccaaatctactaaataaggcaccaaggaccaatcctggagaaacagagatatgtgacctttcagacagagaattcaaaatagttgtgttgaggaaagttgaagacattcaagacaacacagagaagaaattcagaattctatccgataaattaaacgaagatattgaaataattaaaaagaatgaagcagcaattctgaaccagtgtatttgaaaataatatgtcagagg

SEQ ID NO: 700820 - DNA, 357 bp, Homo sapiens
  misc_feature (22)..(22): n is a, c, g, or t
  misc_feature (146)..(146): n is a, c, g, or t
  misc_feature (153)..(153): n is a, c, g, or t
  misc_feature (202)..(203): n is a, c, g, or t
  misc_feature (213)..(214): n is a, c, g, or t
  misc_feature (219)..(219): n is a, c, g, or t
  misc_feature (260)..(260): n is a, c, g, or t
  misc_feature (293)..(293): n is a, c, g, or t
cccccccccccccccccccccnaaaaaatagggtggccccaaacccaccaaagaaagggggcccccaaaaaaaggtttttttccaaaaaagagggcccctttccctttccccccccaaaaaagaagaagaagttgttggtaaaggncccagancccctttgtgggccccccccccttgttccttggttttcggagaaaaacnnctttgtagcnnctccncgtgggtctccccccaagcccctgtttaaaaataaatggtnataagaacccgtggtttttgttctatttttttnaaaataaaaagatcaagatttctggtgtgcccctggatctttggaggggaaggggaggccaaga

SEQ ID NO: 700821 - DNA, 1318 bp, Homo sapiens
  misc_feature (72)..(72): n is a, c, g, or t
  misc_feature (355)..(355): n is a, c, g, or t
  misc_feature (955)..(955): n is a, c, g, or t
ttttagcattggagtaggcttaggttatgtacgtagtctaggcctactccaatgctaaaactaatcgtcccnacaattatattactaccactgacatgatctttccacaaaacacataatttgaatcaacacaaccacccacagtcctatattattaggcattcatccgctctactattttttaaccaaatcaacaactaacctatttagctgttccccaaccttttcctccgactcctcgtaactaagccgccgcctcctaactgactaactactctgtagctctcgtaccgcctcactaattcgatggcaaggccatagcggcctagttattcgcagttgataccaacttatncatcgagaagagaaaactcatatcctcgtcgtaatagcttaattcttacccctactgaaagtcatccgtataattctactagatcatctcatctaggcctatcatggagaactaagtccattaattttctatgtactcatgtcgtctcgtgaatagccgagccacgttatgtctccgcagcacctatggagcttagtcgagtcagaccccgtagtgattgtgacaaatctcatgtccaaggataacagacgcgtgtaaacagtccacggaccatcgaattacggttcacctaaatctcttagaagccaccttaggatatggggctcccctattcaccccatatcttcaggtgcgtactactacaggttttaaccaccttcatcaatgagcctctaagtgccttcaagctatagatcaagttacataccgtagccttcaacttcgttcaacttgtctcccaaggaaacctgtatcgaaaaaactcccttgcaggcccgaaaccaaagtctttacacttgttgcaaccttaggcgttttaccagcgaaaatgaagacgtttaattaattgaggttaacaacaggcatttaagcgtccatctngtaacagggaaacttcccaaaccgggttaattgtaagcttccgcttatataggcccccagttgattccgaaaaaagcgcccggccccaaatttcgcccttgggagggtttcgaacattaaaggttacacacttttgacacccggccaaaagataaacttcccttataaagaaagatttaagcgcccgagggattcattgagaggacatctcagatatatcagcgcaccgtctcatgacgagcgtatccaaatgtatctctcagagtgaccccaccgttgtcgtagaagatcaacaacgaattatcgtctcctaaaaccacgccattcatacgctcagtttctaatcatagtagcccgtcattg

SEQ ID NO: 700822 - DNA, 710 bp, Homo sapiens
gaaagggggggggtttaaaccttggattttccccaaaacccccccccaaaaaacccccccccaaaggggggttgatccaacgggggggttgggggcccccaacccaacccgggccccaaggcccagggccccccccaaaagccaaggccaagtccccccccccctaaaaggcccggttccccaaaaggggccaagttttttggcgggccccaaaattccccttttaaggggtttgccccaaaaattgaacaggggggaccttgggaaaggcgggatcctaaaaaccaggtggggggggccagggccacccccgggaaaaaggtccccccggggggagagaaaagagccccccttttttttaaaaaaggttgggggggttttgggaatccccccaccggctttttttaaaagggagtgttccccccccacccccaaaaaagcaaaaccgggggccatggcatataaggggccccaaaatttttaaaggggttttttttccagagaaccccccggacaaatattgggggaaaaaaaggttttttaagggggaaaagtggccaaaaatcctcaaaaaaagggaaatttttacccccaaaaaaaagcgcccccccccctatttgtgggggttacccccccaaaatggtgggtaaaaggggttctgaaacccaaaaaatttcacaaaaaaaaaataaaacttttcgctttttgaa

SEQ ID NO: 700823 - DNA, 336 bp, Homo sapiens
cgtaatgcctgtcgatgggttctgagtatgcgcacgaggggtggaaattgcttagtcctaccatcaagagtcctctgtcactgatgtagactgacatgtggtatcgtcacacggaggtgggaggaaatcgattccattctgcctatttgcaaacttctgcccgattggcactgctcctctcacatcaatgcacttctcctgatgctcatgaccagccttcggccatactctctgatagtccacgggcttcacgtccatcacagctggccttcattcgagactcgtcgtagtaggtctccactttgaccctgactctgaatatgaaagatcggaagt

SEQ ID NO: 700824 - DNA, 151 bp, Homo sapiens
agcacaagaatttcataagaggtaagatgactggcaaagatgtgttgttatgatgtaaatttagaagagctttgatactatgggaaacacaggtggttaagggagataccatgataatttctttggtggctttgactcagtacggcagtgg

SEQ ID NO: 700825 - DNA, 796 bp, Homo sapiens
taaagaggaaatatgtagaactggaacatgtggtcggaaggccaagctaccaattacggggaagatctcagcaaaaaatcatgatgagctttgatgagacgactcaccagaatatggtagacggtgttatagagcagttctgttgatgtgtctgggattgtatgcatacatatgtgtcgtaagtttacgagcagttggtgatgcgtcgagcataaagagacaagtatgatgaccatctagattggggtataaatagattgtttattcgaatcagtatttactggaaaatggactagtcacttagtctttcatgtaagatttcttctcaagagacgtgaaaatcttgggaaattgttaatttcgtgtctggggattatagttgggtacaacaatgactgtaaagacttgtatagttattcatattaaaccttatggggaactaaatacttgaaaaatgcccggctcctttcagcaaggtgaggtgggttgagggaggcagttaatactgaaggtgactgtgagctagtttaactaccagaattttgtgatattggccagtgttaaatagtgggaaaggggaaatctgattaagcgaaaggggtatgcatcctaggtaagctattgagaacaagtctactattgcagatgctttcgttcgagggtgtactcgtgagtgatacttactgtaggggtggttgaaactccatgctgtcaaaatgggttgcaatttgcaaggcatcagttcgtgtttgcgttaaaagccaaagaggtatgggaaaaggtttggcggcaagga

SEQ ID NO: 700826 - DNA, 177 bp, Homo sapiens
acgaccactcatcaatgatcagcatgatagcattctggatagctagtatctgtgatagtttgatgactaatttaaagaaaaacacctaaaatatgaaaaatgattgtaggatcaaaaaaggcggatgaaattacttaatactcagtgtttcggagagtattccttttagtttgttgg

SEQ ID NO: 700827 - DNA, 1058 bp, Homo sapiens
  misc_feature (304)..(304): n is a, c, g, or t
  misc_feature (538)..(538): n is a, c, g, or t
acctggagtccatcaccaggctgggaaacatagatcacatcttatgtgtacggtagtaattgggaagaatttagtctggtgccctgattggctgtccccgtatatgtcttcccaaggcttacagcagagatggctggagtgtaggaggacatttacttgagagagtcctcggacgtttctcgaggtcttggcatgtgtaagcgcagtggagttgtccacgaggcgactcctcgatcttggggcaacaagagcatgtgagcccgtggtactcacaagatagaagaaggccatataggagaaaagnaaaccaaacgaacatcaaacgaaaattttgccctctattctagtacacaccatagaaggcttatatgtccgtagggaaactcgctacatcacgacaccccaagaaatctatagtcatcaaaccatgactctgtttaacagttcgacctctcaagcctatatcgcatcgtattccccagcaccataagaccaatcttgagtatcacaaggcaaactgaaaatggacacggacctnagttgtgagaacgtcaattccttgtagagcataaaacttgagtaaaagagggcgttcttgcgaaaatgccttttgagatatgccttgacacgaagaattttggtctgaccccttatatgaggtatccttaaggctgtctccccactgggatttcactaacggtgtattcagacttggagagtagactctctttcgaaatttcccttatagaggagatcttttagattttcggttttccaagttttaacaggttgtctttaacgcaaggataattgcctaataatgactagttagaagaaaggagtccaccatggttaggttttctgacctcactgagagagttgtagttccctccggagggttttattcttgtgggagacataccatttgggtgcacttttgatattccctttgtacccgcggtgagggtactttctttgtggaaaattttttcaccttcacaagagcgttttaaactctattgctctcttggaacattgaccgttgttgtaggcttctc

SEQ ID NO: 700828 - DNA, 812 bp, Homo sapiens
  misc_feature (226)..(226): n is a, c, g, or t
ccaaattaattctttaaaaaagaatgataatcacagggtttactcagtgaaagtcatattaattattttcccaaaatctaaaagctgagccggagagccccatggcccacgagggaccagccaattaattaggatcacactttttctccaggggttccccatgcaaggcaacattaccttgtctttcaaaaagacactggccttatgcaagggggaaacctgtganagctgcactcagagggaggagtttttcttacatattttgcaatttcaggaatttaatttataggcagatctttaaatacagtcaacgtacggtgcacagtaatatgaaagccaccctttgaaggtaataaatacacagcatgcagactgggagttgctagcaaacgaatggcttacctacccaaaccagcttttagttcagacttagtttttataaaatgggaattctgacttgcttaagcaggggtgggatggagatggtggcggtcagctttttgtatcagcaaagtagctggttctgtgtgtgtctccaggtaactttgcttgattagacaggagagccatattctaagtgcactgttgaagcctggtgccagtccaaattgtctgtctgctggtgtgttgggaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattccaataaatcctttactttaaaaaaa

SEQ ID NO: 700829 - DNA, 128 bp, Homo sapiens
tcattccagccaataaagaattaagatgcgggttgaacacagcgcacctcataatactaaagaaaacatatcacgattcgctgctgtgcagcgatcttgcagacctacagaacaccgctcctgagaca

SEQ ID NO: 700830 - DNA, 520 bp, Homo sapiens
ggtgacgcgtgggtcgtaagggaagaggagaggaacggggagccggaccgacatacccagtacagagccgtgtgaatgggtttgtggtgaccccggtgttaccaggtcaggcaggattgtaaaaggatcgggaagttggcgtagcataattgattagcgagatcacgtaataggagaagcaatattgataccaaaggaagaggatggaggtacggacggataaacggatatggtgtgtcaaatagaagtgagactaggatcatagagagcggtgcggagagaatggatattataggagttagtattgtatatagtgagaaaaagataagttcaagtggagtggccattgcaaattaaagagtaaaggagacgataggaagagatatacagggaatgaaagatgatgaaaattaggaagaaatgaggtagaaggaagtagtaaaaacgcacacatagtgattaaatagaagtcggagagaaagaaaggggagagaaggtagataaaaatagagatattaat

SEQ ID NO: 700831 - DNA, 446 bp, Homo sapiens
  misc_feature (295)..(295): n is a, c, g, or t
  misc_feature (309)..(309): n is a, c, g, or t
ctcaaactttagtcgggcttctgagccttcccctaggtccatcttagagagacatcgtaaaatccagttttagcaaagagccctgctgggtcagtttagcaagaacttctgagacttaacttgctcgctctcctcctccactgaccactgagtaaaatgcagcaaaataatcaggaggtgatgagccttcagcgttcattgcatttactttaaatacaatccgttcaattgtaatcttatgtgcattaaataaattgtatccaaaataaatgcaacaaacaccaaaaactcttcncctcctaatcattntgccacattccacgctggggtcagtggaggaggagagccaggaaagaaacaaataataatgtaaggaaataattttagaacatttacaccacaaaaatcttcaaatgccacatatcagggctatcccccgacaaaga

SEQ ID NO: 700832 - DNA, 180 bp, Homo sapiens
  misc_feature (35)..(35): n is a, c, g, or t
cagttttcagcaaggtttccaatcagccagcactnttttgcatgacagccactcaaacaccaacacatagcatccacatttttttcaaaacacatgcagctcaacactccaccctcattcaacagtcaccacacctccccagcacatcaacatcacaccaacacacacacacatcccaac

SEQ ID NO: 700833 - DNA, 717 bp, Homo sapiens
ggctggtacggcccggaagttagggatgtaatgttgggtgggagtgcgggacgcctcaaaatgtcttccaggtggcaccctcagcaactactactgtggactcgacttatagtgccatgagggcgacagaggtgttcgcggcgcgacttcggagccgctcggtggcacaggcagacgacagtggccggcctgcaggtgtggctgatggaccggccgacaccgcgccgagttcgcctcgtgtagtatgctccccaagatcggcccgttgttcgtcctgcattctgtaggtaccagccggggcctcctcgagcgtcgcgcgagtgtccgtggggtgcataagtcgtggtttcgttaccgacctcgtcacaatgttccgcacagaacggccccatgggtcagacgaacattgtgtccagtaaccctgggctgttaactagtgccgctccgtggattgtgaactcgttcgtccggattcacccggagcagtaagtacaagagtgttgcgccgtgccagagataggatagaaaagagcagaacaagacacagaggacaagaaaggacaacaaaagacaatagggcgcgcgacgcggggcaccaagaacaaactccgcgcagcacaacggaaccgcggattaaacgccgttgaaaaaccccagaagcgggttccacaaggacaccgcggcccaccaggtacggactcacaaccatctatcctg

SEQ ID NO: 700834 - DNA, 206 bp, Homo sapiens
ctattcgtggtgttaatgacccgacggaagggctagttctcgggaaatattgggctcagcaaggtatctcagaaactatacatacgaatgacactgcaaccttcattagctgttttacctttaatcacgacagtctaaaccagtttcgcctctacggaaaagaggatgggcaggaggcaacaggtgttagcttagtcttcaagaaa

SEQ ID NO: 700835 - DNA, 525 bp, Homo sapiens
aaacaccacccccccccccccctccctttttttttaagggggtggggaattttttttaccaccccccccaacaaaaaacacaaaaaggttttttttttttttaaaaaaaaatttttttttctcttcggggggaaaacaccaaaaaatttttttttttttttttttttctcccccccccccccctttttttttttaaaaaaaaaacaccattttttttttctctcccccccaaaaaaaaaaaaaaaaacgcgcccccccccccccctggggggggggtgtgggaaaaaaaaaacccgccgcgggggagtacccccccccccttgggggggggggtgagaaaaaaattatacccggcggcccccgccaaaaaaacacattctcttttcccccccggggggaaaaaaaaaaggaggggttttttacccaccccccccccccatttttttggggaaaaaaaaagggctttccttaagggctctttaaaaaaaccaaaggtttggattgaagaaaaagtttaccggcttt

SEQ ID NO: 700836 - DNA, 909 bp, Homo sapiens
ggctctttccctgccgccgcgagtcgggcgaggggaggttgggtgcgtcaagattcaattcacccgtaacccaccgccatgcgaggaaggcatgctgctggaggtgtaatggaccgtaatacttgctttacaagagcgttcttgaagactgccctcatccaggattggcctagcacggtgaaattcgcgaagtgtggcaaagccttagaaaaagcgcaaaggcccacaatctttgggtggttggctgggctttccaaaggtgtgaatggaggcctttatgtatggtcaaggtgggggtggggagggcccctttttggtggctggaaacaccaaaatacaaacttaatttaaggtgttgggggttgacaaccaagaaaactaaggagaaagtgggataagggcctttgttgtaacatttgggacaggacgaaggggaaaacccccggtaaagagggtgtttgtggttgccagtgtgtgtaggtacgtttaagcggacttactgggcaaagggacgttctcaagggccaaggggattgttcctttgaacggaggttattttcaatgttgccacgaatagtgacgacactaaatcttgtgggttcacatttggaaaaaacaacaaacaccacaaaacacaacaaacaccttgttcgcgcggcgcgggccaccagagaaaaagttttcacaacacactctgtgtgggggacgccgcggcccccagatgatatcggtcagcccagtgccaaccggtggtcgcaaaggacaactggtggccacgaacagctgtgcggcttctcacaaaaaaaacaccgcggcgacaccgggcggttgtgaccaacccaggtgggtcggcggctaccggggctttcacaggcgcccagggcgtgatacccgaccgacggggggtgt

SEQ ID NO: 700837 - DNA, 127 bp, Homo sapiens
  misc_feature (73)..(73): n is a, c, g, or t
cattcaccattatttgttaattttattttgattttttaaaggcattattcagtgtacaattaacaaagaaatnagttttctactctactgtacttaggatgctttaaaaacatcaggtgaaatgatc

SEQ ID NO: 700838 - DNA, 236 bp, Homo sapiens
  misc_feature (67)..(67): n is a, c, g, or t
  misc_feature (71)..(71): n is a, c, g, or t
aaaacgaaaacaaaattttcggccgcatcagtttttatttttagtgtttagctgctgagatcacggngtanttgatggaccacgagtgaaacttcaggagtaccacatactgtcttcctgctatcataggctgctgcagatttttcatggactttttgcttggccccatccgggacgtgtggagagaactgactatatacttgcttttatttgacagtcaccaaggcactgtttct

SEQ ID NO: 700839 - DNA, 306 bp, Homo sapiens
cttaaaatgaatctccatccatccagccagccagcctcaaagcatattggttctgtttctctggagaataatgactcatacatctaggatctagttttgtttagaattcaaatgatcatactatgcactaaaaattaggggcagaaatatcagagataaattaaatccagaagtgtatcttccagagcctccagcatgacagatactgacttacaaattatatatatttccaaaagtcactttttggcctgctgcctggaacttaaaaggctatccctaataatactggagcttcaggcggggcgt

SEQ ID NO: 700840 - DNA, 97 bp, Homo sapiens
ggaaaactccatctcaaaacacacacacacacacacacacacccctagagggaaactccatctcacacacacacacacacacacacacacaaccccc

SEQ ID NO: 700841 - DNA, 452 bp, Homo sapiens
ttcctatccatttgacacgcgttcgcgcgcatgatgattgcagtcaggtcgcaaaggaactgacatcatgtacacaggcacgcttgactgctggcggaagattgctcgtgattaaggaagccctgctgttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaattt

SEQ ID NO: 700842 - DNA, 187 bp, Homo sapiens
tgtaaggtacctagagtcccatctgtctcaggatgtctcaatcttgactcgtgatctgcgctctgctccaaagtgtggatacaggcgtagcactgtgctgccggattcttttagagatcatcatactgactgtgcccattcctcctcactgtctgactgcatcccttttcgggagacagaagtgggg

SEQ ID NO: 700843 - DNA, 546 bp, Homo sapiens
atttgtgattgtgttttatgtgtctgtcactgctgggcattttgctggtgctctgtaagtagtactgactgtggagggatgatcattggcaccttcgttatcaccaggtgatagattgcttccagctcacctcatatctgctcattttctgtgcagagtatcacaaacctaacttggagcacactgcaagtgtaaaggcataaatgctttgcttttttgttcgttgtttcttactctgatgcttttttgttcagtgttctgtaaaggaccaaaaagtaggcatatacattagaaagtaggaaaataatcattaaaacttgcatgtatttcctttatctatcatttataaggattgctgtaccacatgaaaatgaatttatgttgtttgtaagtttataaaatagaagtatttcatccaattgcaacctttttgaaatagtttatcaaaagtattggatatagtcttaaacattgctaaattttagagacattggaaataaaaaatacatgtaggtatatagcccaataagacatcttacatagagg

SEQ ID NO: 700844 - DNA, 194 bp, Homo sapiens
cattgagccccttgatgccaaaatctgtcatcaaattgattattattttggcgacttcaatttgctcacggtgacaagtttctaaaggaactgataaaactggatgaaggctgtgtacctttggagatcatgattaaattcaacaggttgaaccgtctaacaatagagctttaagtgtaagttgtggaaagcag

SEQ ID NO: 700845 - DNA, 292 bp, Homo sapiens
  misc_feature (42)..(42): n is a, c, g, or t
  misc_feature (94)..(94): n is a, c, g, or t
  misc_feature (96)..(96): n is a, c, g, or t
  misc_feature (98)..(98): n is a, c, g, or t
  misc_feature (111)..(111): n is a, c, g, or t
  misc_feature (143)..(143): n is a, c, g, or t
  misc_feature (145)..(147): n is a, c, g, or t
  misc_feature (166)..(166): n is a, c, g, or t
  misc_feature (171)..(172): n is a, c, g, or t
  misc_feature (181)..(181): n is a, c, g, or t
  misc_feature (190)..(190): n is a, c, g, or t
  misc_feature (263)..(264): n is a, c, g, or t
agcatggatgcaccactttattgtctgagaaatgcaactggnataaagaatatttccttaccacaaataatttccagaactatgtacatatttntntnagaaatacttgtntaaacaaatctccctccactttttagtataanannnaccgttccatgtgattttnaaaannccggcacgngctcgtgcntggcattactgcacagttttaagatgatgcagattttttacaagttgtattgtggtgcagaactggatttttnntaacttaaaaaaaatccacagttttaaa

SEQ ID NO: 700846 - DNA, 842 bp, Homo sapiens
cacctatccttctttaattaattagagctctttttatagacatcacccagacaacacatatataactacacagacaggcagaagaaaatccagtaaccacaagatttttcatttgccaacctccgggttgagcccataaagagacaggattaggaaaacatgaagcttctaaggcctaataaacagttataactgggaggcaaaaacagattttgagagggatctattcacttttaatttctggggtttcatgaggaaaacagaggtctctcccctctcatgcaagaattaagggtggcaaggcaaaatggagaaaaataattcagttgactagaaaaagcccttttccagcaaaacaagacccaggaagagaaaaacataaaggccttttaaatatacctataatttggatatccacttttaattaagctgagtgctctttaagaaaattcttttaaattctttgttatccgactttagctgcgcgaagtggtcagtgtttctggctttcaaactttactaaaggctcagagaaaggaaaacccaaggcagttggtggggaggaagagaataaacaaatagcaaaagtcacatagatatcaaaccagaaaggactctgcctgagctaggattgagcctgggccaccatttgtaaaatggcggaggctaaacaaagcattgccacatggttaccaggtcacaccttccaaggacgttaaacaagatggaggcctgcagcaaagttgctactgaccatacagaaggacatgcaaggacaccagattgtttaaagttaaggccaaacctcaaaatcctttttctaataaacttcgagaaggaac

SEQ ID NO: 700847 - DNA, 441 bp, Homo sapiens
  misc_feature (1)..(2): n is a, c, g, or t
  misc_feature (272)..(272): n is a, c, g, or t
  misc_feature (367)..(367): n is a, c, g, or t
  misc_feature (398)..(398): n is a, c, g, or t
  misc_feature (417)..(417): n is a, c, g, or t
  misc_feature (430)..(430): n is a, c, g, or t
nnccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggnggggttctctcaggcttccatgatccacgttaaaggtgacgtaaacgaagaaacctttaacgaagcctacatgatgcacaccaccacttctccgnactacggtatcgtggggtccactgaaaccgntggggggatgatgaaaggnaatgcaggtaagngtctgatcaag

SEQ ID NO: 700848 - DNA, 109 bp, Homo sapiens
acttagaggatcctgatgtatccccaacacaacaggataggaggagatgactaatgcctccagtgctacttataaatggtagtttcccttctttctttcagggactttc

SEQ ID NO: 700849 - DNA, 127 bp, Homo sapiens
gtgagggtgtgagcagcggaacaggtatgccatagcacaggctcgttgctgttggaaggcgggttggcgacttccttcctctgtccggaggaggcacaggtgtcaccagttccagccaataggctcc

SEQ ID NO: 700850 - DNA, 104 bp, Homo sapiens
gaaggtatacattatttaaaataacaaaagttaacagaggcactaataatgtataccttcctttcttgttctagtaattaaagtctttgactataaaaaaaaaa

SEQ ID NO: 700851 - DNA, 308 bp, Homo sapiens
  misc_feature (264)..(264): n is a, c, g, or t
taactacctttcattcaatatcagctctcctctgccacaaggtagtccacattgcaatgcagtagtgatcttcaatattttccctgtgcctagtcttatttatgtacatagatgcatacttgtatacagatatatagggcctggatttttgtccatatattgttttacctaaattgaatcataccataaatactttctgaatcttgctttccactcacctatatctcacagaaaccctgagtcaactggtatagcttaaatccnttcttttttaacggttgggttatattctagatgtgagtttgcta

SEQ ID NO: 700852 - DNA, 896 bp, Homo sapiens
  misc_feature (724)..(724): n is a, c, g, or t
  misc_feature (750)..(750): n is a, c, g, or t
ggattccaaataactcttatttggagagaaaacgatctgcacttcgcattttcggcgttgacattatatacctttatagggtcctttagtataggtaagggagagtaggtaaactgattttttttaaacaggggagggtatgacaatctttggtcacgcagttgggagcaaaagattgaggtgcgattgcatgcctccttatgagagtctggctctgtcgtcccgaggctgtcagtgcagttggacgcaaatcttggactgcaaccctcagcgctcccaagtagtctagggattgacaaacagtaatgctcactcacgcccagccctcgatacctcttttagaagtcgacctgtctggcacgaaagtctgctgtttgtactaaaggctgggaatttggcctttagctaggaattgcatccattctttcagcctgcattcatactttaagaaccacagaagtgactctgtcttgggccatgaaaggcacactgtgttggtggactatatgaagagacgtccttgagtatgtttgcttttcatgaatctgggtcactgccaccttccgtctcccaggttcaggcgagactcctgactcagactcccgagtagctgcgactaccggcgtgtagcaccgcagcctggctaatttctggtattgcagtacaagatgaggttcgcatattgggcaggggtggtctgcaactcctgaactcgtgatccggnccagctcagactccctaaagtgctgngagttacaagctgtgagccaccctggccggggcactttggttgtggaactacagacttgggaatttcccctacaagatgcgcgaaccggtacttgtgaggttttttcactctaaaaaatttccactggcggtttgacacacaaaaa

SEQ ID NO: 700853 - DNA, 715 bp, Homo sapiens
  misc_feature (261)..(261): n is a, c, g, or t
acattatcgtggcagctttgcctgttgtgtcacactccctaggtacttcacgtgtcgtgaaaagccatggctccggtcgctgtgagtcgagacttggtctcccgatgctgtcagagatgctccaatgatagcgctggtccgctcctgtgctcggattgcccttctgtagaggggggacacaggctcccaagcatcttgaggtgtgaggtgctagatcgctcactatggggtatagcctaggatgcacaactagggaacaantctgatggtctcctcatgatggtctcctctgatggttgtcctcacgttcttctcaggggatactttctgtcgccaacagacgcgtgaaggcgagtcgtgcatcacttaactgccccagttggccttggctatgagtaggttccaaagactacaagacagtctggccctagtggattctgcggccagctccctttgtgcccatccatgtgtcctgttgtgcagtgaagggttcctacggggtgggttctttggcctgttcccagtaagtcgccacctgcattgaccttaggcccatagagagggcctgtcccggtgctgccccagccaggatctggtcgctggcccaggggactgatgggcagagtcgcccctgtggtggactgtgaccatctctgatggggcctgaccgcgggagctgagaagcgccgtccacgtctggcctccgagggcccag

SEQ ID NO: 700854 - DNA, 374 bp, Homo sapiens
tcgaattccgggcctgggatgcaggtgtgccgtggtgccacctaaggcaaagcgcttatactcagtgagctgtcaccaggcctaatatctgggttccaggctgggctttcctgctgtgcctgcactgagaaagcttccttttcctagacttgtcatgcaggatttgtgtcacttggtgttctccgtaggcaggtctggccctcactctccacaggagtctggattctgtcaccacaaagacccatctaggcttctgatctagaagtcctctctcgtagaacttcacctctctcctcacctcctccttgttgtcaattcattttcctcttcacccctgggctccttcacctccccagctccattctctatcccat

SEQ ID NO: 700855 - DNA, 115 bp, Homo sapiens
tactcaatacgaacaaggccacagcacaccacttagggctagcttaaggctcgtcttgctaagcttcgtcgagaactcattactaccaaagggtaggatggtggtaggaggtcca

SEQ ID NO: 700856 - DNA, 185 bp, Homo sapiens
  misc_feature (15)..(15): n is a, c, g, or t
  misc_feature (37)..(37): n is a, c, g, or t
  misc_feature (185)..(185): n is a, c, g, or t
aatgcagtgattagnatggggataaggcagatttagnaaatgaatcttgccgggcacaagtgcttatgccagtagtcccagcactttgggaggctgaagggggagggtcaattgagcccagggatttgaggttacagtgagctgtaatcacaccactatactccagcctgggttacacagtgagn

SEQ ID NO: 700857 - DNA, 282 bp, Homo sapiens
  misc_feature (204)..(204): n is a, c, g, or t
  misc_feature (273)..(273): n is a, c, g, or t
  misc_feature (279)..(279): n is a, c, g, or t
cttgaatcccagggccctggtggcataggcacccaagagaatctccttgtctgtaggttgtaaagaccatggaaaaagtgtagtatctgggccggagtgcaccgttcctcagggcacagtctctcacgacttcccttggctaggggagggatttctctgatcccttgtgcttcccggatgtggcaaagctcaccttgcttcagnttgccccccacagtctgcacccactgtctaaccagtccagtgaagatgaagctggggacctcagtttgnaaatgncga

SEQ ID NO: 700858 - DNA, 455 bp, Homo sapiens
agcgggggtgtctgcaccttagaaaaaaaaagaaaaatcaaaaaaaacaaaaaaacaaaacaaaaaaaagaaggaaaatcttgagagggtgggcgtgggaactcaggactccagagatggcgagtggtgtggcggagggagagcctactactacccacttagtacatgtgtgataggaactcaaacgtgtctggtgcagctataaactgtgccatgtgtcaagtagactagtaatacacgcatacgacacagtagcgtcaattcggataaccgcagtagggtataaaagacctgatgataacttgacagcaaggtactaaccacgaaccacaactattacagcttaaaccattagaaataacaaaaaaaagtacatggccattggtcctggagggaaccttactgtgccttaagccatttatatacggttaaggacctgcagatacctggataac

SEQ ID NO: 700859 - DNA, 348 bp, Homo sapiens
aatagctttagcgacttgctaggaagacacaacagtgagctccaggaatgtacaggccagcgggagcccagtatcagctcaacttccatgacatcaaactgctcttcctgcgctacgcccatggagcagtcgttcagcgcggacactggcgggggccggccgagagagcaacatccacctgatcccgaactttgtaatgatttcaactgagcatgaactttcctgagcagaatctggggagggggcacatgacacactgcagacacaagcacagaactgcagctgaaggtgcacacaggtggggaggcaaggcgtgagaaaccctgcttgcgtacaacctgccggtgg

SEQ ID NO: 700860 - DNA, 140 bp, Homo sapiens
ctataatctatcaattggctaataaaaatatctatcatctgaaggataactatgagacagtgcgtgaaatggtttaagataaaaagctcttggtatggggggtagcaaatggtaaagaatactattattttttaactggt

SEQ ID NO: 700861 - DNA, 462 bp, Homo sapiens
  misc_feature (111)..(111): n is a, c, g, or t
ggggagaaaggggccctctccccccctggggtccaccaaaaaatttttaaaattgggccgggggcccctttcaaggggggggaggtggtcaaaaacaaagccccccccggntttttccctttttcacaaaggccccaccccctgggggggtttggcccctatggggaaggggcccaaaactttttcctttttaaagggtgggggggggggacccaaaaagggggggtcccccccccccaggcccttttgggggcaaaaaaaagggggggtttggggaaaattttcccttaggtttttttcccccccccccaggttgggccggggcggtttccccccctgggggggaaaaaaggctttttggggccccctaaaaaaagccccatttccaagggaaaagggggtttattcccgggaccaatttttcgggggggggggggtccaaaaaaggtttttttcccctga

SEQ ID NO: 700862 - DNA, 378 bp, Homo sapiens
aggaataactggatacgaccgcggttctattattgtgggttcctcgggaagctgagcgccatgattaatgagggatcggcgcggggcgcattcgtattgcgccgtctataagtgacattcttggaccggcgcctgatggacctacagcgatcgcatttgccgatgcaatgttttcattaatcatgaacgaaagtcggaggctgtcgatgactcatcagtataccgtcgtcattccgaccatcatcctgatgccgaccggcgattcggcggcgttcttcccttgacccgccgggctagcttccgggaaaccaaagtctttgggttccgggaggagtccagctattcccgaagctcctcgaagttccggatgtcgagatt

SEQ ID NO: 700863 - DNA, 607 bp, Homo sapiens
acctatttatttagggaaccttaaaaacaagccaaatccgtacccaaacctggaacagggggacaaatggatacacacccctaacgccgtattggcccgcaccaacacaaggggagcgcctccctttaaaaaaaaaaaacccgcccccaaacccgggatcgggctaacaaaggaaaaaaatgcctcctgcggccaaaagttcccgcccccacacctctcaaagctcttcctattacaggggccaggccccatcccccggtcccacctgtttttttcttccagggacccccgccaaatcctacaacggggggaacattcgacaataaccccccgatttcttttcctctatcctgacacccttttctttgcccacaccagccccttggggtatccacttggaaaacaaatacaattgtggcactttgtaaaagccaatgcccgccaaaaagggtttccttaaaaaactaacaaattcgggtttttcaaaaccgcaaaacaaagcgccccaatacctggccccagcccctcaaaagggcggcttcgcgaccacaccaaagggggacttcccggaaaaaaaaaattgtctccaccccctgcggggggggcg

SEQ ID NO: 700864 - DNA, 715 bp, Homo sapiens
gctccggaggagcccaggtgccacttccttccggtcctctcccgatcccggggtctatctccgaccacccagcccgcctcccccccatgcccgcccgagagttctggaccccccaacgagatccaagtctgtataccctgaggtgcacccggaggtgaaatcgggtgcccacttcttgccctggcgcccccagatctcggcccccctgggtcttgtcttccccaaaaaaagttggtgatgaccaattgcccaaggccaccggggtgactgtgaaagggccctgaggaattaccacgtgagaactgacccattctcaggacacgacacggcccaccgatttgaaggtgggtgcctctctgcctgctggccctgagtcactccaagcccctcacagggaccccccaacgagacacgagaagagaaccaagtgaaaacacattaaaacacccagtgggagataatcaccttttgaatgaagaattgtcaaccacattgctcgacacgaatgcggcacgccgagtccttaaggcccgagagactctctggagacccttataagagatcctggggactgccccctccgtgggctgtaatgttgatggcccccctcctcatgacatcatcgatgacatccaccgtggtgctgtggatgccccgcccagttaagccccaagggaaacctttccattaaggatcaatttgaccactggtggga

SEQ ID NO: 700865 - DNA, 1252 bp, Homo sapiens
gatccattcgctatatgacatgatatttgttgttacactctttgtggggtagaggagcgtttcatgtgaagtttacaaggcatttgatctaacagagcagagaatacgttgcttgtgagaattcaccagtttaatagaaactggagcagatgagaagcaaggagaattaccatcaacgcatgcagtgtagcggaataccgtgcattactataatagtagctggatcatccccatgaatagtttggctgtatgattacttttcagctggattactgactcgtttatgtacagtattaagaaatagctgtgcacggtgatcactgagtctcgggactctctaccctgacacacagtcactacacagttatactgtcgagagtaatagatggctcgctggctcgcagtgtcatcactgcgacgtactctagtagcaagtggccattgtcagacaggttagctcttataagtggcaaagttacacacagccgtcccacattgctagtaccaacgtgagttgtacccctctaagagcccaagggttaaattacttcgttctcatatctcagacaattgcgataagcatgccgttgatgcgaagaggatcacatagtagatttatcacagaaggtctcttggcgtcttttgccgacaaagacttcacataaggatttgaccttgagtaccggcgtacacagactttgacatcgctagcgaagtcgtgccaatagggaagccttaaaggcaggttcaacaaacagagtggggcttcagggttagccttttattttgagcgtatttttgaaaaccaacacttagggaaggtgcttttgaatagaattagggcctttgtgcgctgcaaaaataccgcaaacagtcacaatgctgcgacataggttaattcttgcctaacaaaatttataaaccgagtttcgcacactgggttatgtcggggtgtcagcgcgcctggtgcggtgttggcatggcaaaatacgtttgttcgttgaagttccaacgcctgtggttccattcttttcccatgttgggaagaggcgggcatagttcccctcatttagtttggcgttggcctcgaacttcaacacccccgaagtgtctctttacaagtaacactgcgaaacccaattacttatttaaactatatggtaagcatatattcctctgaagttccccatattcacacaagggccataaaccttgggcacaaggtatgtgccacaagatttaccacaccaca

SEQ ID NO: 700866 - DNA, 167 bp, Homo sapiens
  misc_feature (14)..(14): n is a, c, g, or t
  misc_feature (113)..(113): n is a, c, g, or t
  misc_feature (164)..(164): n is a, c, g, or t
ccatctcccaggtncccccctctccatcccctccctcgtggcagcccgctggttttgtagatctgggttggtcacagtattttttcttgtaatttaagaggccacattctggnctattaatggacatgagatatgttaagttttaaatgataactcaacttcanccg

SEQ ID NO: 700867 - DNA, 1029 bp, Homo sapiens
tgactcgtggcaataccagacccgtgctatgagagcttcctctgtgtcttcggacatcctgttctacaagtccactactgtaccaacgcgtccccgtatgatattatctctgtccctgccatacgactcctgcgctgaggaatgaaaattgcgtactctctattgtgtgattgatactgcctgtgaacatctgactgtgttaataatgctttctatctctcacatcaataaagtgacatggaatccaacgtgtgagtaatctgtatcttcatgaatagtggcttggtctcgctatgtgtccaatgcgaccctccaaaggcacgggtactaccctctatatcatgtcgcctccccactagttctcgtgcacgctccttgggagagtgcagacgtatcggtggataagccaatcgcgagttttaatttcatctatactatcagacccatacctgttacagacgagaagatgtgagtgcttgcccttgtgttccacttcttgcttgaattctgttatttgcgcaaaggacgcatacaactgttactcctcatatctccttgaactgatgtgcttcttgatgctgatctggcccatgtgaagtccatctcgctgtccctgtcctcagagcgtggcgtgtctccccgttgttagactttggcgttacgttagtgtagtatccttcgtagtcctaagattgaactggtggcccgccgtcgggtgtctccttccgattttccctggatcgagtctgagacgcaagaatggggggggggcgtccctaaatatgctgaacagatggcccccatcatttcccctagccactttcaatggagtaagcttgccccttttgtcgcaagcagtctaagaggaaaggcgttggcggagcctttgaaagaacgtccattgccaagcccctgcttcgatccatgtgcaagcccactcttggtctgggcccagggactcaaaaaataacgcagccagtaaactgcggtccggcacacaaccgtttcttaatggccatcgggttcgaa

SEQ ID NO: 700868 - DNA, 217 bp, Homo sapiens
cctgcagaatctgacttgatctggggcagctgcgatctgcatagttgttctttttacattttttgtagagtcggggtctcgccatgtagcccaggctggtctcaaacttctgggctcaagcggtcctcctgcctcggccctcaaagtgctgggattataggcatgagccacagtgcccggccggcatttttttttttttttttttggaaaacagacc

SEQ ID NO: 700869 - DNA, 121 bp, Homo sapiens
ctcataaacaaaacaaacaaataaaaaatttcttccttgacttgtaaacgattctgtaggtattgctaacctgctttctagaggaatttattaaaaaatgaaagtaggctggctgtggtgg

SEQ ID NO: 700870 - DNA, 161 bp, Homo sapiens
tcagcaggcatccccatcaggcgcaagcatgtgtgcacagcacagcacatctccttccttccaccatctgcttggccagtcctgcctctcaaggcagggcacttcccctcctccttgcagttccttcatcccaccagggtccctgcagctctgcaattctg

SEQ ID NO: 700871 - DNA, 338 bp, Homo sapiens
  misc_feature (33)..(33): n is a, c, g, or t
  misc_feature (40)..(40): n is a, c, g, or t
  misc_feature (90)..(90): n is a, c, g, or t
actctcaggatctacaaacgcagagaggacacngtcatgnttgccgacgtgcttgacttcgactctgaagacattgacggtatagacaangatgtgggagaagaacaggaaccaccacccacggggcactggacagccacctcttcgtatgatatatacatggtggacacccgcaaagaaaacaatggcgatgaggcaacagaagacaaccccttagggaagaaaccaaagcatgggcatcattggcactgctctaagccctgccatagaaataccggcacaggacaagaaaacaacccagatggtgccaaagaggaatacaatcctctctgcgtttg

SEQ ID NO: 700872 - DNA, 268 bp, Homo sapiens
ttgtatgcagacagggtacgaccatcttccagctgtttttcggcaaagatcaacctctgctggtcaggagggatgccttgcttgtgtcggatctttgccttgacattctcaatggtgtcactcgggtccacttcgagggtgatggtcttaccagtcacgacctttactaaaatctgcatcccacctatgagacggagcaccaggtgcagggtccactttttctggacgtggtagacaaactgggagcgccgatccaaaacaacggcag

SEQ ID NO: 700873 - DNA, 378 bp, Homo sapiens
gtgattctcatgcctcaactgcttgagtatcaggattacacatgtgggcgcactacacccagctcatccttgcatatgtagacgacacgcggtatcatcatattggcctatctgacctcaaactcctgacctctaatgattcaccaccctcggtcttccaaacatgctggcattacctgtgtgaatcaccatgctatggctgtattgacgtaattacatactcgacatttactacaatacgtgattcctatcctctgatcttctgaccttcgtaacttctcatgcactgctatacaagtgtcacaatagagattcagaccctgccttctgttgttacttgacatgtatgtcattagcatgcacgatgcctattcttcg

SEQ ID NO: 700874 - DNA, 93 bp, Homo sapiens
ttatagcaggaaaaaaaaacttttgagggaaatagaagggctgcgttaccccaaataaacaatggcattgtcataggccttccttttactagt

SEQ ID NO: 700875 - DNA, 821 bp, Homo sapiens
gcaacgtcacctcaagcccctcatcatctccaggaaagtttctgccaaagctgtggcatagccagacttgttgatttggttcatttgccaatggttttatgtccctaaacctcatttggatccttggggtatagtttgtatcttctctgcttcaggtgatttactgtaacttttcaagagtattggattactttctgctaccatttaagctatagcttgatatatgtgagcgcaaaaaaaggtttcagcatggctggtgagggagaaagaggaggcttagaatatcccagttggtcacagcctgggcaagtcgcctagcgtccccatcaggtctaacggtcactgttcacacagtgggatcctcatgaatcatgaggacacctgcctccaacttctgcctggagggcatgggagctgttgtatgaacctatgtgtagctaaatgtatatgtatgatgttcgtattctgtagtggtgggtggtagcacagaagaaagaccgtgtgtccgtagagagtaggccaaggtgatctggccgtcttctatggggagaaattctaattttctttcccacttatctcagagcaagcccaatattccctccaagttcttcttggtgctgagggctgtaggaattgattgaaagcttctgcctcacttagtatcgtctggggcccagagacccaggaagtaactctaatactgtttcttaatggtatagcctcctgagcattcagatggtaaaatcgaagaacattaggacatcttggagtggagtcctcaaagtggtattgctttgctgtgctgtttcggaagaacggga

SEQ ID NO: 700876 - DNA, 154 bp, Homo sapiens
  misc_feature (142)..(142): n is a, c, g, or t
tccgccggtccggatgtatcccaacactattaaaaataaagaatatgaagaaataaaaaagaaagaataaataaataataaatgaatgagtgagtgacttcgttcctggaggtgagttgaagccttgggagaatttaggtgntgggcgataaca

SEQ ID NO: 700877 - DNA, 527 bp, Homo sapiens
gaaagagagatcagactgtaactgtgtctgtggtagaaaggagaagacataagagcacccatttggttctgtactaagcaaaattatcctgccttgagatgctgttaatctgtaaccctacccccaaccctgtgctcactgaagcatgtgctgtgtcaactcatgtttcactggattacggcctttgcaggatgtgctttgttaaccacatgctttaaggcagcatgctccttaagattcatcaccactccctaatctcaattacccagagacacaccacactacagaaggccgcagggccctctgcctaggaaagccaggtatttgtccaaggtttctccccatgtgatcgtctgaaatctggccccgcggccagggaaagcccctgaccgtcccccagtccgacacccgtacagggtctgtgctgaggcggctcagtaaaaaaaggaagacctctttgcagttaagaaaagaacaaggcatctgtctcctgctcttcccttggcaatgcaatgtctccgtgtaaa

SEQ ID NO: 700878 - DNA, 687 bp, Homo sapiens
  misc_feature (44)..(44): n is a, c, g, or t
  misc_feature (67)..(67): n is a, c, g, or t
  misc_feature (74)..(74): n is a, c, g, or t
  misc_feature (76)..(76): n is a, c, g, or t
  misc_feature (85)..(85): n is a, c, g, or t
  misc_feature (90)..(90): n is a, c, g, or t
  misc_feature (92)..(92): n is a, c, g, or t
  misc_feature (99)..(99): n is a, c, g, or t
  misc_feature (105)..(106): n is a, c, g, or t
  misc_feature (123)..(123): n is a, c, g, or t
  misc_feature (173)..(173): n is a, c, g, or t
  misc_feature (185)..(185): n is a, c, g, or t
  misc_feature (198)..(198): n is a, c, g, or t
  misc_feature (251)..(251): n is a, c, g, or t
  misc_feature (254)..(254): n is a, c, g, or t
  misc_feature (260)..(260): n is a, c, g, or t
  misc_feature (281)..(281): n is a, c, g, or t
  misc_feature (317)..(317): n is a, c, g, or t
  misc_feature (358)..(358): n is a, c, g, or t
  misc_feature (399)..(399): n is a, c, g, or t
  misc_feature (429)..(430): n is a, c, g, or t
  misc_feature (462)..(462): n is a, c, g, or t
  misc_feature (551)..(551): n is a, c, g, or t
  misc_feature (556)..(556): n is a, c, g, or t
  misc_feature (572)..(572): n is a, c, g, or t
  misc_feature (575)..(575): n is a, c, g, or t
  misc_feature (597)..(597): n is a, c, g, or t
  misc_feature (685)..(685): n is a, c, g, or t
cacttaccaagtgaataattttattaaggtcctgaaggtgagtntccggaagtgctgggtaaaacanatcacangnaagaaatgnaaaancnacctcancatttnnaaaaggaacaatctatngaagggaaacctagcgtaataaaaccctcactggatgtacatggaaaggngtatggtgagcnatttcctttttcnaggctgagcccttcataaattggcccctcggcttctggtgattcccgccgcangcncaaatnctccagtgtgttatgaaaatntttgtttatctgctctgtttcttcactggttttttntttttggtggtcttctcgattcttttggttaagctggtttnttacctgatttgttaccgcatcattttccttttcataaaantagatatatctgttcagaatttctataaanngctgcacttgtggagaggggtccatgcactgntttgctattttttgagctttttttaggcactccattaccctcttgcctccgtgaagctcctccccatttttgaccgtgtttctgccagncccgnagagatgtgcacaagngcncacagctcggccctgatcaggnttctttaaaagtatggatacaacaagggcacactgagtcctcagaggtacatgattctcatcactgaagcaaaaaatactttcaaaantg

SEQ ID NO: 700879 - DNA, 104 bp, Homo sapiens
cttactaccagacaaacttagccaaacgatttacccaaataaagtattagcgttagaaattgaaacctgcagcattagatatagtaccgcacggaaagatgaaa

SEQ ID NO: 700880 - DNA, 115 bp, Homo sapiens
ggcatgcttctcattgtgctgcttgtctgggcatgctcctccgtcacgcagcttggctccctccgagcgcgacctagctgccgctacgttgtccccatttgccatttgatctcct

SEQ ID NO: 700881 - DNA, 150 bp, Homo sapiens
acctagaggttcccacgtacagcttctatggctgagggtgagtcagctgctatagacctaacttgggctgatttgctgtagtgtaggaggagcctagtagtggggtgaggcttggattagcgtgaagcaagggctatcggttagagaggc

SEQ ID NO: 700882 - DNA, 682 bp, Homo sapiens
  misc_feature (32)..(32): n is a, c, g, or t
  misc_feature (62)..(62): n is a, c, g, or t
  misc_feature (66)..(66): n is a, c, g, or t
  misc_feature (80)..(80): n is a, c, g, or t
  misc_feature (96)..(96): n is a, c, g, or t
  misc_feature (102)..(102): n is a, c, g, or t
  misc_feature (108)..(108): n is a, c, g, or t
  misc_feature (110)..(110): n is a, c, g, or t
  misc_feature (168)..(168): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (189)..(189): n is a, c, g, or t
  misc_feature (193)..(193): n is a, c, g, or t
  misc_feature (213)..(213): n is a, c, g, or t
  misc_feature (215)..(215): n is a, c, g, or t
  misc_feature (218)..(219): n is a, c, g, or t
  misc_feature (238)..(238): n is a, c, g, or t
  misc_feature (251)..(251): n is a, c, g, or t
  misc_feature (254)..(255): n is a, c, g, or t
  misc_feature (274)..(274): n is a, c, g, or t
  misc_feature (277)..(277): n is a, c, g, or t
  misc_feature (280)..(281): n is a, c, g, or t
  misc_feature (293)..(293): n is a, c, g, or t
  misc_feature (299)..(299): n is a, c, g, or t
  misc_feature (305)..(305): n is a, c, g, or t
  misc_feature (307)..(308): n is a, c, g, or t
  misc_feature (310)..(310): n is a, c, g, or t
  misc_feature (332)..(332): n is a, c, g, or t
  misc_feature (334)..(334): n is a, c, g, or t
  misc_feature (350)..(350): n is a, c, g, or t
  misc_feature (367)..(367): n is a, c, g, or t
  misc_feature (373)..(373): n is a, c, g, or t
  misc_feature (401)..(401): n is a, c, g, or t
  misc_feature (407)..(407): n is a, c, g, or t
  misc_feature (410)..(410): n is a, c, g, or t
  misc_feature (414)..(414): n is a, c, g, or t
  misc_feature (416)..(417): n is a, c, g, or t
  misc_feature (419)..(419): n is a, c, g, or t
  misc_feature (425)..(425): n is a, c, g, or t
  misc_feature (482)..(482): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (544)..(544): n is a, c, g, or t
  misc_feature (547)..(547): n is a, c, g, or t
  misc_feature (553)..(553): n is a, c, g, or t
  misc_feature (595)..(595): n is a, c, g, or t
  misc_feature (604)..(604): n is a, c, g, or t
  misc_feature (607)..(607): n is a, c, g, or t
  misc_feature (621)..(621): n is a, c, g, or t
  misc_feature (642)..(642): n is a, c, g, or t
gtactagggttgttcttttgctctgtttccanattctggagctgcacgtgagcacttttgtntaanagatctaaaaaaanaaaaacatgaaaatgnaaattnaaaaananaaaaaaaaagaggtggagtcgaggacttcccgcccattgcacaccgttggcacatacntgcttgnanangantnaaaanaagnagacccaattccactgaaantnaanntgttgaagtgcagtctgtntgtgaaaaaattnttnnggggttgaaaaaagatgangtnaannttgggtgcaaanaaacancccaanannanaaaaccactcaggctgacaganangcacatggttgtcgtntgcactctgtagtcacntgatgngacataaaatacagggaggaaggccaancagatnatncacntnntntacatngtaaaacctatgaacttagcttcgttgaaattttctgggcacttccgcgttttgaangcgtanananagcataagatcaccaggatcacatcgtaggtaagagagatcaacatgctggnatntttganattgcattttaggatgactgtttcccgcttctctgcaagggnatacctccnggngcctggggctccangatgagccacacagacaccancacaatttgcaccaggatcagacccaggcagatgaaaacc

SEQ ID NO: 700883 - DNA, 171 bp, Homo sapiens
aattagtgaagtctgattttcctcctcctttaatattccttcatttcatttggagcactacttaagaacatcagacatgaccctatcctaagaaatttttttttttaattggccaggtgtggtggctcacacctgtaatctcaacactttgggaggccaaggtgggcggat

SEQ ID NO: 700884 - DNA, 932 bp, Homo sapiens
tgggttatcagttctaaggccctggcaagggtggtgtggaacaggtcccacataactgcccatgtcgagagctctaagcctaaattgggagggacaccaggacaagactcctgggttcatagcctaggggcctaaggtcgcagcatagagcttccttagatccctttggagatactaatacttgggagaggaagtgaaagtctgaagcattagtatctaggaggcagggatcagaggaagtagattcagaggtaaggagaattttggggctacactttcaagaaagttgtggtcaggacccaggaggtatgggtcagaaggaaaggtagaggcacacgcacgggtgactgttgagtagggacttctggctgcgccatgatctcaaccggctaatgccgagagtttgggatgacagctttctgcctctagtcggcccccggcttccccagggaaattgaaagtggaagctggttccaggtagaccagcgcttccaacccagaagcgttgggggttgttagaaagccattccccagacagcctcacacttgagtcttaagtctggtggccgcctatcgtttttaaccgtccgacaggtgcctggtattttcctccaattctaaggaaggtagaacagaatagcagcgaaagtgcttggaggtccttcatgatggcaagatgttacagggagtctggttcttagagctccagattgatgggggcgctccctgatgggggaacctcttgtgctctgccctggggtcttggggcccggtcctaggaaggggctctcgccggctggggtgttacttctccgcttgggggcccggcttatccgcgggaaggggcctccgcggggggggagcgcttggataagagacccgcccccaagtggtgagtcttgcagcgggggggtccgcaccacaccgggtta

SEQ ID NO: 700885 - DNA, 109 bp, Homo sapiens
gagtgcatccacgccgtctgactgcatacaacgccgcctgactgcatacaacgccgcctgaatagcatacaacgccagctgattagcatccaatgccgctaactagcat

SEQ ID NO: 700886 - DNA, 951 bp, Homo sapiens
accaggagactctcaagataccagtttgatgccttctatggcggagaggagtactcatcaggatcatctatgcaggttcagtgtcatgcccactctctagaggcacttgtctggaagggcagaaatgcgcacgatgtgcttgcctatggatcccacagggagctggtgcaagacgcacactaattgcctaggtgctaggcccgatgagctagaccttgtgtgagtgtagtccccgccgcgagctcgtccatgcgcacctccatgccaggcctcactaaggcgcagtgagtgggtgccggagggccaggcgcatgggactcctttgtcatgtctacgcgatgatctctacctcagcaggatcgtacccatgggaagaatacgtaatcttagtaccctcctttgggtacacccgtagcattacgcggggagggaacacctagggtagactccccagcatgtaaaagaaacgttgtcccaggtgtgtgtatagtaatacgcattgcactttgcacagtgggttgcatgccattcgcacaaaggaaaggacccgccattcctatggataaagacgtatgttgaccttgaatattgtggaaggactgaggcaaacactttccccctggctccacgacaccaagtttccggaaaattcagtgaacttgatagcgcaagtctccatcccctggtgtcttttcgacaccgcacaggcaggcttttcgccgatactccccagcgaatgtatccatgttgcattggttagacatcgcacattggtctcaaatcgtggtagggaaccccatagacggtgaggcatacagggtttattcgtggcgcccccaattgtcttcttgcccagtaccgaatcgaagagggtagaagcaatttgattaacacctttgacttttagaccatttggggcatgggggctacaacgaggggaccataccctgg

SEQ ID NO: 700887 - DNA, 578 bp, Homo sapiens
  misc_feature (526)..(526): n is a, c, g, or t
cacagggccttttcccctcaaaactaggcctctttctgtcaagtgtaattccttctaccagcagccagcaaactatggcctataagggggcagctcatattttgtaaatcaggttttactaaaacgtagccacgcccattcatttaagtattgtctatggctgcttttgttctccaatggcagaggtgagtagttacaaccacatggtctgcaaagcctaaaatatttactactggggtctaaacagaaacaataacttgcctaagcacagtgactcacacctgtaatcccagtgccttgggaggctgaaggtggtggactgcttgctgtttgagcccaggagttcgagaccaacctgggcaacatggcgagattccatctctacaaaaattagaaaaatagccagttgtggaggcatgcacctgtaatcccagctactcaggacgctgtggtgtgaggatcccttgagcccaggaggtcaaggctgcagtgagctgtaactgcacctctgcactgtccagcctgngcgacagagcaagaacctgtctcaaaaaataaaaaattaattaattaattaa

SEQ ID NO: 700888 - DNA, 847 bp, Homo sapiens
ctcttaacaggaacaatcttcgtggtcggtggacccgccgtggcagagcaacatgtgcggggttataacttgcaaagagttttcgtctccgtggtgtatcacgccggcgcccctcttgtttggtctgggtccacccctccgggcataatatcttccggcaatatttcttctttgcgggcgtcccccccaggcgatagatcccctgtctacaccctcttaggttgaaaaacaaaagcgtgccaagccccacaagtctgcgtctttaaaggtgtttccacccccaagatcctacgtcctctgcgcttatgagcgttctagaggtggttacacaaaataaacgcgccctccctctttggccacccaatagtgcgttccaccctacatagaggagtcgtttgaccaaataaagacagatgcttctaaaggggcgcaccccccggcgtcacgcgccctcaaaacttttatgtatgtaaaattcaattgccgtcccaagaggagaattattcatgaacacagcttttgtgtgtgtcgtcttctcccactgatgtatcttgtccgcggatagatgttcgccactgtgggagttaccaccagtttgtgagtcttgggagccgaaaatgtagtcgctgaccccctccaccgggggttatgttgttcccaacaagtacaacacgcatcctcaatgaagatgggtccccagatcatgtgccccccccccggcttatggtgaagactatcttcctattcaagctgggtctccacttcgtcgatcccctaactattcactaagggtcagggtaaacaagcccaagcacgcaaaaagttccccacaacaacccacataaca

SEQ ID NO: 700889 - DNA, 256 bp, Homo sapiens
acattcgttagctctaggtgaacgcccccgtatttgtttgaaacggtactaagagtgctactcgcctaggacaatgtagtcaaggtgacaggggctcacataaatagagagacgccgcttttttttactttgaacatgctggaagaatgacggcgtatacacagtatacgtcgtcagcgatcgttatgcaaagtttatcttacatagctctgagaacacgctgcgttgtgtaaagtgtatgagctgtgctgtactt

SEQ ID NO: 700890 - DNA, 117 bp, Homo sapiens
ccggctatagcggctagtggagtcccgttgtggcgcagtggtacgaatccgactaagaaccatgaggttgcgggttcggtccctgcctttgttcagtgggttaaggatctggtattg

SEQ ID NO: 700891 - DNA, 413 bp, Homo sapiens
  misc_feature (306)..(306): n is a, c, g, or t
atactgttccgcgcgctttcgagtgtccagttcaccttctaacagcgcaagcctctcggctgctctcactggcggggacccccctctcaggcgaccactctgcctagtctcgttcattacaattcctcgtgctcgcaggagggcgtgcacttgaccctcatcgccgacctgattaatgctgccatcagcgtcatgcagctaaagcatatttgtgaccctttaactgcccctaccccgaaggttttcttggttccttagatcttactgaataagctgtaagcatcttgccacagggttcttgactcnccttggcatgtttccatcctctttccatgctgcctcccaggacatgttcacatatacctgtgccctcctgtgacctcttctgatccctaaacctgccctgctgctcc

SEQ ID NO: 700892 - DNA, 924 bp, Homo sapiens
gagccggctcgggtccccttccacaccattggaagcttgtgttctttcgctcttgtgcaataaatcttgctagtgttcactctgggtccacactgcctttatgagctgtaacacttaccgcgaaggtctgcagcttcactcaggaagccagtgagaccacgagccccagaagaacgaacaactccagacacaccgctttaagagctgtaacactcaccgggaaggtctgcagcttcactcctgagccagcgagaccacgaaccaaccagaaggaagaaactccgaatacatctgaacatcagaaggaacaaactccggacacgctgcctttaagcaactgtaacactcaccgcgagggtccgtggcttcattcttgaagtcagtgagaccaagaacccacaaattccggacacaatactagtacatgaaattgataggcttatcatggacttcgactatgggtcattttagcttcctcaagtaacctgttctagcccttaaatccttaatggtcagaacagtattcttttacctaacaaaattcaatggatttttgaccaatttaactttcatagattatagcaattactttttggcagagctttagaatcaggaaccaagtttctgatttacagcttaatgaagaaagcttacgagaggtaagggattctgaccacttacaggcacggccactcccgacgctgtgcttgcccaagctcctcaccaatgaccatagcggaggtcccacccggccaccacaccagatcggcggcgccaaggctacagcagcacacccatggtcgctgggccaacacgagaccaccgagaaacacatacccagggagtcgccaacgcacaagcagcgcgacaatactgcaagcagcaatgcagcgatgcaggccacccagccgggggccacgaaat

SEQ ID NO: 700893 - DNA, 976 bp, Homo sapiens
attttttttgtctttttttttagatagagtctcactctgtcgcccaagctgaagtgcagtggcgcgatctcggctcactgcagcctccgcctccggggttcaagcgattctcccacctcagcctccccagtagctgggattacaggcacacaccaccacgtccagctaatttttgtatttttgtagagacggggttttgccatgttggctaggctggtcttgaactcctgacctcaggtgatccgcccgcctcggcctccctgctgggattacaggcatccaaagcgctggaattacaggcatgagccaccgcacccggccttatcagttgattaagtgaaccttcagtgggcaaagttgttttaaaagtactgatacgagccttgcctgcagaggttgatgtcactgatttaaggtgggcccagccagtggttcagttttgcctgtcttcgagtgattggaatgtacagccaagagagtgtaattatggtgctggcagaagtattaacctatctggatgtcactgtcttcactttctgactaggctgcttccagggaatctttccacctcaatatttatgagatatctataattttataacaaacttttaaaggagcctcggtttccttaaacacaattgatgacaccagttttctggttttcttccatttttgtttatagagccagggtctcactgtgttgcccaggctggccttgaactcctgaactcaagggatcttcccacctcagccacctgagtagctgggactataagtggcacaccactgtgcctggtcagttttctggttttgataatctatggttgtgtgagatattatcattggggaaagttggaggaatacataggagtagtctatctttgcaacttccatgtcttatttccaaataaaaagtaaaaaccctcattgattatgtacttcattaaaacactggacttcaatgaaatcatcacct

SEQ ID NO: 700894 - DNA, 925 bp, Homo sapiens
attttttttgtctttttttttagatagagtctcactctgtcgcccaagctgaagtgcagtggcgcgatctcggctcactgcagcctccgcctccggggttcaagcgattctcccacctcagcctccccagtagctgggattacaggcacacaccaccacgtccagctaatttttgtatttttgtagagacggggttttgccatgttggctaggctggtcttgaactcctgacctcaggtgatccgcccgcctcggcctccctgctgggattacaggcatccaaagcgctggaattacaggcatgagccaccgcacccggccttatcagttgattaagtgaaccttcagtgggcaaagttgttttgtgggcccagccagtggttcagttttgcctgtcttcgagtgattggaatgtacagccaagagagtgtaattatggtgctggcagaagtattaacctatctggatgtcactgtcttcactttctgactaggctgcttccagggaatctttccacctcaatatttatgagatatctataattttataacaaacttttaaaggagcctcggtttccttaaacacaattgatgacaccagttttctggttttcttccatttttgtttatagagccagggtctcactgtgttgcccaggctggccttgaactcctgaactcaagggatcttcccacctcagccacctgagtagctgggactataagtggcacaccactgtgcctggtcagttttctggttttgataatctatggttgtgtgagatattatcattggggaaagttggaggaatacataggagtagtctatctttgcaacttccatgtcttatttccaaataaaaagtaaaaaccctcattgattatgtacttcattaaaacactggacttcaatgaaatcatcacct

SEQ ID NO: 700895 - DNA, 209 bp, Homo sapiens
tttggggggggcccttttttcccccccccccttttttttttttccaaagggccggggggggggggtttttttcccccttcccccccccgggggggggggggggggggttttttgggcccgggggggcttttttttaaaccccccccccccccccccccttttttttcccggggggttttttttttttttttaggggggggcgggttcca

SEQ ID NO: 700896 - DNA, 899 bp, Homo sapiens
tcgccggggcctgggtggtggccccgggggcgtttgaccctgtgtgcctcgtggtggtaggaggccgcccggtgggagggcccgcagctgttttggtgggggcgagggcggtgtccggggttgggactcaggcttcggaggtatgttttgagtgcgagcggcgccgcgtggggcctgtggccccttgggggtcgtcgcgtatccggtgtcaccctagggattgtggcgcgcgtgtcgcgcgtgccccccgttgtgctctcgggcgagactcggagtgcccgggtggtggaaaccccccaggtcagtcttcggggcggggcgagcgtggcgcgtattcgcgtggttggtaggcgccgcgggtacggatgcccgggcctcggttgggacttgttgggtgttcgtcggtcgccaacttcgggggagtcagcctgtgtgcacttccccccttgcccgctgctacccgctggaggggtgtggagagagggagccttgggatcaccccgtgctgatcttgcgcggagctggcagcggggagcccgggagtgtcaggcctcgctcgctcgatgaggttgattcgcgaaccccggggagagtctcagaggctgcgtacctggcagacgttggtttgctcgccctcgctgcctcccggccctacctcagcacagcggcatggtctcgtcaccggcatgtcctcgagttccaagttatcttttccccgcccctagtttttttcccggggctctttccataggtggttttttctcttctatcacattggggccatgggcatggtatggggaggggagggggtttttcccgacctcaggtcccagctgtttcacgttgtcttatttgcagtccccttttcccaatgccaccacccgttgggcgtggttata

SEQ ID NO: 700897 - DNA, 288 bp, Homo sapiens
agatgaggacagcaggtcgcaggaggagccagtgtttggctatgaggacagcagttcacaggaggagcgagggattaacaatgatgacagcagttcacatgaggagccagggtttgatgatgattacagtaggtcacaggaggttacaggtattagttatgtggtcagcaacccacagtaggagccatacttagctgatgatgcacagtagttcgcatagctagccacgattagatgatgaggacagcagatgtcagtgaggagccacgtgattagcgatgatgacag

SEQ ID NO: 700898 - DNA, 675 bp, Homo sapiens
ccgacagcttgggtcgagcccccccggatgctccctttctgttattgatcccccccccgcggtctgtaattttttcgtgaccgcgtggtctatttgcctccgtcaccaagtggggtacccccgctctgtctcttgtggcagacccactctctgcggtgctaactccccgcgccgtcttgatttagtggagtgtgggggttgccaaagtagtgtgtggtagctccgacccctcgctttggatgggccgtcatcatattcgcggcgctctcccccctcacgctgtaagataggctcgtttctatgcctttgacaacccactccgccgttacacgttcgcttatatctccccccctcacactgtccataccttagatgtgctctcctctcaccacccccactttgcgtgcccccactattctatcctcctctctcttcactaagagatcaccatatattatctactagaaacagatacctcacacgcttgctaaaccacgttctctcgctcctcgcgccaaaaaccactttgtcacgagagtttcttaaacacctcttggatttaccacattgacacctcgcgcccataattttctccgatccttacccacgcctctcctctctttttccgcctctccgtttcttcaaaccccacacaccacaacagtaaccaacaaa

SEQ ID NO: 700899 - DNA, 1083 bp, Homo sapiens
ggcgtacggtgatcctctatcaaatccgaagaccagcctgtcccggtactctttctgactttctgtccgactgcgacggctccgggcggaaccacaaggcttcattgctggtttggctgggcagagacagagctaacgttggtagccgtggagtcgttgcctgcgttgagaacgatgtgcgacgagcagtattggtgcattgttggtgatgtaaaacctcgcgcaacctgggtgacaggtgccctgtcgcataccatgcgagacgaccccgctgagaacactaaagtagacttttggtgtccggcgtacaaccgcccccgttggtgactggtgactcgagatccagccgtcacggttgcttggtccatcattctgcttttctgaaggtgacacgctgctgcgtctccgtgtctttactgcctggcgttcacttatccaaagcacacgagtatccgggtagaaaggaaccgcatgaggcgcaaaggtgactccaatctggatgtgtgcacactatccggctgatgttcggaggacagtccgtatgttccttctctgtacgaggcgttgcgtcccgcatgtcaacagctttgcttgtccttgcgacagattggattcggcaccagaaaccgaagcaagatcagttgcttctcgtcgaaatccgaacgaaggaccttccgtcaagagtcgacctcctaaaatcatggtatacacagctccaacgggcccttcctgctttcgggagacgagatcgggagggggggaaattccgaagggctcgagttcattcactcggaacgtaactcttggcaagaccttcagcatcgggtcttttacaaggagagactgccttagcttggtggtctattgacctgtctggttggagtctggacgggcacattcccgtgcccattgttcgtgatttccccggtccggggcgttgacgtttcacggggtcgggctgcctgagttccgcgccacactctgcgtccgcgcgttcctctgtggtcccaccagtgcgcccaacggtgtgtgcaccctcgtcacccatattggagcgctctctccttcttcctctttcttggc

SEQ ID NO: 700900 - DNA, 302 bp, Homo sapiens
ggttttataaacctcctttataagttgccagagtactccagatacatcaaggggccagattagcctgcttcagaagtgaggaaacatgaattttcttcccaggtttttctgctggagggaggctggattatgatcagatgtatgatattgttttctcccaggctgtgccttggaagcctttcaagtagggacagttcttagggacctgttcagttgctgaagttaaagacactcactgtattgtttgctgctggctagatctatttggaatgacaatgcaaaactaggtcaagtgtcgacgc

SEQ ID NO: 700901 - DNA, 482 bp, Homo sapiens
  misc_feature (482)..(482): n is a, c, g, or t
cggcttatggtgcagacatgggcaagtccaagaaccaagcagagacaaacaggtccgaaaatgtgccagaaatggtatcaagaaaacccgatcacaaagatacgaatctcttacggggggtggaccccaaggttctgagggaacatgcgcttttggccagaaagccacaaccaaaaggggctaaagaagatgccggtgcaacaatggcaagggcctggagtgcacgtggccgaggcctatccagggcctcggtaaaggccccaaggagggttaaagccccaagaattcccaaaggggtgtcacggccggaaggcccgaatcgagcttgggctacattggccaaccccaaagcttggggaaagcgtgcacagtaggcccggatatggccaagggggtcaaggctgtagcagggcaaatgggcaaagggcaaagggcgcaggggccaagatccaacccacgggccagggctgcaggcccacagn

SEQ ID NO: 700902 - DNA, 1494 bp, Homo sapiens
gagacaacaaagagggagaagatcgcagtgttatccactacgatgataaggccattgaactattcaaggatgaagccactgatggaggaggagacaacaaagagggagaagatagcagtgttatccactacgatgatccaggccattgcaacggctgctcagcacccgtaaccaggcatgcagcactgcaagcacaccagacattgccagggccatgcacatgcaatcatttgcagctctattcgaaagtggccccagtcatgtgcgtacgcggcaagcaagcaccatgggcggcaggcaccgcgcgcgcgtcaccacacgcggcgcaaaatccacttaacaccaggaaaacgacaagcgctgcgaactccctgaccctaccctggcgcatgaaaactcggcctgcaggccacccgaccttcatgaacgcccgcacacgccacagcaccgcactcttcgcgcaccgacacaactcctggggcccacaccgaggacgaccacgcaggacactcccggctcaccacagcggatcaccacattacccaacagcgcatcggccatcccccacctgtcagtggcaccccaggacctacccgtggggccaacggcgcaacggacagcccacagggcccggaaccaaaccccacgggccccggacagtaacacacttgccaccacgtgccccataccacgccacaggcacacgaggccgacacgcaacaggcacactaggggccactgaaccacgagcccgccaagaaaaacgccaaccacccgacgccaccagcgaccccccagaccggcagtcacagggcggcacactggcacaacacccgagcccacacacgacgacacgcacccaacaggacccactcccccactaggcacagcgaccccgcaacagaccggcaggcggcgacagcctacaccggcacacggacaacaccgcacgaacctcgacacaccaggcccacgcaccacagcctgacacccgacagcaccaccgacccacacaccagctgcacgcacctcacctcacgcccacacacctgggaaccaaaggcgacagacccgcacacgagccacacacccacgacacagcccagcacgacacagctgtccacctatctcaacacacagaaccaacacgcctcccacccaaggcgacgacaccacccactacacgagccaacatacaggcatatacaagaggagaacacacacagactgacactcacacaaatacccaaatccgacagcagcaactaccaacgccacccaccaagaccgagacacacactcagtaaggacatagacaacccctaaccggacacgacagcagcgtagacacgcacacagcacaaaaacaagcactagagcagtcagcgcgaccgaatcgatcatgcaagagagccaaccgaagatcgcaatacacacactacgccactcccagaagaccaccggcacaacaagcagatatgacagaacagctca

SEQ ID NO: 700903 - DNA, 330 bp, Homo sapiens
aggactcccagttgagcatactgtaccgagctcaacattctttacaggaaagaaatccaccccagaatttcatatctgtgcaaaactaatctttatagagaagaagaaacaggatcattctcgagacaagcaaaatgctgacgggaattgtcaccatcagacctgttcttataatgagtccctgtaaggacagcactatattatagataaggtaaacaccagttaccagtccaccacggataacacactgttagtacactgaccatgtgacactaccatagcagccacttaatcgagtctgccaaaagaaatcaaagttagggtaccgag

SEQ ID NO: 700904 - DNA, 833 bp, Homo sapiens
agcggaggtgggcttcagaaggtgggtagtagcaaacttcactgagctaaaggagtacgctctaacccaacatattggaacgaatcccagaacttaaagattggttctctaaaataagacagacaaaaataaaaaagaataaaacggaaggaagaaaacctccaataagtatggggttatatatagaggccaattctacaaatcactggcatccctgaaagggaggtggagaaatcaatgcattgggttagaacatgctcatttagctctgtgaaatttgttattacccaccttctgaaccctacttctgtcagcaaagaagctaagaaccatgttaaaagattacagaagatgctaactagaataaccagtttagagaggaacataaatgaccagagccagctgtaaagcacataaggggaactttgtgatgcaaacacaagtatcaacagctgaattgatcaagcagaaaaaagaatatcagagcttgaagactgtcttgccaaaataaggcaggcagagaagattagagaacaaaagaatgaacaaggaatgaacaaaacctcaaagaactgtggaactatgtaaaagaccaaacatatgactgattggactacctgaaagagacaaggagaatggagccacgttgggaaaacacacttcaagatatcatccaggaagaacttcccccaacctagcaagacaggccaacattcaaattcaggaaatcccgaagaaccccaggtaagatactccacaagaagatccaaccctcaggaacacctaagtcatccagaattctcccaagatccaaattggaggggaaacactgg

SEQ ID NO: 700905 - DNA, 580 bp, Homo sapiens
atacagcagtgcagctgcatcctgtaggtgactctgtagaggatcccggtctgagcaagcttggcagtatgtggatgcgatcctggcacgtactgtaggagatgtgcgtcgtgactggcagctactgcaggatgcacggcgggcaaggagctgggctgaggatgagaaacagaaggcagagacagtacaggcagcactggaggaggcccagcgggcacagggtatcgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggcc

SEQ ID NO: 700906 - DNA, 864 bp, Homo sapiens
gaataagaatgggatctagtgtactgtgttaaatgagattggcttcagcaatccattacagttaccttacatagcacattgatacgtgtgaaatgaacatatgaatgtaatttatatattcctagaaatttaagttactttgtgagatttgggcctgtccgctcaatgccagtttaggattgcttggattctatagctggaaatgattataaaatagattttcatgggaatcttaaaaactctgatctcaagagacattgtgttggagcagttttaacagccccagtacacagaatgtatacgaagagctacacaaaacactccaagtttcagcagttttagcgccaccattagtccacttggctagtctcatgaagagaatcttagtgtaaagttggtacacaggtaatcaaaaagttagtttagaagatatatagaggggtgtaagctaatcgtggtgtctagtaagtagcataatgcagatgtgaggagttggaacttagcgtgtgatgcggtattattcatctgcattcaggttcttaactctgggtttgtacgtcgaggtgtatagcgtttacaaatgcccttgtaattaccactctgaagtctgctgagtgtgtctctgtgaacatactttaggatattctgcaccatgatggaaaaaggtaacttttagaagtgtctggtctaataacgtggtggatgtgcatgagtctgggaagttatctaatttttgataaagcaccctggggtgcattggtcgtctcaaattcacagtttgttatgaagtactgggtaacagggaagggagaatcctatgatagcagttcagtttgaactcttagccatttgtgaatttaaaag

SEQ ID NO: 700907 - DNA, 404 bp, Homo sapiens
atttttggggggggggggggggggggggggtttttgggccccttgggccctttttcccgttttttcccccccccccccttggggcagttttttgttaaaaacggccccccctttttaaaatgtttgctttttttttccccccggggaaaaaaagggggagggttttgtggggggaatttttcttttggggaaaaagccccccggttttgatttttcttttctgcttttccccgaattttttccccgatttttttttgccggggtttttttttcaagttctccaaaaaaaaaaatttttttttttttttttgctggaaattattcccggtttttgcccccccttgggggaatttttttaaaattttttttgcccccccccccctttttaaggctagggtgggcca

SEQ ID NO: 700908 - DNA, 1159 bp, Homo sapiens
gtgcaacactttatggggaaagatttacacaggggtgaccggtcataggccaagcgatgaaaagagggcgccaggagtgtgcttggggctcccgaggtgtggcctcagatgtggaagccatgtgggacggccgtccccaggcccgcgcacccgcaccttcagttttcccctttggtgaaatgtgggaagcttatgcttcctttccaagttcgtgcaaatatggggtgcgagtgagcctaaagaggtgggagcgaaagaacacagaggaaagaaggctctcccactctcccgaggaccgtgcccccaagcctccgaaccccacatgtggtggcagtgcaagagaaagagggaaaatttgtgccacaaaacccagtgtgcccgagggtgccccccttctccgtttgtggggagcgaaagtgtgcgagtgtggctctctctctgtgggaatatacccgcaagaaaagctgtggaacgccagggggcccagtgtgcactctcttgtggctctgtgggaccaatatcactttgtgcacttgtggataagagacgtgtggcacgggtgcgcctctcgtggggcccacacagtggggccatgtgtgcagtgaacacccccccgggggtctcgttgactcaccaagtttggccagggccaggggatcatttaaacggctggggcgggcaccgcagggggaaacacttctttcttcccaggagaaccccttctctccccaagtgtcacgggagaccttctattctgggggggcagggacgcactacggcacggctcgttgggctttcaacaaggaaatttccccgggaggaccccaatgttgtggccaacaagggtgaaccgtgtttctttgaaccaggttatatattcccttccccggagagagcttatctccggggggacgaagtgctgggtctggtgggcctggcggaacatggctaggcgcaattccagacccgggggtgggggcgggctgccgcgcccaaactaaaaaaagaccaagccccgcagagacccccgaggggcttgtgcccaagtgcccccactaacacgggtgtttaacaaaaatatacaaaggagtcgccgccaaccaccagaggggtgttgtgcccaggtaagcatcgacaataacgccacctggccacacgt

SEQ ID NO: 700909 - DNA, 871 bp, Homo sapiens
  misc_feature (256)..(256): n is a, c, g, or t
agcggaggggacattcagaggcatcagccccgttcctcgctcaccgagctcccagagttcccatctccatcccgcaatcctaacacgaaggaaatcgactgccacggtcctcaaggagccctggggacccagtgctgccgctacatcgaagtatgtggccgcatcaattcccatgaccccggaggattgcccagacgaggccggaacaccagctaggatggcaggaggacaccatccccaaacatgaatgacaacnatctctgttgccatgtccagcgaagcgaatgaccaagccctaggggctgactcagtgcgatgctgggatagtagtgtcctgagttcacctgtattggcctgcatccactgtagaatctcatggcccatgcatggttctgtttaacaccgtgcagatgcaagctgctgtgcctagaagctcagtggagaacgacaggcattctgctccgtctgttgcttatcggattctggatgtttgcatattcacgttaccatcagaatagatgcaaagtctggctaggatgacagcataaatggtccactgcagagcgttgaggttgtaccaggagaaggtgcgacatcacagtggggaaatccaggacctccgaggtagcatgaaccagttcattgccaagctccaggagatggaagccagtgtccgatgagcacaaaatggcccagaaaattcgtgagagatgatacacggaggatgacatcgaaaaagccgagactttgccctgaagtctatagggggcagacattgactttgagcacacgtcagtcacctataaccatgaaaaagggccactcctactggaactgggatccagtgtggaactacgcacagccccaagag

SEQ ID NO: 700910 - DNA, 910 bp, Homo sapiens
ggttgggtggcctgagagcccatcgcgcgttgtggacggccgaccgcccggcggccgttttcagaccgcggggcccacggttgtgggggccgtgccagggggagggcccaagtgggcccgcttcccgcccgggtattgttcggggcgacccagtgtgcccggtgtccacgcgcccacgcggcgtttctcgggcggcctggtctcgagggcgtccccgggccccgtgcgggcgccggggtgcacgtgcgctcccggtcgagtgctccgccagctggtttgttcaagcgccttggtggggggaagacccgccccattgagaaccactgatcaagagactatgctggcttttcggggagtacccttctaacggtggcccatacaggcatcgaggcccagtgacgcatgacaggggccacagtgtgctgtggcccaggcctgcccagaccagaccctcaagggaccagggaattctgaggcctttgaggggcctccccggggcgcccaagacatctggcttttctcctcaagacattttattttttaaagactgtgaaatagtttgtcttttctgttttttaaatgatctatgaaaccccaaaagagactgatcatcccggcctctagcactcatcctcccccaggacccctgtcccaggatggagggtcccaatcctaggacagccattgttcctcacacccctagcatgaacttgtgggatggtggggttggctttcctggcatgatggaccaaggcctggcctcggcccgaggggctgctcccatgggccaggggtagctagcgtgtgcccggcagatcctctggacacgtaacctatgtccagacactacatgatgactcaaggcccaattattaagacattttctaccctgccaaaaaaataaaaataa

SEQ ID NO: 700911 - DNA, 304 bp, Homo sapiens
ctggtttagatcagaggatcccttagacagccgttccccctcacaagcaccttctcatacttcccatgcccggtggcacaaacttatacctcttcccagatggggtgctcttaactgttgatgaggtcttggagcctcccttctgctcccagaggcttttcttgctcatgtctccagccacaatatccttgcaggacggagtcttggccgcagactgagcctgtacctcacccgtctcccaccgactcttggtactggccacagccatgctgggcagctctgtggaggccttgcgggctagctt

SEQ ID NO: 700912 - DNA, 149 bp, Homo sapiens
tagtccgctgtattattgggtctgttaaattgtcattctcagtgtcttaatctgacgcagcatatgcgaggaaaatgtatcatgttactctatactaacattcgttctactatagggtgacagattgctcccattgggtgtgaggactt

SEQ ID NO: 700913 - DNA, 450 bp, Homo sapiens
gtgatcctcccacctcagcctccccaagtgttgggattacaggtgggggccaccccacctggctttcagtatgtttctgtactacaatgtcatgttccaggaagttaaagaaaacaacttcaacatccacattttcagaatatgtgtcaatggcttagaagaaaatgccacagatagtagtacagcctttctcatgaaatgttgcattaccacttcttgatggtgagaatgcagtgtcacgagactctaaagttgaaaatgtgatcttagaatgagttgtgacttcttgatctatgaagtctctaagacgtatccttacctctattatctttgccctatgtctattaactgcatcaggaacgatatatcgataaaaaatctgctatatgtaacgtttaaaaagtctctctacagtactatataaaaacatgtatgaataataaacgtatt

SEQ ID NO: 700914 - DNA, 345 bp, Homo sapiens
  misc_feature (31)..(31): n is a, c, g, or t
  misc_feature (152)..(152): n is a, c, g, or t
  misc_feature (165)..(165): n is a, c, g, or t
  misc_feature (173)..(173): n is a, c, g, or t
  misc_feature (175)..(175): n is a, c, g, or t
  misc_feature (178)..(178): n is a, c, g, or t
  misc_feature (231)..(231): n is a, c, g, or t
  misc_feature (248)..(248): n is a, c, g, or t
  misc_feature (315)..(315): n is a, c, g, or t
  misc_feature (336)..(336): n is a, c, g, or t
tcgtccttgtcacagtagcttgggatgactnccagtccacatggcatcagggagtgacaatccagcaagtcctcgctagtccacacctacgcaccgagcgtcggtgtgcaggcctgtgctggcagagtgtggatgcagggtggcggttaggnacagttcccctgnggactgcntnttnaaaggaatccagttcctccggaataacagcccatgttaacctgggctactggnaagttcacacagtaatntggcatgactcatggaaggatgaggaacgtttgttcacttctttcctttcagcaaggcagagttctngccaggggttagcacctggcnccttttggc

SEQ ID NO: 700915 - DNA, 740 bp, Homo sapiens
gagtgagtggttgtgtggtcgcgtctcggaacaccggtagcgcttgcagcatgggtgaccatctgactgtaatggagcagtatgacacgaatgtcaaagaaggcttgtttcacgtatctcagacgaaagagtgggtgactgggaagcatactacacgaacaaaggaatcgggaagcctgtaagtgagagtcgtctggggcagaaatcccacagaagcagagttacaggacatgagtttagtgaaggtagatgctgactgggtaatggcacaagtgacttccctgaagttctcgtgacgcaatgagtggcaagaaaatctgaagagacacagacagtgatgaagaaattagagaagcattccgtgtgttgataagggatggcgatggctatattcagtgctgttcagaacttcgcctgggtgatgatcgtaaacgttggatgagaagttgaacagatgaagaagtgatgagagtgatcagggaagcagatatagatggtgatggtcaagtgactatggaagagttgtgcaactgatgacggcgcagggaagagcttgtacagggtgtgttaaatttctctgttcaacttgttcattggcttttcgtggtggtacttatctgtaatggtgctcctactgtcagcaattgctgtttagtattagggcttcatcctcctgtttcttccctttctctggtcttggcctaaaaccttttttggaatgggccagtaccggtggtggg

SEQ ID NO: 700916 - DNA, 677 bp, Homo sapiens
  misc_feature (504)..(504): n is a, c, g, or t
  misc_feature (523)..(523): n is a, c, g, or t
  misc_feature (605)..(605): n is a, c, g, or t
  misc_feature (631)..(631): n is a, c, g, or t
  misc_feature (677)..(677): n is a, c, g, or t
tgcaggttttactttttgatttgtttggtctgatccagaactttgaattctttacatcaaatttccataattatttgattacttctttagatagattttggtactgctggtagtgttttggaatacagtagtttgtgacaaaaaaattcagaaagtaacatgtttaattacaagtaagaagtttactttattggtctgctttttaatttagtttttaaaaattacatctttagaaataaatttacttaaaatggtcagttaaataaagcacaaaggattttggtgtgatttcagggcagatacatagatagtaaaggctgaacttttctagaatataatttcaatggaggccgtgatattttttaaaaaattaattaaatatacccctctattcaggccccctgaaagtgtaagagaatggctacttaccttgtgtttcaatacttcccaaaggctcactgtattccatttgggattagatatcttgtctttgaacagtctggngggccttttcctctgatgntctttctttgagaagatctttctttatcatcttggcatgtcctcctcaaactttgattgaaggattcttgttttcaagcagngtagatagtctgcttcatacttctcnctgggcatattctactctcaggtcaattattattattcatttcgcn

SEQ ID NO: 700917 - DNA, 160 bp, Homo sapiens
gcgccgcccattctgtgtgtgcatggcggcgggtcgcctgtgtcggctctcttcgttctctgccctctgtcttccgcgtgccgtcgcgggtcggctgcgcctccctcgttctcgcttggtccgtgggctgctggtggtggcgttgtcgcacccagttgtc

SEQ ID NO: 700918 - DNA, 392 bp, Homo sapiens
  misc_feature (20)..(20): n is a, c, g, or t
agcattgaaaaactcccacntccgtgtgagaccaccacagtggtgcttcattagttgtttgcggattaaccaaacacgtattgagtgcctactgtgtgcccaaaccagtatttgaggtacaggggacactgtggcattcaagacagacagaagtctgccctcctggagttgacattccagagcaggaggcagataggaacaagcacacattgtaccatgttgagtagtgcctgcctgcaaaaataaattcaaaaattacatacacttcggttgggaccggtgctcaggcctgtactcccagcactttgggaggctgaggcgggtggatcacgaggtcaggagatcgagacaatcctggctaacacagtgaaaccccgtctctactaaaaata

SEQ ID NO: 700919 - DNA, 423 bp, Homo sapiens
  misc_feature (71)..(71): n is a, c, g, or t
gcaaaattttactactgggcttatgttccatttcctcctttgattagacctgtcacttggatggactcccntactgaagtttatacaaatggtagtatctggatgcctgggccgacttatgatagctgtcctgcatagcctgaggaggagggcatgttaatgaatgggataattgggtataaataccctccagtttgtttaggaattgctcctggatgtttgccattacaaatacaaagttggatggtctacgtacctcctcataatcgttctcaacctagttatcacgtagtgagtggaatgtcttttcaacccatcaggactgtaaaaacttaaggggatagttattatcagtcaaatataaaagtccaaaattgcaagcctaagggattggcttgccctaaaaggaatccagaatggtca

SEQ ID NO: 700920 - DNA, 896 bp, Homo sapiens
ccccgaacacggaaaacaaaggcgcagtggagggttctgctgtgtatgcaagtgagggtctgtgagtgcaacgtggcgcaaggcattaaggccagtgtgttagtgcagcgggcagtgctcgcagatggtgctggtggttgcttgtgtgagctggccctcgtggctcgggaggtgctgtgtttgcgcaggctgtgctgcccctggcgtacgggactgggactcctgtgattactagtggcgactgagtgcgctcttacctttgcgtcctgatctccaagcaagcacactgaccttcttcaggcaaatacgcacatgttcaattttccagaaagttctgtgagtaaggttaatacctctcgagtcatgccactagatgccgccaaatcccagcaaaggattggatagtaaggtccctggagattctggagataaaagaataccctcaccccctacccctttactgattaagctgaacggtaataatctataggcatcatggaatatacgatcataacctaggaaacaaaatacaatcaagttcatgtaaatagcactagctaggcagggcgactgttgacccaaagatccaaataatatagcgtacatttcataacctttaactcgcattgagagttaaaaaaaaaaaaaaaatgaggaccattatacaaataccacactataactctagagacaaatagaaatggaaacaacacaagaaagaattccaaacggcaaggtgatacgcaaaaagacacagtgaagtgccctgtaaaaattcagtaacacacacaataaggaagcatctcacagcatatattacaacatgatgctcccggcagatgacaaggaacaaaaacctaggacacaatatacagccaaaagtagatgaaccgcgc

SEQ ID NO: 700921 - DNA, 200 bp, Homo sapiens
atttcttacttgtcctatagattttatagatgcctaagctaaattttgttttactcttattggattaaaaattttataacagggagatcacaacttttaccttttttcatgtaattttgtaaaaggaaaatatgatttaaaaactattacaattaagtgctatttatacagtgcttctctagtatacactgaagtaagtt

SEQ ID NO: 700922 - DNA, 110 bp, Homo sapiens
  misc_feature (41)..(41): n is a, c, g, or t
ctccaaaataaacaacaggactgctcagtagtcagagtganttttgggtggggtttgaaagagttccagctttcctatgctaatggtgacataaaatgttaatttcatac

SEQ ID NO: 700923 - DNA, 104 bp, Homo sapiens
cgatggatcactacacactcctctttttttctgggggggagtgtgtgtggggtttgtttatttatgatcgttgtattttttaattcattaaccagatggttagc

SEQ ID NO: 700924 - DNA, 767 bp, Homo sapiens
agcggggaggctggaaagtccgggattgaggggccagcatctaccaaggtgccttcttgttacttcatcccatgatggaaggtggaagggtaaagagaggagaagaagcagtaccgggaatcttacatcagttgactaacctggacctcgacgatggactcagcgtggaaaaatcggtcgcgggccagcggtgagcagtgcgggcagcatgaaactacaagcgccgtgtcccgtcattccaccgccagccacagcagttcccacgactctcgggcattgaaggcagacgactcgaagccaccgggacactgagtggccgagaagacacgtcgtactccagcaggtgccatccatcgcaagctgaaaacctgcatgtcaatgaccagtcatgggctaggtcccgacacactcaggggttggagagtggcaggcaaacagaccgagctcggaaggaaggacttgaccaggacggatggacgattgttaggtttgattgacgcccacggtgatctatggagccagatcgaatcgaacgaagtctctaggacaagtcacgcgcctagactcatgtgtcatcttacattcactatgacggacattgctcagtgttccgcggaacgctgcatatggacgagctcgtggtggtatgattggctgataccgaaccattggagtcttccaaccatcgaagcctcttgcagaaaacagtatgtataacgctatcgatggccaagaagtacgtgatttctacttccacaagacgtata

SEQ ID NO: 700925 - DNA, 200 bp, Homo sapiens
gtatattttgtcctgctctgctgattccctgttccattgtgagcgacacttccttcattagtgagtttaatattatgtgttcgataacttcctaaacgtacctcctaacaagtcccttaatccttggacgtctgtcgatacatccccatctgcatttccttctcttgacaacatccttccctttagttactgagaagcca

SEQ ID NO: 700926 - DNA, 561 bp, Homo sapiens
aagatcatgagttcgtatgcagggtacatatgtatatatagttgttacgtgggtatatagcatgcatgaaaatgaggtttagggtacaaatgatcccatcacccaggtagtgagcatagtaccaataggtagtttttcagcccctacccccctacctatctttcccttctaatagtccgcagtgtctatagttcccatcttgatgtccatgtgttcccaatgcttagctgccacttttaagtgagaacatgtggtatttggttttctgttccttggtcaatttgcttaggataatggcctccagcttcatccatgttgctgcaaaatacttgacttgggttttttatgaatacacagtattccatgatgtatatgtggtaccacattttctttatccaatccaccatggttgggtaccttaggtagattcgatgtctttgctactttgaatagtgctgcgatgaacatatgaatgcatgtgtctttctggtaaaacaatttgttttgctttgtgtatatacccagtaatgggattgctgcattgaaatggtcgccaatccg

SEQ ID NO: 700927 - DNA, 697 bp, Homo sapiens
tgaaatctggacgggtaacggcttttccgagccacagattacgggctgcccagcgcttccttggaaagctgcggcgaaacgttcgactcccagtgttaatgcttgctccgcgacctcagctgcgcaccgttgcaccgtcgggtgagcgaggcatcactagcaggcgctaaatggactaccgtacgctctgcaattcgcccgatttagttcggtgtctgagctgaagctctcgccgtcgggcgggatctgatgaggaagccaaggaatgataaataagccaccgctaactgacgccatcgttgtagcgctcgcaaggctaatagatgattcgcagttgtccgaaaagcgtgagcccacacactacgacctcgacttgctattcgcccaagtcagcattactgcgggggatcaaccggggcctggaggacgtccagtcggaaaagcaaagcgcattcgaggtgcgttgaactgggcactaactaatcaccctaagggcggcgaagcatttatacccgcgttgatttcgacagtgcaggggtacggtggttttcgtcagcaatcaataaattactgcggcgctgaagcgatagcgaatttgatatctgcaattgcagctcaagggtgggagctgtcgatggacggaaatcttaccccaaatgttctagaggcgatgaaagggcggcagcttacacacgct

SEQ ID NO: 700928 - DNA, 1169 bp, Homo sapiens
ctgggccgttggcccgagcggattgcgggctctgtggctgcggggctcctggctgcgtggctgctggtgcctgcgatggctgcggagtcttgggatgctggagcccagtgcctgtgccgcgcggttgccatgaagggcaaggatggagaaggagggcggcgcacggttgggcgctgtgcggcagtgaagcccctgagaaagagccctgagctgcgcaggagctccaatggagctagggctaagtctgtcattgttcagtgggcctgaaagtaccctgtgaagtgcggtgtgtgcctttgcttacggcctgcgctgatcattgcatgcagcacgatgcaagtgcccttggccgagctgtccggcgacgcccattggaatgcttggaacggggacagatctttgtgaaaggggccgcacactatctttcctgggtgtgcaatgtgccaagcttgggaggaattggagacgcttatgcatgagtgcccaatcggccaaaatcttgcaagacgagctataccatggcccttggcccaaacgggaggcaagcagggattgaaaacttcagggggacggaaaattcccccagcgctcatatcgaacatcagcgaaagaacaagaaaggctgccttgtgaaacatggcaatttgacagtgatggcagggctgcaattccagacaagggaagaatgcgaaagcttgcaccttccttaaccttctccagggctcaatttgccggcgaggagccgttgaacgaagggtgagcctgggaaaggaagttgcccaagccgaaaacccacacaacgggcttgaatacgagcggacacggacaggcccaatctggtccgtgggcccccccaggcaagagaccccatgcaatttggacggggccaaaaaagcaacccggtaccacatagggtaaccacatttggtacggtgtacctatttgtggaacgcgaaaggcattaatataattccattccaaggtgtttgggaatttagaagaacacaggaagggaaaatggaacacggccgaaagtataacaatttcccccgcataaaaataacccaatggattgattgggcagaaaggtaactccagcgcctttattatgacagctttgactttgcccgagtgaaagcacccgtgtgtccattttaacagtgaccccc

SEQ ID NO: 700929 - DNA, 404 bp, Homo sapiens
tttatatgagacagagatcacgatctgatagacccagcctgaaagtgcataggcacaaactcggctcactgcaaactatgccacctaggttcatgacatacaccagcatcaaactcccaagtagttgggaatacaggcgcccaccaccacgacaaactaaatttttttggtaattttcgtagagacagggattcactatcttagccagaatggtctcgacatcctgaccttgtgatccgcccgcctcggcctcccaaagtgctgggattataggcatgagcactgccctgggcctaaatattcatattctttacagtacaatatactgctttcaatcacttttaaccatctgcacaattctaagaagtatagagaaggatggttacctgattttataacgtaaa

SEQ ID NO: 700930 - DNA, 132 bp, Homo sapiens
ttagtttcccttccacactgccctgcatgctggttgaatatgctccaccgcgagcgaggctccatgaccaagggcgcccgcgtgctgcgactggggcgtgggccgctctctgcttttcctttctgacccctg

SEQ ID NO: 700931 - DNA, 132 bp, Homo sapiens
cttttgagggggtcatagctcctccttatgacttataaatttatggtgtgcctgactgagaatttggatggcatccctaaaaccataatatccttttagggaattttgttttgccatgtccttagtataatt

SEQ ID NO: 700932 - DNA, 939 bp, Homo sapiens
gccacgaactgaagcactgaggcccggctgcagaactctcccgagaggggaataatccgtgccggccggttccgccatggatgccaggtgcaggtcagctcgacggtcaccgcgcggggagcccaagtcgcttcgtcatggctctagtgcgacgagagagcgcagttgatgtttccagtaaagaacgctggacgttgcgaccgtgatcaattattgtcccgtttggatggctgccgttacggtccatcgtccccgtctcgctgtcaatgtgacttgaggcctgtggtggagaaggacgtgccgtgccggtgggttctgagccgcgagtagtgtctggtgggttgcgtggattgcggaggctgaccttggagcgagcatcttgagacacgacactaatggaaggaatccctccattgttgtggagtcctgtgcacacgtattcgacaatggcacttaatctgggttgccggcggtgaccctgtcagatgatgcatgctggatgtgatatctgttcttagcccgagctaagcagcgtaagcttaactcgtctgacccctagcgtgatattcctgtggtgttgtctagaatcagataatgggaacatttatgatccagaaacggcgatggcatcacggtggcagtgcacaaaatggcctcttgatgctcatatctgttcttcagcaagcctgtcataggaactggatcctacctatgttagttaccttatagaactactaaatgttccagtagttaggccagttcatttcatgtgcattaggcacgtttcctgtttatttaagagtcaattgctttctacttgctctatggaccggatatcaagatattagtacgaactggctcctggtttgaacgcagcaggtccaggtcacttggtatataggaattttgctgtattccattaaatctgttgcacggacc

SEQ ID NO: 700933 - DNA, 162 bp, Homo sapiens
gtcatccggcaagagaagtggcacctgcctgaaatttggaacttggtgagcaacccagatgtgagcagataccaactgtaatcagatatttcctgatgctctttacgtgagcgggtttgcttatcacagtactcaggcaaatccatggtgtaaggtttttta

SEQ ID NO: 700934 - DNA, 426 bp, Homo sapiens
ttacaatccccactgatcacgatcttgtcatggcgcatgcgcacagaaagcactggcttggtgaacggtgaactccagcaccagcttctccttggtagtccttgccctcccgggcctcgtcccagatcagcacttggggtgcctgtgggaggccaggacatcctgagaaatctgcctctgtggtaccagatgtcgccccttctccatcaagggcgtccacgttgtaaatacgcacatctggtctccatagcgcatcacaagcagctcttggtctcggttgagacgcaagctggtcactcctcgaagtggcctgttgagtcattggtgcacgattgtacctcccagctggaataaggctgccaccgccttactcgcctagttcccgtgtctccggagatcgtcgggttctaagggtaccgagctcaa

SEQ ID NO: 700935 - DNA, 206 bp, Homo sapiens
tttccctggtatacccaccccttactaaaaatacacaaatttgccagcgtgtgataggtgggcgccctgtattccacgctactcgcggaggctagaggcgggtggatcatgaggtcaggagatctgagaccatcctggctaacaaggtgaaaacccgtctccactaaaaatatcacaaaaaattaggcgggtggggataccccggg

SEQ ID NO: 700936 - DNA, 615 bp, Homo sapiens
agcggagtcttcgggcgggcggggtctgctgcagcgtggacccggtgagcggggcccgtgtgccgccgtggcctgcaggggcgatgtgagccccagtgtgtatcccagagggatccgaggtgacttctctgcagactgtttgccatgacagcccaccaaggacggggggaataaagtggtgaaccgcttcacctcatgcccctcccacggtcagtctccccgatggtgctgggtgagggcaggctggtcgtgcgtctgtactaccatggggagctgctgcgagctgctctgaacagagacagcgttccagacaagcacccgcagacaagttcaaggtgacaaaatgtggatgatgaggcggcgtggacgctgggctctgggcgtgatggagctgacagcagagatgagcatggtgctgcaccatgcatcggcgtgaggccgtccgctggccttatctctgcttgcggcgctatggctacgactccagctcttctcctttgagagtggccgccgatgtcagacaggccagggaatatttgcatttaagtgttcccgggctgacgaaatcttcaacctccttcaggatctgatgcagtgcaacagcatcaatgtgat

SEQ ID NO: 700937 - DNA, 347 bp, Homo sapiens
gtaaaaaaaaggttttaggcaaggcgccgtggctcacggcccctgaatcaaacactttttagaggtgaggcgggcggatcacccttagtaggagttcgagaccaggctggccaacatggtgaaacctccccgctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactc

SEQ ID NO: 700938 - DNA, 363 bp, Homo sapiens
  misc_feature (293)..(293): n is a, c, g, or t
  misc_feature (300)..(300): n is a, c, g, or t
tctcttcgatgacaggctcatttggccaaaaagccgtttagcgcgggcaggccttctagggagaggagggtggctgtaattaagggtgctagtcatgttagcttgtttcacggggcgagatagtagcaacggtcgtgctgctgaagccctggcggagtagtaggaatgcggtagtagttaggataatataaatagttaaattaagaatggttatgttagggctgtacgtgagaactgctattattcatcctatgtgggtaattgaggagtatgctaggattttgcgtagctgngtttggnttaatccacctcaactgcctgctatgatggataagattgagagagtaaggagaaggcttacgt

SEQ ID NO: 700939 - DNA, 360 bp, Homo sapiens
taacagtctcgatgatagcccaccatctacctgcaagtcactccatggcccagttcatcttgtagtagttagccagtccccaagtcaatcatgatgtgcttgttcctgaagaacaaacatgacagtacatggatcgtataactcatacattttgttgaagtcaggcacttctgtaaatatccacaagataaataactgcaaaatttttaaccttctcggcgatgctgtacaggacctcgtccatcttcatgcacgtaggatcccagtcgtggccgacgcggatgacgaccacgcggtcctcctccgagaggatggcctggtccacctgccagccgttgtgcaggtgcggggccttgtacg

SEQ ID NO: 700940 - DNA, 112 bp, Homo sapiens
gtatcgttatggatagatcaccaactgttgtcaaccctccagcccacaactcaaggcactcctcatcatgtctcaccgctatctgagccatctccctttagggaaaatttcc

SEQ ID NO: 700941 - DNA, 102 bp, Homo sapiens
gagggcgctgcaatcccagctacttgtggaggctgaggcacaatgaatctcttgaacccagtgagatggatggttgctgtgggctaatggtcacaccactgc

SEQ ID NO: 700942 - DNA, 476 bp, Homo sapiens
tccccgagtatccgatcgcccgtgaatactaatggcttagtaaccatctgtgtattactcgatttaacactgctgtctcctgtgggggtatagatatgagcaaagtgtttatgagctgcatttgtgcatagcttagatacctgctccttttagatccgggtgatctagaagaacattttcactgtgggtagggttgtttgcatgtgtaatcttacaaagaactaataaaaaggtcaggaccaaacctatctataaggttttgtggacccatctagacttcttcagtgtcttgctttgagtggttaagctacattaactgtgtagaacacttaagtggaaaattaaagtatgagaaagcaaagaaagcaccgaaagaaagaactatagaattcgttgcttcacagttctggaaatccagggtctttaaagttggattggcagaggtttggctgagagggttattcataataaattta

SEQ ID NO: 700943 - DNA, 440 bp, Homo sapiens
  misc_feature (143)..(143): n is a, c, g, or t
  misc_feature (357)..(357): n is a, c, g, or t
  misc_feature (360)..(360): n is a, c, g, or t
ttcggcgggatctgcgggccgtaccgcggcatggccccatacccacggctgaccacctcgaacaggtagccgaccggagcctcccgcagcggcaccgccttgcggtacagggcgaacccgcgggacgcatcggcgtggaagtncggcggcttcacgtacccgcgttccgggatcgtgccgctgccggtcccgatcgggtcgtggcagacggcgcagaagatcgtgtaccgctcctgcccgcggtcgaggtcggcccgggtcagctcgagcgggaatgcgtccacgaacttccccggatcgctcggggcaccccgcggtggcgtggccgtggccttctcgcccgccggggccgggganccnccggctcccgctttcagcccggtcatcagcgggtcgtcgctccgcagccactcgcgtgcgatcgcgccctcgggcggccg

SEQ ID NO: 700944 - DNA, 258 bp, Homo sapiens
tactatgctggagggtgatatgagaggatgcttgatacctggaaggcggatgctgcagtgagccgagatcacaccactgcactgccagcctgggtgagagagtgagaccctgtctcaaacaacaaatttttttcaacgcaaaccacgtaatcagaaaggatttactctcagtcatgataaagggacatcatacaaaagaatctgtagtttctgtcgatacttacatagtaaagagagaaattgcctctctcccttaaa

SEQ ID NO: 700945 - DNA, 105 bp, Homo sapiens
ccagctagcaaagacagaaggtgaacgacatctagaaacattacaccacacacaccgttatcacattttcacatgctcaattgatatttcttagctggtgggaag

SEQ ID NO: 700946 - DNA, 149 bp, Homo sapiens
ggagttcacggctgcagtgagctatgttcttgccactggactttaccctggatgacagagtgagacccggtttcaaaaataaaaacaaagaactactacataatccaacaatttcacttctggctgtatgtccagtgaaattgacataa

SEQ ID NO: 700947 - DNA, 178 bp, Homo sapiens
aaggtagggatagaatcagaatttattgaacatcttgtatgtccgggtttggacactatggtctgcaggccaaatctagcttaccaactatttttgtaacacaagatgttattaggaacactatccataccttattatgtttacttacgtgtttctggactgctcatcacaactacaa

SEQ ID NO: 700948 - DNA, 225 bp, Homo sapiens
ctgctgcccagcatgaagacataccgggcttaattctgtggagtatgtaccgacggccgatggtgcacccctcacagaacaccaacttgccggaggagtacaaggtgccctgacggctaggtcatgaagaagacatgatgtcattaaagactgtgctaccattacatctgtcccggagacgatacatcttggtcggttgtctaccaggaagatgacggagacatg

SEQ ID NO: 700949 - DNA, 207 bp, Homo sapiens
acgcgggatccgtacagcctgggtgtcctcagcggacgtacccacggatgatgctgttacgggcacaggtggtacaggtgtgaatctcagctctgccactttatgtgtacccaccacgaagaccttgggcacagtgactccagtttctctactcagagccttcatctagctcatcctacaaacattgggccaatgctacctccgtat

SEQ ID NO: 700950 - DNA, 1504 bp, Homo sapiens
  misc_feature (605)..(605): n is a, c, g, or t
tggccctaacaaaacttgctttatttgataaaatatgtgcagttgtaaaggggagtagaaacaaggggggcagggcaaaagggtgtgcaggtgttgtggaggtgtgggggcgggggtctcttacattagctgtggaacctgtggcccttggggggtgtggacgttctttatctcaggaacggaggaaacaaaggttcaaaagttctccggaggtgtgggccagctcctttgtgtgttaacagaatctcatttgtgtttttctccagggggtgtgaaagaagagaggaagactctccagaagacacctgtgagagttaggcagtgtggtgggcaagctgtgtctcccagtgtgcacctctctataggggaaacgacccatagaccccccccaagtcagaggccaagcagccagagagaacacctcttgtgtgcgggacacagagtctctgtgtcgctgtgtgtgtgtgacaaaacacgacccacagtgcacacacagtctcaaaggtcagcagactctctcccgcccctatttgaggttctccccatataagcactgctgtgtgaacctgtgtgggcttttctcctatagaagagagtggcgcggncgatgtgacgtctaaaagatatcatctcgaagaaaatctctctctaaacaagtacatttctccccctctctttttgtgcgggctctctcaatctctgatctccccaaagggggggtgtgcacgacaaacgccagggaagagagaagcccctataaacgctgttgtacgagagtctctgtgagaagtctcccaaccaccctctgtgggggctctcgagggttttctctcacacatgtgcaagattttctacaaagataattatgtctctctccgagggctccaacagaaagacacaaacgaaaataagcgcgatgaagggagggggtctaagaaaatatacccaaaatagaaggggtctcaccaggaagaaacgccgaaattttcgtcacaaaagagggctgtgttttgtgggggcccaactgtggcgccaacttttcctgtgggaatgttggggcatctcctattaggcccgccccccaaggggggggaaaagtcgcccgccacacaattattccccccagctttacacgaagaggtttacgaacgcaagcggtataacacattcccatgtggcagaagccgggcgggattacccttcacagaaggtggggccccccgcccccgtaaaaaaaaaacaatgtggtgaccaagggggggcgccgcaagcatgtctgtcttgctgagaagaatacaaggcgggagaccccacaggtggactaatagtggggccggcatgaggggagacccccccctggtggagaaaaacccccccacaccgccgagaagaggaggggcaccaaaacgctttggctgaagcacacactagtgacgaaaacacagccccacagcaaaaaccgcacgagagacaacaacacaaaagagggcgcccgttgaaacaa

SEQ ID NO: 700951 - DNA, 415 bp, Homo sapiens
gaaagcttgcacgtgggaaacgtcgggccggactgcacatgtactgaggttgagtcgtgacggccacaggttccgaattttggcgtgaggaaccgctgatcggccacgggcgccgaacttgctggcctccgaatgtgcctgagcggcggcgaaaaaaccaccttaattgggcggagggttagttttaagagcaaagggcctttactaaaatggcgaggctttccgtcggcgttgttttaaaatgggaagcctcgaccctgtattgaaactaagctgttcgaaggcggcgtgtgtcaattcggattaatgaggggaagggtttgtgtggaaaacgccttgagtttaaattctcagaatcttaaaaccgattccgggacaatgcgtcttagtgcaaatgagcaccttagatcaagaa

SEQ ID NO: 700952 - DNA, 1754 bp, Homo sapiens
  misc_feature (245)..(245): n is a, c, g, or t
  misc_feature (398)..(398): n is a, c, g, or t
  misc_feature (868)..(868): n is a, c, g, or t
gtgttgcaggtgaggcaaagggatcgctacatagtggactacttgcgaggattttacatactccacatacaggaagagactaggcattgcctgtgtgtatgtagcttggaagaattggtggcggcgtcctaagccgaggcatgtgccctaggcgcgtgtgcttcgcacgcatggctaggctacaatgcaagagaacgggtggtctaccatcactagcgcatcacaacgtcgtggtcgttcgtagncttgtggtcgagcacacctcagaggacggacctaacagtgacagatatcggaggtccgagaaatgtagcatcgctgacacatgagcctgattcatgtcccaggagcacaaataccgggtgtgcatatactcatagactacagccacgtgacantgagcgcgagaggatgcggagcggcgtgggtgtgcccctgacgacatccaattccgggtgtttccatagttcgcatttgtcggggagagctctgagaggacgggggctgagggctacgttgcacttgtgtaccccttgggtggctttatggacttggaaacctctgcgcgcggctttcgggtggacccatatatgctccggtcagtgtggggaactttgatacccccagactgtcacagctgagtttggttgcgtccctaagcgcaccgtttgcgttagacgttcgcgaagatgtggcacgcgccctgggttggctagataagagtgcccggtgagtccaacgtgaacacgttcgtaaggcgtgtagggcatcgacgcttttgcgaccctcggtggcttcggatttcggcaccttttcgagcacgcaagtagaacgtcagaggagtaactctatgtccagcaagtttccncccccattctaggggcgataagtcccatgaatcggcgagcggattggtgaaacaagatactttttccaaagatggtttccggtggattcccgaggaagacccaatcttatagttctttgaggggcattgccctaaggtatgtcttaagggcctgttcctatatcaaaatttcaaggccctttgatttccttaggtgcattgggtttacccccgattatttcaggggccccctggagcaccgtttgataggcgtgttgcggagttccgttaagaaagggaagttggcgtgttgaatgagaccggaggctgtggattgtctgtgtgatgtgaggacggatgtccgaataggagccaatatgggcgaaatgttgggtgtcgccagtaactttatcccctggggcgccacacgtctatgtggtacgggtccccccaagtttgtagtggaagccttcggcatgggtcgtgaaacctcttgtgggaagatatccctggaactgtggtcaattgtgcgcaattgtttgtcccatggtctcatcacgcagggtggtttaaacccgtagatagtatgcacgggtggggtccccctacaacaacagtaggtggggaactacatggttttcacaaacggttgtgatatcatggaagatggcggcatccccaggtggagggggaactatgatattaacccaggcgtgtggtgtgatcagggacgtccaccatgtcaccaggcgacaagtttatagatcaatataaaggtggtaggtggtataagaccctcaatggtgaccttatacaaccatggctgtggacgatcaagtaatcgagagattacacatactacgacattctgttgtatagacaccgagtgagctactacaaccagact

SEQ ID NO: 700953 - DNA, 888 bp, Homo sapiens
  misc_feature (33)..(33): n is a, c, g, or t
  misc_feature (176)..(176): n is a, c, g, or t
  misc_feature (267)..(267): n is a, c, g, or t
  misc_feature (285)..(285): n is a, c, g, or t
  misc_feature (338)..(338): n is a, c, g, or t
  misc_feature (400)..(400): n is a, c, g, or t
  misc_feature (424)..(424): n is a, c, g, or t
  misc_feature (445)..(445): n is a, c, g, or t
  misc_feature (463)..(463): n is a, c, g, or t
  misc_feature (468)..(468): n is a, c, g, or t
  misc_feature (683)..(683): n is a, c, g, or t
  misc_feature (685)..(685): n is a, c, g, or t
  misc_feature (728)..(728): n is a, c, g, or t
  misc_feature (881)..(881): n is a, c, g, or t
gcgcgggggggcggggggggcggggggccgccncgccccgacgggacccccctgaagccaaggcagggggagggcaggcaggaggctgtcctggatcccaggcaaagccccgggccccttggagcagcaccaggggtcccgacacccccaccgacagggtcgaacgtgcacaggcngggaccacgccggagtccattgagcccccgtgggggagggcagtcccagggaccaggaagggattcccgtccagtgtcaggttatccaccncgggcagcccgtcaggcngcggcgccctgggcaggctgtggcagcggagagcgagcactctgagcttggcnggcagtcctttaggcacctgtgccagcccagcgaacgacagagtgagggagtgcagggcgcnggaccacatgcatctcggagcgcnagggtttacgggggcgcgcanaggtggtggctgaggtcnaggcngtggggctgcacacctgccgccgcgcagtgcgcgcacacgcctgtgggcgtctccattcctgtgttgcgcacgctagattctggatggccgggaacttgtggggacagagagccgccatcagtccgcgttcgcccagtccaggattgtcagacaggtctaggctggtaagggccgggaaggcgcgaacctgttcgcaggaaaaggcaggcgagtntncttgggcaatgctcagtaccttgaggcctggcttgagccactnctgcagctcggcgagccaagaacgccctgtcgcccacgacacgttgcgtaggcgcaaccgggaaagtgcaagttctgtggcttccagaggcagcggaggcatggtgccggttatctttaggtcctcgagcgtgagttccttgaggcgggagtncgctagc

SEQ ID NO: 700954 - DNA, 1434 bp, Homo sapiens
cctggacggtctgcgaaaggccgggacccggttcccgcgggccacagtggggggtgtgcgaacccgagagaactagggttgccacattcgggaagaatcagcatctatgtgtggtcacgctgagctattgggcagcctaggagaccgtggcgcatcgaggattgtttgcaggaacgacgagctggctgtttgatgcatgtctcggcaagggcatggaatcatacagacgctcaagaagaatagcgttatatttgcaccgaagtagagatagttcatggtacaccacagggagccacgtacgactgctcgatcacgtattggaatttcgtcgaaaatacctacacgtgggcactcgaacatcgtgcgggtggtagcaacacactggcttggccctcgtagtggtactcacgacgggacatatggcctcgacgccacgaatcccacagcagcaatcactatcttctgcgcgaaccctcttctctccttacgcgaagacaggccaacccatttgggcgggtacttccacattcccattttccactccaattttgctttgcaaggatttctctatctctcgcagagcttctcttctactactatctctcctctcatcacctcatctggcgaccacgaccaacctagtctccctgtgccgccgcgcctttctagtgcacccccgacggcgccgccgcgcgcagagcgcgacgttgacggctgccgcaaccacacaataatccagcacaccgcagcgcctcgtcatatagattgtgccacatcttacccctctactaatcgctccccccccggcgacggtggctctcttatcaagcgtgactacaatcattctccggcctccacacaacccgctactgcggcatctactgcgcgcgtctgcggcgacaacaccactacacacgacggcgcttcgtcaccgcgagcagcgccgccaccgccgcacccgcgtgggtgcctgttgtaaaacaccaccgtccttaatctttcgtatcactcgtccgctctcagctggatccaaacccgctcggggcgcatatccttcgctaactctccaatcatgctctcggagcgcgccacctatgcagtcgtgtggtgggctcctcatcatgttgacgtcgctcttccgctcgctggtgccggtccactcaccaaaacgatggactggatgtcctcccactatctcgcccgtcggagcccactcaactcgaccgtcgtctaattccctagcaagaaggagtggggaccacaccgcacagcgcaccacgcaactttgtatgtggcgatacaaccgcatcttacagtgtggcccagcactcgttgtggcccacttcttccgatgtttcgccctcccacaccatacacgagcagaaggtgtcgtctcacatttcgccaccctgtattctgcaacactcgtcgaat

SEQ ID NO: 700955 - DNA, 149 bp, Homo sapiens
  misc_feature (95)..(95): n is a, c, g, or t
  misc_feature (97)..(97): n is a, c, g, or t
ctaaactcgtaccgctccacccaaaagatatcagctcaatgttagtgcagtgagaatctgatagtaatagggcatatatgatttttgctctgagntntgccatgtctgtggtgtaagatcagtctgtagtgtggaggaacaacagtgtt

SEQ ID NO: 700956 - DNA, 435 bp, Homo sapiens
aacaggtggtgcgtgtatgtgctcgtccccgctaccctggcgatcctgcccactgggaaaggttatttcagatctctcataacgtagcgagatgagttagaggagggtaatacgtgacagtgcctgtgtgcatgcatcatgagctgggaaatcagtttctcatactccttctccactcctgggcatatcatgcacagccaggccaaccgcctccaaggctcccatgttgcacagttgattgacaccggtaagctcatggcttctgcccctagctaggacttctctgtccgtcactctgctttgactagatggagaatcctcgtgttggctgaagggccgattctggattcctggccatccagagagccccactctgctccccccggctgctgtgctgaggaggggctgcgggtgtccgggctggccccaacctag

SEQ ID NO: 700957 - DNA, 529 bp, Homo sapiens
  misc_feature (344)..(344): n is a, c, g, or t
aaccatctatattcatgagctttcaatttcagggcaggccatagttttcttatctgagaagcaaatccctgtggaggctataccccttttttttttgagattaatggactcttggagcccgcccccgtggttattgatccatttgtgtaaaccaaagccccgtggttgcccattaaaagggtccttgttccttttcccccaaatgaagggtgaacgggatgtttttggaagcaaacccagcccagggattccttttgggttttagttttaaaagcccccctttttttaaaacccccggttcccggccccatggtggggaagcccaaattgtttgggtttttttngagcaacttttcccttccaaaattggccggggggcaaaatgccaatttatatgtttttttgaaaaaattcctttagctgccctaccaggccaatgcttgttaatggttaatataggcagggggaatactcctttgtaacttttaaagttttaaacttttcaataaaattgggtggggcttttggg

SEQ ID NO: 700958 - DNA, 301 bp, Homo sapiens
tggtgtaacatactgtcgacaggttgcagtaagctgagagttgcacatgcaatccagcctgggtgacagagtgagactctgcctcaaaaaaaaaaagaaggggcaggtatggtggtcacggcttgtaatcccagcactttggaaggctgaggtaggcggatcgcaaggtcaggagatcaagaccatcctggctaacacagtgaaaccctgtctctactaaaaatacaaaaaattagctgggtgtggtggcaggcacgggtagtcccagctacttgggagactgaggcaggggaatggcgtg

SEQ ID NO: 700959 - DNA, 453 bp, Homo sapiens
cacagtgtctcaggcctgtaatcccaccattttgggaggctgatgagggaagatcgcttgggcccaggagttcatagaccagcctgggcaacatagtgagatccccatctctaaagaaaactaaacaaaacaaaacatgttctttttttttcttttttcttttttttagacaggctgtcactctgtcacccaggcgggagtacggaggcgcgatctcagaggtcacatgcaacctccagcctgggtgacagagtgacagcctgtcgaaaaaaaaaaaaaaaaaaaaaaaaaaaaagacgggaggcgcgccgggccggcggaagccacgcaggaacacaaacacgaggggcgcagaggggaccaaaaagcggaaaggaagaacaaggggaaagaacggagacacaaaagaaaaacgaggcaaggaaaaaaagagagaaaaaacacacaaaaaaa

SEQ ID NO: 700960 - DNA, 805 bp, Homo sapiens
ccttctaaaaacttgttgacaaatccgaatccaaggtttcccaaatcgcccgcacatccaaagcgctaccgaacgctacggggaatccggtatctaactctcccaagctccttactactaacttgctacccagtcgatccctaaagggcacctacctttaactctaccgacgctaataaaggcctacggagggtttagaccctaggcatctaccttatcctattatcctatactccgaaaggagcgaacacagtagtaagctccccattcctaagactataacgatccggaacgatatccgtcgaaagacgactaaagctcaaaagccaacccggcagctcctgttactgcggctcaaccgggggcgacgccatactccgaaaaatcgcctttaataacgtccccgctatcctactcgtgagcatcgactacttcctattcttggtcttaatattttctgttgtggaggaggagttctaaagctgtaaccacgttaccctaatatcgaggacgagcgacagatccgagtttcgagagttatcgtcagcttcctcctcgaatcggcggagctttaggggtagactaaagtactatccctaactagctaccgtcttccatctacgtagtagccgaggtcctaaggtaatataaaagaagcaccgtccgctgcctatccttcgagaacgcgtcgttcttcctattaataataatcgactttttatcctatatatgtcctacctatcggcctctcgaaaagcttctaaatggtagcctcctcgcccttatttgtattatgggtaaaacg

SEQ ID NO: 700961 - DNA, 755 bp, Homo sapiens
  misc_feature (1)..(1): n is a, c, g, or t
  misc_feature (153)..(153): n is a, c, g, or t
  misc_feature (156)..(156): n is a, c, g, or t
  misc_feature (203)..(203): n is a, c, g, or t
  misc_feature (277)..(277): n is a, c, g, or t
  misc_feature (283)..(283): n is a, c, g, or t
  misc_feature (298)..(298): n is a, c, g, or t
  misc_feature (300)..(301): n is a, c, g, or t
  misc_feature (316)..(316): n is a, c, g, or t
  misc_feature (363)..(363): n is a, c, g, or t
  misc_feature (372)..(372): n is a, c, g, or t
  misc_feature (539)..(539): n is a, c, g, or t
  misc_feature (556)..(556): n is a, c, g, or t
  misc_feature (593)..(593): n is a, c, g, or t
  misc_feature (628)..(628): n is a, c, g, or t
  misc_feature (636)..(636): n is a, c, g, or t
  misc_feature (661)..(661): n is a, c, g, or t
  misc_feature (665)..(665): n is a, c, g, or t
  misc_feature (680)..(680): n is a, c, g, or t
  misc_feature (726)..(726): n is a, c, g, or t
naacacaccacaccactgcctgcctcggcaatgacattaatgttcttgggagcccagaaactgaaataaatttccagcaaaaaccaaagcagacccactgcctggataaattcagaccaaacgttttccctaattgttccgggaacttttgcngcntgaagaatgcgtgaatggctatattgttcaccagaaagacagaggtnaatccccagagggaaatttcagatttttcttttggtttgctttttggtttttcatttttgtagaaatggggggngtggcnatgttgcccaggttngnnttgaactcctgactncaagcaatcccccagcctcagccttctaaagccctgggtttacaggnatgagtggnctaacccagcccccagaatttctactttaaacagccacactaagaactggaaaactgtgcgtggggctctgagagcaggggtggaaagcctgtttgtgtgtgagagtttaacagtttataagaggaagtgccgtgaaggcacagatgggcacacccatccctgcctnggcggattccttctganccttcccacagtttgtttttctccatccttccatccncacctctttctcttgaaaactttctcttcccaaancacaatanagcggactttttcattttccatggncccngaacttagttttgtnatctctttttggttaaaaagagagagaaagaaagagagaaaaaaanttcccacttgtgctgcgccatctccaaaa

SEQ ID NO: 700962 - DNA, 476 bp, Homo sapiens
tgagtggtaggaagatatgcagagaaggaggaagcctctatacatctacaggtggtgaatagtaaggatggtgcagccgctatggaaatggattgcagttcctcaataaactaaacacagaatgaccatgtgactcagcaattccacttctaggcatatatcttaaagaattgaacaaggtgttcaaacaaaagcttgtacataaatattcactgcagcactatttaaaacagctaaaagatggaaataacacaaatgtttaccatgatatgaataaacaaaatgtggttgatccatacaaggaaatagtcgaccataaaaaggaatgaagtactaatacatgctacaacatggatataccaagaaaacacactgtatcagctgggtttggtggctcacgcctgtaatcccagcactttgggaggccaaggtgggtggatcacttgaggtcaggagttcgagaccagcctggccaa

SEQ ID NO: 700963 - DNA, 328 bp, Homo sapiens
tggaagggcaatacaccctttaaagaacattacagcttaaagggaagggtaatacacaaaacatttccacaaacgcagtttccactctctttgcctacagggctgcccaaacggcaaaccttttaatggacatcatgttaaaataaaaggacttggcctgctttccccagggaaaccccctattccactgtaaacagttttcctcacaaattttttgaaaaaacccagggactcccctttttggaagccaaaacctgtgcattccttggtgacctccggtgaaagaacttggcccgacaatggggacaaagggccccgggactttgct

SEQ ID NO: 700964 - DNA, 117 bp, Homo sapiens
ggaacgcgcccgtacttgtgggatgaagactcgatgcctgtgcccatgatcaatccccctgcagagacaggcgcgttagcccagccgggctggagaagggcgcaaccaccacgacga

SEQ ID NO: 700965 - DNA, 481 bp, Homo sapiens
  misc_feature (11)..(11): n is a, c, g, or t
acctgacgaanctttggcgtcctccgtgcccgcgtgtaggatttggctagtctctctcaagtgaagtaccctctgctctgtggctgctgggaggctcagccctccattttactgctgttgtacataatctgtcgttcttattgctaatctcctctaagtcctgcttgttattccggtgagactcccagcctttcttcactctgcccttcgtgagagcagtattgtaatgggtcacaggccagccagcagacagtgtctgacaagacaaagtctggtatttttaaactgtccgtttattttttttttattgccactattctatggatattgaatatctcaacttcttaattttataagaggttttcttttagaagctatgggagtgtgggctgtcatcctacttttattgaagttttattgaaacttagactaaagtgaggctggtggcaactgcattcacaaaaggtgatgtgaaagaagg

SEQ ID NO: 700966 - DNA, 121 bp, Homo sapiens
ccgctggccaatggactaattagctacccctttctcacagagtgaacgttgtggttggaggaatgaggcatctgtgtgtggagaagtccaccctaagagccacagatgtgtgcctgggggt

SEQ ID NO: 700967 - DNA, 1060 bp, Homo sapiens
  misc_feature (1)..(1): n is a, c, g, or t
  misc_feature (100)..(100): n is a, c, g, or t
  misc_feature (329)..(329): n is a, c, g, or t
  misc_feature (340)..(340): n is a, c, g, or t
  misc_feature (509)..(509): n is a, c, g, or t
  misc_feature (603)..(603): n is a, c, g, or t
  misc_feature (1028)..(1030): n is a, c, g, or t
  misc_feature (1033)..(1033): n is a, c, g, or t
  misc_feature (1038)..(1038): n is a, c, g, or t
ngtatgcaattcgcaagaaatcgcagggaattgttgataataaggaatatgcggttaatgaagttgtggcaggaataaaagaataattcaatgtgatgtnggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctcnttaccgccagngattacaaagtggcttctgctgagtaccaccgcaaagccctgtgagcgtctacagacagctcaccatttttgtcctgtatcgtgtaaacagctttttgttcttagtctttttcttgtaaaattgatgttctttaaaatcgttaatgtataacagggcttatgtttcagnttgttttccgttctgttttaaacagaaaataaaaggagtgtaagctccttttctcatttcaaagttgctaccagtgtatgcagtaattagaacnaagaagaaacattcagtagaacattttattgcctagttgacaacattgcttgaatgctggtggttcctatccctttgacactacacaattttctaatatgtgttaatgctatgtgaccaaaacgccctgattcctagtgcccaaaggttcaacttaatgtatatacctgtaaacccatgcatttgtgctttttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataannnttntttcnaaatttccaagaaaaaaaaaaa

SEQ ID NO: 700968 - DNA, 1119 bp, Homo sapiens
  misc_feature (1)..(1): n is a, c, g, or t
  misc_feature (100)..(100): n is a, c, g, or t
  misc_feature (312)..(312): n is a, c, g, or t
  misc_feature (332)..(332): n is a, c, g, or t
  misc_feature (347)..(347): n is a, c, g, or t
  misc_feature (396)..(396): n is a, c, g, or t
  misc_feature (402)..(402): n is a, c, g, or t
  misc_feature (412)..(412): n is a, c, g, or t
  misc_feature (417)..(418): n is a, c, g, or t
  misc_feature (421)..(421): n is a, c, g, or t
  misc_feature (451)..(451): n is a, c, g, or t
  misc_feature (459)..(459): n is a, c, g, or t
  misc_feature (463)..(463): n is a, c, g, or t
  misc_feature (467)..(467): n is a, c, g, or t
  misc_feature (483)..(483): n is a, c, g, or t
  misc_feature (498)..(498): n is a, c, g, or t
  misc_feature (500)..(500): n is a, c, g, or t
  misc_feature (504)..(504): n is a, c, g, or t
  misc_feature (520)..(520): n is a, c, g, or t
  misc_feature (523)..(523): n is a, c, g, or t
  misc_feature (525)..(525): n is a, c, g, or t
  misc_feature (546)..(546): n is a, c, g, or t
  misc_feature (553)..(553): n is a, c, g, or t
  misc_feature (555)..(555): n is a, c, g, or t
  misc_feature (564)..(564): n is a, c, g, or t
  misc_feature (570)..(570): n is a, c, g, or t
  misc_feature (574)..(574): n is a, c, g, or t
  misc_feature (578)..(578): n is a, c, g, or t
  misc_feature (584)..(584): n is a, c, g, or t
  misc_feature (591)..(591): n is a, c, g, or t
  misc_feature (593)..(593): n is a, c, g, or t
  misc_feature (596)..(598): n is a, c, g, or t
  misc_feature (616)..(619): n is a, c, g, or t
  misc_feature (626)..(626): n is a, c, g, or t
  misc_feature (634)..(634): n is a, c, g, or t
  misc_feature (642)..(642): n is a, c, g, or t
  misc_feature (646)..(647): n is a, c, g, or t
  misc_feature (663)..(663): n is a, c, g, or t
  misc_feature (669)..(670): n is a, c, g, or t
  misc_feature (674)..(675): n is a, c, g, or t
  misc_feature (1087)..(1089): n is a, c, g, or t
  misc_feature (1092)..(1092): n is a, c, g, or t
  misc_feature (1097)..(1097): n is a, c, g, or t
ngtatgcaattcgcaagaaatcgcagggaattgttgataataaggaatatgcggttaatgaagttgtggcaggaataaaagaataattcaatgtgatgtnggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgattttcccttaaaaattatctnggcgaaaagaaattcttgcnatcttcttcttttanctgcccagtggatttacaaaaggtgggctttcttgcttgaagtcacccncccgcnaaaagcgccntgtgnngcngtcttacaagaacgagcctccccccatttnttgtcccntgtnatcntgtaaaaccacttttncgctcctctcgcccntncccngctcacacacaccgcngtncnttaaaactcgttaatgtctcnccgggcntntgttcccgnttgttncccncccngttttnccccgcncntcnnnggggctgctcacgccccnnnnccccttnccaagttnccccccgngtcnnccgtaattcgcccccncgccgnncccnnccgtagaacattttattgcctagttgacaacattgcttgaatgctggtggttcctatccctttgacactacacaattttctaatatgtgttaatgctatgtgaccaaaacgccctgattcctagtgcccaaaggttcaacttaatgtatatacctgtaaacccatgcatttgtgctttttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataannnttntttcnaaatttccaagaaaaaaaaaaa

SEQ ID NO: 700969 - DNA, 274 bp, Homo sapiens
ataaagtcggagcaacgcgatttcgtcgcttagggcgccaggtcaacagggcatgcttttaactcatgttgaagatgtatatagtatttatcaatgagtcccttcattgatctcaaatacatagtttatatattccaatataattccacccatggcaaattccatggcaccgtctaggatgagaacggtaaacttgtcatcaatggaaatcgcatcaccatcttccaggagcgagatccctccataatcacgtggggcgatgcttgcgctgact

SEQ ID NO: 700970 - DNA, 157 bp, Homo sapiens
  misc_feature (46)..(46): n is a, c, g, or t
ctcagggtaatcgccccttccttcaatgcaggatggagcactgagnaagcaagatgttggctaccagaaatggagtttcaaaaatggggttgggggctctattggacaataaaaacatataatgctatctgccaaattaagaaaaagagagaaagac

SEQ ID NO: 700971 - DNA, 301 bp, Homo sapiens
ttagattcatatctggtctgtcatgactgctcagaaaacaaaataaatgaagtgctctacgaagatgggcattatctactctaagcagacacttctctatgcacaatcatttcacctatttcatatttaggataaccactgccttattttatttttaaatcaatttgaatggctacaaatgctattccttatatttaatgcaaaattctgactgccctgtgtgctattctcttctactaatatcaccttacagaatgacaaagagaaaaatttcactccctttacaccttttttttttttt

SEQ ID NO: 700972 - DNA, 357 bp, Homo sapiens
agtctgagatttcaggagactccaactacagaggtttagagataaattagcactaggtggctcatcacgcctgtaatcccagcactttgggaggccgaggcgggcggatcatgaggtcaggagatcgagcccaacatggtgaaaccccgtctctactaaaaatacaaaaaaaattagccgggcgtggtggcgggcacctgtagtcccagctacttgggaggctgaggcaggagaatggcgtgaacccgggaggcagagcttgcagtgagccgagatcggccactgcactccagcctgggcgacagagcaagactctgcctcaaaacaacaacaacaacaacaacaacaaaaaaaaaa

SEQ ID NO: 700973 - DNA, 654 bp, Homo sapiens
cccttgccaactctgcctcttcccccgtctgactggtggtatcagtttatgcgttgccctgcaggaagaccctcttgttcctgtgtggtgggaaggtatctggaatctcagtttgccctctctggagtttgagtgagacatagtgcttttggatggacaaggctttgcaggagtggttcatggatgtgagtgtggtgggatgatttctgacggtgctgtgtgcggtgaatggagcaaatcagaaccaccccttggacgttgatctcaatgcttggctccagaactgtgctttttgaagtgttggagccttctgacatgcagactgttggagcatgctgtgtcatgtggatgtgccattcgtggctcagacacagtcaaccgcaggcccgagactcgagacttggtgtgaatgcaagacatgggtgcttggacatgtgccatgtgatgagcctgtcggacagtgatcctgagatgtgggagttgctgcagagcggagaaggacagtgcaagtgtctgtggcctggagctcatttgcctcagagatactatgggggagcacgaggtgtgtggatgaaatttgagctgctgtgccagcgccgggccttggaagcctttggaccttggatccatgcacagtggggagtcaatgtccag

SEQ ID NO: 700974 - DNA, 591 bp, Homo sapiens
gacgctctctctggtggggagtgccctgtctgggctgggttaactccaaaaagcacctcacctgtgcaggccagggcgccttgggttctgcgcccccaccgctggggacccggtcctgtggatgggaggaggccgtgtatttatggaaacacttaatccctcaccagccccaaggaggctgaaagctcaccacctaatctcgtctccctggaagcgccttcgcgggccggtggggtgcaccccagacccacgtagagtgtatttccccagcccaaggtgcaggtcacctctggagacttgaaatgggagcgtgccgtcagtggacactgaagaagagcgcactgatagttcatgcttacggagcactcctcatgcaccagaccctgcgttttctgttttaatcccctgaccaactctccaaccaaatactgtcagccccattttaaagatgaggaaacagggccaggcacagtggctcacgcctgtggctgcaatactttgggatgccaaagcaggaggctgaggcaggagaatcacttgaacctgggagcggaggtgcagtgagacgaggatggtgccctgcatccagcc

SEQ ID NO: 700975 - DNA, 682 bp, Homo sapiens
  misc_feature (189)..(189): n is a, c, g, or t
ttgggaaaccgtttagcccggttctttttgtgttgaaggccccttccccccaggttaaaatgggctgggttttcgaggctttttttttagcctttgggggagaccctatcccattccctggggaaaaccccagcccttttgtccccagggggggtgttcctctttttttcaggcaggggcccccccccnccgggggggttttcctttccctggagaaaaaaagttcccccggggggggttttcccccgttttccccccccccccccaggggttggggtttgggggggggcccccccccaattttttttgggggggttttcctttttttaaaaagggtggggtttttttttccccccccctcccccctttggggttttttggggggggtgaaaaattccccccggggggctccaaaaaaaaaccccttccccccccccaattgggggccccccccttcccttttgggggggggggggttttttgggggggggtttaaaaccccccccccccctttttttgcgcggggaaaaccccttttgggcccgcccagggggtttttcccccgtttttttaacccttttttgggggttttcccccccccccgggggccggggtttttttggggaaactgggttttatccctttttcccccccggttttttaagggggggtggggccttta

SEQ ID NO: 700976 - DNA, 360 bp, Homo sapiens
tgagatggtgcactgtattctagcctagggagagagccagacgcgtttacaaaaaaaagaagcagcagcacgtctggatgtgtctccttactaggctcattccaagcctggggccacctgccttcactccccatgaagcctcgagtcccctcccactcatgctagcccttagggtctatggtttgggataaccaagggcttcactctagattcatagcctggctccaggttcacaacctgacactgccactttcaagctgtgtaactctgggcacgctgtttaacacctctgagcctcagcttgctcaaccactgtgaaggtgaacagtttatgggaaagtgccaccctctgcagcagtc

SEQ ID NO: 700977 - DNA, 406 bp, Homo sapiens
cacgaggcctcgtgccgtccatgaatttccgtagccatctcgcatccgttacgaagcgcgatcgcgccctcgtgctcacactcgcagccgccgagctgctggtcagaagtggcgaacgcgtgggccttctgggcctcacacagccgacttcgagccggcgcgccgcgacccgcatcgcggaagccatcgcctcgaattcggacgcaccgcaactcgcctccggcaaaccgtcgaacgcgcgcgtgagccgcttctcggggctcattctcgcgagcgatttccttgatccaatcgagaccatccgcgaaagcgtcgaggtactggccgcgaacggcgcgacgggtcacatgatccaggtgctcgatcccgccgaggagaccctgccttacgaaggacgcaccgagtt

SEQ ID NO: 700978 - DNA, 415 bp, Homo sapiens
ctacgacatcttcagctcttgggacattggccttctcaacaaacatggtcagaaacatggtcaaatttatggtccctgggccttcatccatcatgagcatcaaggtatgccctagtggcattctcccatatataagcatgcatatcacgcaaatgttccatgtcgataaatccatctctgttcgcatcagtcatgttgaaggcctatatgaactccggaacctgtgtctggtcaaacatggctatcacattggatgttgcccattcagaacgcatgatggaggtcttgatctacgcccttatgctcgacatggaggttgtttaattcccacgccaaacaacagaatcaaggtcgccctgcgcgaggtcacaaaccacagcaaagagcgttagactgtgcgagcacagtggcggcg

SEQ ID NO: 700979 - DNA, 439 bp, Homo sapiens
attcggtgagaagatacactcgagatctagattctattgactacgctctcttcaagctactgataacggtagtaatagatacacactaaaactaattcaagatttccactgtcttggcgatatagctgaaggtttcattgatgattacataaaactcttaaaacaatgctatgaagcaaacactgtaactgcaattttcagcatgaggaatcagaggctcagagaagttaagaatcttgtgcaagacatttataactgttaagtcttacattacaaaagaagaaacatctcaaatcaacaacctaatttgcaacttcatggtacaggagaaaaacaaactaaacccaaatatattgaatgaaggaagtaataaggattagagtggatattactgaaatggagaatggaccaacaatagaggaaatcaatgaaaccaaaa

SEQ ID NO: 700980 - DNA, 174 bp, Homo sapiens
gaagaatgcatgagactctggtccgcaagtgctcagatgtcatcctgcctgactgtggagccattaagaagcacgagtccagcaagtctgatgttactgtgaggtgtgtgaatcctgggtgaaggaggtgaccaagctgattgacaacaacaagactgagaaagaaatactcga

SEQ ID NO: 700981 - DNA, 350 bp, Homo sapiens
gtcgacctctcctctatacacagtatatatgcttaacacacagtttctagtcatgtgtgacgtggcttgtcaagagaaccaatgaattacatttgggttgtgcacgtaaagcaaggtgattgcagagctgggtgcttagttcccccagtgttgggctgctgatagttggactgccgatgttagatagtgaaatgtagtgatgtcaggtggaatgggtttaatgtttctctgttgccacaatagtaaatatgtatgacgtggtgttatgcaggacttgtttgtgaatcattttaacataatattcattcacataatactgtcctttttatgttttctgggttccttctatg

SEQ ID NO: 700982 - DNA, 803 bp, Homo sapiens
  misc_feature (14)..(14): n is a, c, g, or t
  misc_feature (83)..(83): n is a, c, g, or t
  misc_feature (86)..(86): n is a, c, g, or t
  misc_feature (132)..(132): n is a, c, g, or t
  misc_feature (147)..(147): n is a, c, g, or t
  misc_feature (150)..(150): n is a, c, g, or t
  misc_feature (159)..(159): n is a, c, g, or t
  misc_feature (163)..(164): n is a, c, g, or t
  misc_feature (170)..(171): n is a, c, g, or t
  misc_feature (173)..(173): n is a, c, g, or t
  misc_feature (176)..(176): n is a, c, g, or t
  misc_feature (180)..(180): n is a, c, g, or t
  misc_feature (189)..(189): n is a, c, g, or t
  misc_feature (196)..(197): n is a, c, g, or t
  misc_feature (199)..(199): n is a, c, g, or t
  misc_feature (202)..(202): n is a, c, g, or t
  misc_feature (208)..(209): n is a, c, g, or t
  misc_feature (215)..(215): n is a, c, g, or t
  misc_feature (259)..(259): n is a, c, g, or t
  misc_feature (261)..(261): n is a, c, g, or t
  misc_feature (274)..(274): n is a, c, g, or t
  misc_feature (286)..(286): n is a, c, g, or t
  misc_feature (296)..(296): n is a, c, g, or t
  misc_feature (312)..(312): n is a, c, g, or t
  misc_feature (318)..(319): n is a, c, g, or t
  misc_feature (326)..(327): n is a, c, g, or t
  misc_feature (334)..(334): n is a, c, g, or t
  misc_feature (400)..(400): n is a, c, g, or t
  misc_feature (409)..(409): n is a, c, g, or t
  misc_feature (416)..(416): n is a, c, g, or t
  misc_feature (425)..(425): n is a, c, g, or t
  misc_feature (434)..(434): n is a, c, g, or t
  misc_feature (469)..(469): n is a, c, g, or t
  misc_feature (486)..(486): n is a, c, g, or t
  misc_feature (711)..(711): n is a, c, g, or t
  misc_feature (743)..(743): n is a, c, g, or t
accaatcaaatggngatgcatcagatcccaattctcatgagtgttaacatattaagagagtacattatttacctaagactgantgnctgtgccttactttataaaaaaacaaagatagccacatcaatttanttccatatatatganacnacctattcncttnnctaaanntngtnatanacataatantcaaacnngngcnccagannggtgcngttcacatgggaggggccacagaagggggggtggtagggggggngngttggggtggggngtacaaattcgntctataaagntggggatatagaaggncaaatnnagttgtnnaaaaganaattcactgtacacattttatttacagttttgtacactgtcttaatatgaatgggactgcgtttcnacttgagcnatttttnaccaaagcnaaataaccnaagtgatacaaagtgttaaaatacagcataaaganacaaaaacagacatacnaattcgagttagggatgtgattatgagtgttacattttttataatccacaattatgtttaggaaatcacacaaacatagatcactgatttgaatgaaatgcataaatttgtagcaaagctttgtagttacaaaaaacaaaaaaaattaccaaagaatgcacaaaattaatgtttattccacctttgtgtcatattcctggatccttcaccaatgttacatgaggnaaaaaacaaaagcaaaacaaatgaaaaactgnaatcagaatcactaatattatcaagtaggggaacaaataaattaaaatctagcagccatc

SEQ ID NO: 700983 - DNA, 226 bp, Homo sapiens
tctctcaagatagtacagtgcaatctgtgggtcccttgagattcaatatgactataaagatgctatcaactactactgcatacaatcgctgcaggaataatgataggacgtgcatttaattcatagactctactttaaattgtatggacatttctacaattttaagtcttttattcatgagcatctggcctatctcttccatttctttgtgtcttgcatttctttg

SEQ ID NO: 700984 - DNA, 688 bp, Homo sapiens
ggagaacgacgctcgatcagagctgctggggcaatactccgcctgctgggtcgggcggctgtatcggcgagcgaccgagttcccgcgacttctcggtggcgctccccctatcctttcagttctccacggaactggcccctcgttcttctacttgaccgctcccgtcttctgccgccttctgtcgctctcccgttgggccgattcccgcccgtcttcctcctggcttcccatcgaaggctctagaaatgaatgtttccgtctcttcagagatgaaccagattatgatgcatcattatcacagaagaaatgcgtgtctatagcttttaaggaacttgattacatcattctctcaagcctgatagttttggcactcaccattagagcttaagacacacctgccttcatttcaatccacctgtcttcataccctgacgaagtgcaccttttaacactcctttgtccttggattacttaagagttcccagaaatacattgccacaacagagtagtcaaatttataccggaaaaatgattcccagtggctatttgatgtttgaggatgaaaattttattgagtctctgtgtgtcaaatttaatgcctgaggacaagtggcagttctgtgatgttcgacttcaggtctgtggcatgagatgttagcacacagagcagtgtagcttggtgcagtcc

SEQ ID NO: 700985 - DNA, 179 bp, Homo sapiens
catagtatacaacagacactagggcttagaaactctttatgcagatccacaggtattatgtaggtaatggcgatatgttctcttgaatctcctcagtagacaacctttcgatttcaactttatttttttttttttcccttaaaattgagtcgggctctgtggcccaggcgggattgcag

SEQ ID NO: 700986 - DNA, 625 bp, Homo sapiens
ggtttgttaagcatgtcaaggcttttgcgaaactagtcaatcttagcatctctaaacaactaatcccagttccaagcaaactatataagctgtccgattataaaggcacctccaacgattttgcaatgcaccaatatcctcactatacaacagctcactaatcattctatactataatctaactaccttcctgtgtctcctattctcataatcctacattccctgtcacacaacataccttatcaaacttctccaatgactattaatttcattacattcattacatataaatactaccaattcaaaacacttaaaccaaaacattttatacactattatactgttaactcaaatctactacatttacaccctttaccacattttatcactatcatatcatattgccatttaactccaatacatctacattaaacctcaacttttctacatcatcctatttatcataagacaatatcattttacaatatatttttaccctattatccaattattaacttacactatattcaatctttttaaacatatttctcctttattacatttttttaaactaactaatttattatcttcatttttatatatattatctaaagatctaatctct

SEQ ID NO: 700987 - DNA, 322 bp, Homo sapiens
gagatggagtctcactgtcacccaggctggagtacagtgttgcgatctcaactcactgcaacctccaccttctgagttcatgcgattctcctgccacagcctcctgagtagctgggactacagacacccgccaccacgccaggctaatttttgtatttttagtagagacagggtttcaccaccttggccaggctggtctcaaactcctgaccttgtgatccgcccacctcagcctcccaaagttctgggattacaggcgtgagccactgcgcccagcccaggcttaaaagtttttaaggtattagtcttcaatgccacaaag

SEQ ID NO: 700988 - DNA, 1174 bp, Homo sapiens
cgacggcctcacaggccgcacctgcgcgacactggactctcagcccagcgcctgggcataacgcctggcctaggagccgcgcaggtactcgagcagctgggcgccacagggatccgcagtgctcctgcgcccacgcgacacccgcaggagagcccaaggcccgctcgaggccggacgcatctcacagcctgcatcctctcgcaaacgcacgcctcaccggcccagaagcaacaccaagcgcccatgcgccagactcccatgccactagaccccacacggccacaacacgcgcctgggcccacccggaccaccgacgcgcccacgcacccgggcatcaacaccccgcctcgcgcacgacacccgccacgcccccacccctgcccacaacaacacccccgccgcacacactccacactccacccacaccacagcggcacaaacgcactgggaccccccaccacagccaccacaccaacaccggtagaccccagctcactcccgcgccccagcacatgccccacaccacgcgcacaccacccaccactcacccgccacaacccaccacaaactcccctgggacacccccaccagctggccacaccacggcccgacacatagccccactcgcccgccaccccgccacccacagcactcaccgcctccacagcacgcaacacacaccgcaaacaacacgacccaacacggacaatacccggcgcatgctacacaccccaaccaccttggcccccacccccacctagccccctcccgcgcaccccccagacagcacctccaggcagccacaactagcacccgccacaacctaaggtcgcgacccgacccagacacccggcgccacgcggaaccgacgaatcatccccaccaacaacaagggccacaccaacccccccgccgccaactcacaccacgacaggccaacccaaacaccccaaccaatacacgcctcagtcctcgcaaacccccggaacgccccccgacacccccgccgcccccagacaccgccgaccagggcactgcgccccgcaccccgcaaaccacccacacgccgaccgacccgattccccacacgccaccaccagcaccaacacaagacccaacaacaccgaaacaccatccacaccccgcccgcacaccacccccaccacgggacgta

SEQ ID NO: 700989 - DNA, 199 bp, Homo sapiens
ctgcatctttgctgaggtactcttcactgtttctgattcttatttctaagtaataagcatgtactgccatctctttttttttgagatgaactctcactctgttgtccaggctggagtgcagttgtacaatctcagctcactgcaacctctgtctcccaggttcaagtgattctcctgccctagcctccctaatagctgg

SEQ ID NO: 700990 - DNA, 250 bp, Homo sapiens
  misc_feature (21)..(21): n is a, c, g, or t
  misc_feature (150)..(151): n is a, c, g, or t
  misc_feature (173)..(173): n is a, c, g, or t
  misc_feature (178)..(178): n is a, c, g, or t
atcgacagtatccaaatgccnccagagacatccattacaatgagtacttaaatgtgtccatagatctggcaattaggaggtcattggaagccagagcccagtgggtagtaaagtaaaatgctgatgggcaaagtagagaagtttaagccnnaaaagtttggatttaaaggtanggaantggtaataaatgagcatgttatcatgggatcaaacttgaaagaggtcatgttatacagtggtgaacgacatg

SEQ ID NO: 700991 - DNA, 705 bp, Homo sapiens
  misc_feature (526)..(526): n is a, c, g, or t
  misc_feature (636)..(636): n is a, c, g, or t
  misc_feature (652)..(652): n is a, c, g, or t
atgtctacaagacgctacgtgtcccctatcatagaatgagcttgtcaccgttactactgatcacaagtcccgcataatcattgttgcacatgtatctggcttccatatgatcctgtgtatgcccttatgtccggagatgtgtctagaaaacaaaaacttagattatctaccattaatcactcctacgaggaacagcttgcaggcaacatagaaatccgcgttgtagaacctatccgtggtggccgcgctatgcatccgtaggtcgctcaattcgggccctcctcgatccctagcgctgtcctttacagtagacgagacgcacggtcaccgatcccatcccattaccagtcaaaatcaatttggcgcaccagatggggtactgaaccatacgaagtacaccaggactacgtgcgggagctaatcgttccaacgtccgtagcatagcttaccccgcgagttattccgtagtaaccagggcagactgcggactccgttggacgttgacggatcgagttagtactcccgnattgaagcccccattcgtataataattacatcacaagacgtcttgcactcatgagctgtccccacattaggcttaaaaacagatgcaattcccggacgtctaaaccaaanccagtttttcaccggntacacgaccgggggtatactacggtcaatgctctgaaatctgtggagcaaaca

SEQ ID NO: 700992 - DNA, 215 bp, Homo sapiens
agtttctgaagctggattgtaaagttggctgattggtgaacaatcgtggcacccatcctggcacctggtgaccctcattacctgctgcctggtgacccgctgggggaatgaaaacacatattactgtctacacagtgttgtcatgagtggtggggtgcccagaagccccccagagcctccagaactgtgataaatacttttctgttgtttcaaaa

SEQ ID NO: 700993 - DNA, 143 bp, Homo sapiens
  misc_feature (74)..(74): n is a, c, g, or t
  misc_feature (100)..(100): n is a, c, g, or t
gatcttattaacactgaagtacggggaggaggcatgatgctggacacactgtcaaagtcaatcttctccacaangttcttgggtttaatgctctcttctnggctacagatgaagatctgccccgactcgtcggcactccaccc

SEQ ID NO: 700994 - DNA, 413 bp, Homo sapiens
  misc_feature (359)..(359): n is a, c, g, or t
  misc_feature (364)..(364): n is a, c, g, or t
  misc_feature (389)..(389): n is a, c, g, or t
  misc_feature (400)..(400): n is a, c, g, or t
gcaacccgaaaacagaaatgctatataggaggagaaaaggctttcaacaaagcattgtcattagggttcggttaaatatgcatgcatttgaaatatacattgacttaaatgcaaatagtcaggctgaagctctgctgtaaagtaaaggtacacccacaaaaggacagagccttttctggagaccagcagaaatgtggttgtatttatattagtggggacagaaattatgatcgctctggggccgctgcagcctttctgctgacaagttgcatgccactgttccgtagtgactgttctttacctgggaacggcttctccatgggcaaccccaacccctttcacaggggcggcattcgttngcttnttctcttttttaaaatggaacacantggggaaggangtgggattatgtg

SEQ ID NO: 700995 - DNA, 890 bp, Homo sapiens
gtcgtgcccagtgctcagaggttccacggtcaatctgtgctctgggaaccacatcgccttcgggctgaacccccggtatttgatgagaatgctgtggtccgacaagcacccagagtcgcatgaactcctgggggtctgaggagcgaagatctgccccgaaaaatgcccgttcgctccgtgggccatggatgcttgctcagtgtagggatcttgtgtgaatgctcacgtgacctgcaaggatgggccgttgggatgtgtactagcgaccattgtttgataatacgtactcatacggcgcgtgatggaacctggcccgacgcattcagatcagactaggcaagatgaggaggtgcgacattccagctgacccagtgtgtcatgacctgtatggcggcattccatggtcccctgggcgctcgggggctggtggtgtggggcagctcggggtccgtctcattcatccccacttcgcaggcccatgccttgtccatatcctgcctgggatctgggcctttaatgcaagaggccatgtacctatgctacgttgggtccatggcttcctaggcctacgagcacagcactggtgaacggagcaaggcatgcatgatcggggcatttgccattccttcaggccgtaggcagcaccgtggggctccagcctgctggagatcctaccatccccagggaggccagggcacagccagggagaaggggaggaacgtagggccggagacagacgggaacggccccgatggcgtacagggccccttgcgcaaattagaacatacgcgagcttcgaaaccacagaccacagggcaaacccaacatagcatggaccaaggatacgaggagtgaaatccctcagaccctcggccaacgcacctaccaca

SEQ ID NO: 700996 - DNA, 155 bp, Homo sapiens
  misc_feature (143)..(143): n is a, c, g, or t
tcgagctcggtacctcccatcagtctgtggaatactggaacagaaagactggctaactacaccggaggcatctatgccgaataccaggacaccacatatataaaccatgtcgtttccgtggctgggtggggcatcactgatgngagcaagatgcg

SEQ ID NO: 700997 - DNA, 893 bp, Homo sapiens
  misc_feature (5)..(5): n is a, c, g, or t
  misc_feature (533)..(533): n is a, c, g, or t
  misc_feature (665)..(665): n is a, c, g, or t
cctcnaggtgactaatacagaggactgcccacgtggactgtggacatactacatggagcatggaggtgataagaccatttcttcaggaatgaccagaatagcataaaagatcaatggaagcattgccaaaaaaggaagactgaaatctcaacctttcagggagtaatttatcatttggatgagcctaatgagaaaagcagtgcagtgaatgatgtgacaatatgaaacaacataatagtgaatgattaacgagtgacaaattgagagggaaaaaaaaggataacgctttcattatggtacaaaagagaatttgacaaactcatccaagaaagcaaccactttttcctccgtcttagttgaacgccttgaaaaacgaacaatcatactgctttcaaggaatttcataagagtaaaatagttaaacttctatagaatttcaataattaagggttacaaatatatttaaaggattttgaagctttaataatcaaaactttataaaaattatgctgcgattattcagggcaaatcanaatgagaaaaaaccgtggcattctgataagtataaaagttataaaataaaacatattatttgttacaaatgacaatttaatgaaatatagttttgcattgaatctagctaggaaattctagatcatatgttntatgaaattgatttgattgcctgacatcaatttattagctgtcatgaattaaattcttgcactgctttttctactatgaagctgggaaatattctaagtttctaaggtcctaaattcatttgcctctattctactggactacaccttttctgccaaatattgggaaaatatgagctaatttggaacgaacaaaaataaagctagtcctggccagacccacttccctgg

SEQ ID NO: 700998 - DNA, 430 bp, Homo sapiens
ttctacaatgaatacaaatggttgtccaaatcaatgtatgaatggtaataccaaataaaatatgggtaaccatttcaaggcatggtattaacgctaacatgatgtccatctaacatccagtatctgaaaatctgaaatcagaacacaggaccttttcatttcgaatttacattaaagtttcagcgccctgattaaccatttccctcaataaaattacatttttcataccttaattgtgcaaaagctgcaaactggtaaaaaaccttgaatgcccatggcatgattattcacaaataactggtacaccctatacctgaaacctgagtgcctactataaacctaccaaaatgattacaatgacaacccatcatcttcatcacatgaatcactgcaatgtgaacagtattctgctgagcacaacacagtaatc

SEQ ID NO: 700999 - DNA, 200 bp, Homo sapiens
tgaactaccgcaggaacataccaggaaagccaagagaatccacagacctttgaaggaattggatcaccgccacaggctccccgagatggcaaaaaacttttgccgggaggactcatatcactctgtcgtctcatgtgccgcagtagttcttactcctatggaaccaatgatagtgaaggagaagaaccagtttcctggct

SEQ ID NO: 701000 - DNA, 1683 bp, Homo sapiens
  misc_feature (1233)..(1233): n is a, c, g, or t
gccggatctacggtatcacctacgagatgtctagcagcaccctccgagttacctactgcctaggcgatgagacccagaagggctaggaaggttcaccactgtctattctcgaagatccatgcgcagggcagatcgtttgacgtctcgcgtggaatccgcacgtgattgatggtatgatctctgtcacgcgtacacaaagggtactcgtgtcaggagccttgctagttgctccaagttaggatgcatatcacaacttgtgctatctaatgatgggctcctaggaagactcctggaggaacgaattgcataacagatcgtcggctcattattgtgtgggaatgtggtcgtcttgcgaaccagtgccttggtgggaaggcgaccaataccaacgtagaaccactccttactctggcgcccatagaccccttggggtatcacgcccaaatgaccacactggataccggtacaaccaggcaaccagcaggaggacacgcatgtgggtaacagaaaccgtgtgattgcaatacagcaggcagtcgaggcactcgcggaacaactcagcacaaaatagttacacaactccttaagagggctcttaggggcttgcgcggaaaacctgacacaattctcccttgtgtggggcgcttgctcccgcgtactgatcccgcgctgcctctgcgccgaccaggcctgggggctcggccccagtatagatggatcgatacaagggagatgagctttccacacggcggtagagtaaatcccgtggcgcccaatcggaggttctcggtaaatggaccactagtggtggccatatgcggctctaacacctacctattaggaaattagatacaaaataaccctattggttctcgtcatggtattcacacacggtgatgctcgaataatccaaaagttggggatatctcaacttccacacattgttggcggcacgccggctactacgataccaacctggggcggcttgggaccacataacgcacaacactggaccagtgcgggccccccaacactcggccaacgacgatgaagcgcctactcacgaagtggggagatcaccacgattacacccccaagaggaacaacggtgggagtgaccacagagccacgagaacaccgattctcccatgccgcgggaacgaccgaacccacaatgtgcacccgcccaacgtacggtggcgacaacgggccacaggacacaggggacacatncaaccgcacaacaacacacaaacccagatgccaacaccgacaacgacgtggccccgcacttcaccacacagagcgaacgggacaacacactaagttgcgggggcaacaacgggcaaatagaccccacacccaacaactggacaagcacaaacgaaacatgaacaacgtgaacggaagaccaacaacgggcctaccaccaacaaggacaaacccagtaggcacacaaacacataacacacaaacacagagccaaggggatacgacacagccgccgcgacaacacacacctggacccgacaacggcgcaacagaacacatgcacacaaacacccagcacacaacaagcgagctgacaacaacataggcacaacgtaggcacaggcataaaccagccgaccagcacctacgaacagacacaccactaacagccgcaaccttgatgcaaccaca

SEQ ID NO: 701001 - DNA, 328 bp, Homo sapiens
tgtgtggcgttctagaggatccctgcatggtcgcaggaggaggcatcttctccaatctgagagtccaggatgcatgccccagccaggtggcaaccggctcaatgggacacaggaaatggggcccgtgggtatgactgagaactgcaataggaaagattttctgacctgtcatcgggggaccaccattatgacacacggaaacttggctcaagaacccactgatgggaccacatcgaataccgagatgtgcgaggtggggcaggtgtgtcaggagacgctgctgctcctagatgtaggactcacatcaaccctgcctgcgaacctatga

SEQ ID NO: 701002 - DNA, 341 bp, Homo sapiens
tgccatactacatgttcttggcttctgcaatagaatctagtctgatcttcattggtgtctccctttcttatgacccaagtggcttttgcaggagtgcaggacttagtgctgatcatcacacagtataccactttctttatagaaccgctaccaaattctgagtggagatcgtggctttagcccgtttgtaactttttttgctcaaatcaataacactggcccattatctgtccagcagaacccattgtgaaatagtacacggtgaacagcccttcactgattacaggcaagtgttacagtagcctagccataaggaaggggagttacatcatagtacaaaa

SEQ ID NO: 701003 - DNA, 253 bp, Homo sapiens
  misc_feature (13)..(13): n is a, c, g, or t
  misc_feature (22)..(22): n is a, c, g, or t
  misc_feature (57)..(57): n is a, c, g, or t
  misc_feature (116)..(116): n is a, c, g, or t
  misc_feature (121)..(121): n is a, c, g, or t
  misc_feature (187)..(187): n is a, c, g, or t
  misc_feature (206)..(206): n is a, c, g, or t
  misc_feature (219)..(219): n is a, c, g, or t
gtaaaattaatanaaatgtcancaatattgtttcaaacccaaaaagcaattttctcntttttttttttgagacggagtcttgctctgtcatccaggctggagtgcagtggaatgancttgntcaccgcaacctctgcctcccaggttcaagtgactctcctgctgcagcctcctgagtagctgggantacagcatgcaccaccatncctggctaatttntgtattttagtagagacgggtttcaccatgttgt

SEQ ID NO: 701004 - DNA, 125 bp, Homo sapiens
gaagaggaggaaggattagaagatattgacgaagaacgggatgaggatgaaggtgaagaagatgaagatgattatgaaagggatgaaggagaggaagacgaacgaaaagatgacttaatagaaca

SEQ ID NO: 701005 - DNA, 270 bp, Homo sapiens
cagtagagctcattgaggaatagatgttatgaattacgtgttggcctaacgctatgcgtggctcacatctgtaatctcagcacttctgggaggctgagagtgggtcgatcacctgaggtcaggaacttcgagactagcctggccaacatggtgtatcttttgtattttctttttttttttggaaacgaaataaacctctaatagcccaggcggcagtacctctttttgcccaggctgtattatctcttatgcccagccagaattgggaac

SEQ ID NO: 701006 - DNA, 322 bp, Homo sapiens
cctggctcttccctatcttactaaaatatacacaagttagccagggcacggtgtgtgcacaccctgttatcccagctactcaggaggctgaggcgcgagaattgctcgagccctgggaggcggaggttgcagttagatgagatcacaccactgcactccagcctgggtgacagagctagactctgtcctataaggtggttgttattattagttccattttacaataaatatcataaatatcagagatatttagtacctctgtgagttcacagagctagtgggtggggtgaccagaactgggggttgtgtcctcgattgcctc

SEQ ID NO: 701007 - DNA, 552 bp, Homo sapiens
catcacagcaataagcagcaatccatttgtgtcaatgaactttttcgaggcgtatccgacttgcggaacgtgtgggttgtgctgggccttgacaaaccgttccagtgtagctgtcctttctcgaagacgcgatcgttctgtaccgtcaggcatggcactcaacacacggttctgtagaatccttcctctgtaagaaacaaggcggcatccaggaactgctgtattctggcccctggtctccgtgactaagcggggggaacctgctccgtgacgtttgaaccagtggggaagccatgtggtccacgccattcggcagttttgttccccgaagaacttcgtcactatagatgttgggagtttttagtctcagtaaatctgaagcaagagaaggcagcctccagggcactggtgttttctttgcagaaggtgataatccatgagtgtctgaggcccgtcccagtctgtgcggtgcggaggagagagcacctgcccctccacccgatgctttgtcctccttctcattcctgggaaggaaatcctgggagctactca

SEQ ID NO: 701008 - DNA, 247 bp, Homo sapiens
  misc_feature (72)..(72): n is a, c, g, or t
  misc_feature (213)..(213): n is a, c, g, or t
aaggatgggggtgataagagcatcctttgtcactagtcctcccaggaccccacgttagactttagacatctnctcactcacctcagaccttctcagggtaatttggagaaaatgtcttccgatctgagccccagtgagcctccctgtcaacttggtgacgagggactagaccagaaaaggtcaacccgagtgtccctgatcgatgaaatgatnggcataatggagtgcgttatctgggtgtggcttt

SEQ ID NO: 701009 - DNA, 187 bp, Homo sapiens
  misc_feature (159)..(160): n is a, c, g, or t
gcatgagatcgaatcgagctccggtacccggaatctcacagcagaagtacaaatcataggtacaagtatttatatcaatgaaaatttccatgggggatttctgggcagaatatgggtctgtgactctggtggaagtaaatcgacgaccgtaaacgtagnncgtgcacaggggctgttgccgtggtag

SEQ ID NO: 701010 - DNA, 570 bp, Homo sapiens
  misc_feature (547)..(547): n is a, c, g, or t
cactccagaggtcacttttcaggctggactttattggacccttcagcagcatttcacacagctgatgcttgaaagcccactacattttgctcccaatcacatgcccctggtcctcctcctacctctagcttctcattccagtctcctttaccggctctttctcatcttcccattctcaaactattggagctgcagggctcaattgttggacatttcgcatcaattccttttgtatctacacttgttgcctttgtgacttcatccagtctcgtgggtaagatttagtccctctataagttgacgactcttaatttccaatttatctccagtttaaacatctgccctgaaatccaggtttgtgtatactgtacactgaacttacatctctatctagaggtccaataagcattttaaacttaatgttccctgccgggcatggagactcacacctgtaatcccagcactttggaggccgaggtgagcagatcacttgaggtcaggagttcgagaccagcctggccaacacggcaaaaccccgtctctaatnaaaatacaaacttagcaggcatg

SEQ ID NO: 701011 - DNA, 756 bp, Homo sapiens
  misc_feature (309)..(309): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (390)..(390): n is a, c, g, or t
  misc_feature (401)..(401): n is a, c, g, or t
  misc_feature (410)..(410): n is a, c, g, or t
  misc_feature (412)..(412): n is a, c, g, or t
  misc_feature (424)..(424): n is a, c, g, or t
  misc_feature (433)..(433): n is a, c, g, or t
  misc_feature (515)..(515): n is a, c, g, or t
  misc_feature (589)..(589): n is a, c, g, or t
  misc_feature (593)..(593): n is a, c, g, or t
  misc_feature (598)..(598): n is a, c, g, or t
  misc_feature (602)..(602): n is a, c, g, or t
  misc_feature (604)..(604): n is a, c, g, or t
  misc_feature (616)..(616): n is a, c, g, or t
  misc_feature (621)..(621): n is a, c, g, or t
  misc_feature (629)..(629): n is a, c, g, or t
  misc_feature (635)..(635): n is a, c, g, or t
  misc_feature (638)..(638): n is a, c, g, or t
  misc_feature (643)..(643): n is a, c, g, or t
  misc_feature (646)..(646): n is a, c, g, or t
  misc_feature (679)..(679): n is a, c, g, or t
  misc_feature (753)..(753): n is a, c, g, or t
atagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggtggatctgaaaatnatagaagaaaagcgaaaggtacacaaagaagcacatcagaaagcccgtgagaagtatggccatctactgtggnagnagngnttcattttcangttttttgnangtcagatcaatnacccttaangccaaaagagaaaagggaaagagttacaaatagtactttctagtgattattaaaaggtgatgttgatggttctgtttgaggncattttgaacattatagatacctatgatgcttcacacgagtgtgaactagaattagtacattttggagtgggtnaaanatgtnaaantnatgttacctttnctaanaatttaangtgtanaanatgcnttnaatgtgaatcaggaaatgttatccacgagtaanctgcaaaaaaaggagtaaaaattaaacttcacaaaataatttaccgtcttgttgaagatttgcatgaggactgngca

SEQ ID NO: 701012 - DNA, 289 bp, Homo sapiens
tccgatgaccaatgtggtgcacgtggccgggcgggagccaacacccacttctcccacaaagggcccgccacacatgctccacacacactccatccctcccacacgcacacgctgtctcgaacacattcacatatcacacatgctcaatcacacacgctcacacacaggcccacgcattcacacatgcacacaatgtcacacatgctcaatcacacatgttcatactcattcacacgcgggcccagtcacacacgcaatgtcacacattcgtcacacaatcacacacacg

SEQ ID NO: 701013 - DNA, 161 bp, Homo sapiens
ccaatttgggttagctaataagttggtcagttcaaaaaaaatttatattacgcatctactctgagccaggcattgtctcttttttgctgtgaagtatagatgctggaacaaagaacagacagccttgcatgtcataagacgtaacattctcaggggtaaga

SEQ ID NO: 701014 - DNA, 318 bp, Homo sapiens
cagggtcctcctttggatacaaaatccacagatgttcaagtccctgatataaaatgacatagtattggcatataacctacacacatcctcctgtatacttatatctctatattacttataacacctaataatgatgtaaaagctatgcaagtagttgttatactgtattattagggaataatgacaagggaaaagagtctatacatgttcagtacagatgcagctctttttcaaatattttccactggtggttgattgcatccatggatgtggaactcacagatatggagggctgattgtacttcttccttgcttgag

SEQ ID NO: 701015 - DNA, 415 bp, Homo sapiens
aggctggtcgatagagcgagcctccgtctcaaaacaaaacaaaaaacacgaaaacttcccaaggaccccttttcctataacattatcccctgtggagatgccacactaactgttagggggttttgggcgatgactctttctggctacttcctgctgaaaaggggcgtggaatgggaaacagcagctagggctccttctggggttgatccaagggtcttcggaggaatggctggcctgtccatgtgtggttcagtttatggcaccatttggagtttgattgcttctaggcgagaagaaatatttcgagtgatagtattaactatacggggtccaaatattagtacaacacgtataagcaagagagtgcttagtaaaggggttaaccaattccataaagaagtgcaggaaaccaaga

SEQ ID NO: 701016 - DNA, 1197 bp, Homo sapiens
atgatgacatatcacgaaacgcgcgcgttggctcaaagcgacttacagcaactctatgcggcacttgaaacaactgaatttggcgcttactttgcgacacccgctgatgatactttacgttttggcattggcgcaatcgctacggcaaaaacggctcaggcattacaaggtgcggttgtttttggtgcgcagtcatttgatgaacaagagtacccgcagtctgaattgatggcgggtttttggtttgtccccgaagtgatggtgaccatcgcggcagataaaatcacgttcggatcagataccgtatctgattttacgacgtggctggcgcagttcgtgccaaaacagccaaatacggtgaccactagtcatgtgacagatgaagtggattggatcgaacggacagagaatttgattgataccttagccatcgatcaaaccttagccaaagtcgtttttggtcggcaacagaccctgcagttatccgacacgttacgactggcacaaattattcgtgcgttagctgagcaggcgaatacgtatcatgtggttttaaagcgacatgatgaattgtttatttcagcaacaccggaacggttagtggctatgtcaggtggtcagatcgctacggcggcggtcgctgggacaagccggcgcgggacggatggcgctgacgatatcgcgttaggcgaagcgttgttagccagtcagaaaaaccgcattgaacatcaatatgtcgtggcaagtatcacgacacgcttgcaagacgtgacgacgtcgctaaaggtgccggccatgccaagtttactcaaaaataagcaagttcagcatttgtacacaccaattacaggggacattgcggcacatttaagtgtgaccgcgattgttgaccgcttgcatccaacaccagcactgggtggcgtcccacgtgaagcggccctgtattacattgcgacccatgagaagacacctcgtggcttgtttgcaggtcctattggctattttaccgcagataatagtggggaatttgtggttggcatccgttccatgtatgtgaatcaaacgcagcgacgagcaactttatttgctggtgccgggattgtggctgactccgatgcgcaacaagaatatgaagaaactgggttgaaatttgaacccatgcggcaattgttaaaggactacaatcatgtcgaatga

SEQ ID NO: 701017 - DNA, 409 bp, Homo sapiens
cccggtccccttctcaaggtgaatgaaccccctccgatttttttgggggcgggccagatttctttttttctccagtttccccccgggaccccgggtttggggcctgggggggctcacctaggaaaaattggggtgttccccccccaaaagaggccccctggtttttttttcggggtttccgtgaaaaaagcccatgggcacagcttttccccccccctttcccccctttttttttttggccagggcgccaaaccctgggtttttttttccccggggaagggggtcccccccccccttttttaaaagaaagaccaaaaactgggggcccccccaacccgtgggtgaaatggggccctgggggccctttccctttttttttggttttttaaaattttttgggggggtttta

SEQ ID NO: 701018 - DNA, 621 bp, Homo sapiens
  misc_feature (410)..(410): n is a, c, g, or t
ccgtccccggcctttgccccccggccaacccgccctacctggcgcgacgggaccccccttggctgtcctcccggctccaagagaagccctctgatcccctcgagtgaccctgatggatgtcgtcgaatattttactgaggctggattccccgagccggcgaccgctttcccagagccggaaattgatggccaatctttgctgctcatgcagcgcaccagatgtgctcaccggcctgtccatccgcctcgggcccagccctggaaatctacgagccacccacatccaggtgcttcagcacaggccacctttgaggatgagtgaccccgagtggcttcttatggctgatgcgccccgcctcaaccgctgcccccgcccctttccggcccccactctcacgcccagagtcccncccgaggtccacggaggctggacgggggacacccctcacgcccttcagtagacccggagttcccaaggagagggcaccctcttgtccttatctttgccccttgtgtctgtttcacacacatctgctcctcagcacgtcggtttggggaggggattgctccttaaacccccggtggctgaccctcccccccccagtcccggaccttttagga

SEQ ID NO: 701019 - DNA, 550 bp, Homo sapiens
  misc_feature (492)..(492): n is a, c, g, or t
  misc_feature (549)..(549): n is a, c, g, or t
cttgatgagacatacctcccatgcatcggtcaaatgaaatgtttgggaaattgttttataagcagaaaagctctttgcagacatgagttcttatagaggtttcagggaattttgcctctaattagatgtcaccttaccattccctgtcagtttttacttttgtttgtacatgttaaattaaatcaaatgaattagttccatcactcccttaagaaatgcatatatgtagctatttagttattttaaaaaattcctgggtctggccacgggtgtcacgcctgtaatgtgaacactttgggaggccgaggcagggggattgcctgagctcaggagttcgagaccagcctggccaacagagcggaaccccatctcttccaaaaatacaaaaaattagtcggatgtggtagtgcatgcctggagtcccagctacttgggtggccgaggcaccagaattgtttgaacccaggaggcggaggttgcagtgagtggagntcgcaccactgcactccaacctgggtgacagtgcgatactccctctctctctctctna

SEQ ID NO: 701020 - DNA, 544 bp, Homo sapiens
cgtctcgggcgggcgggaggtgcaccagcggcggcggcggcggtaaatcctcccggccgctcacagcactgtggagccgcgtcccagcccggcctcggaccgcggcacccctcctggccctcgcggcttctagcccgccgcctgcccgcggcgtcggcctgcgagccggggcggcggctctccccggaccccgacgggcgggcggacgtgcctgaggaggcggcgaggggagggcaagggaccggacggacgggcagggcgacgactgccgaactcctgagcagacccaccaacagcaccagcggaagaagcacagcagcccagccgcagggccaaacgtcacagggattcacccgcgggaacccatgccacaaatgccaggaagatgggctggcagaccaggcgagggcagaagacgaccgaccacaacaaccccaagcccctgaggcacggccacacacacgcactgatcgacccaagtggcaaacaactcgacaccgccctcgccccgtggacctacgccccatcggccgtctccgcacac

SEQ ID NO: 701021 - DNA, 143 bp, Homo sapiens
gatggctcagcgccggaggcacctcagcagccatgttgaagccccatagtgaagccgggactgtcttcattacagacccagcagtctgctcagcagaccaatggtttgacaacagttcctggaagtcacgatgttgtccggcg

SEQ ID NO: 701022 - DNA, 342 bp, Homo sapiens
tcagacggagccactctgtcacccaggctagagtgcagtggtgtgatctcggctcactgcaacctctgcctcctgggttcacgccattctcctgcctcagcctcccgagtagctgggactacaggcgcccacgacattttttgtatttgtactagagacggggtttcaccatgttagccaggttggtttcgatctcctgacctcgtgatccacccgccttggcctcccaaagtgttgggattacaggagtgagccaccgtgctcagccttgaatttcttttttaaatctctccaccctgccaggagaaaaaaaacctccctgatattctgactgagattgta

SEQ ID NO: 701023 - DNA, 120 bp, Homo sapiens
gactacataggcagctgcgctattcggtgcctggcgttggctgatttcgccgccgccgcaccacgatatctactcgatcgaagatctggcacagctgatccacgacctgaagaacgtgaa

SEQ ID NO: 701024 - DNA, 483 bp, Homo sapiens
tttgggctcattcaggatgagcgctgccgctagttaaggaggtggtgtggggtcccggtcagggggtttccaacttccgtcagggacgtgggggtcttgctggggtcagtggccaaaaggaggctcaggtcagcagggatagtgcatagggtggtcatctcagcatggataactgaccctctagcatccagtgccatgatgggttttctgggatccaggacgggtacctgcttagggctgcagaagaagggcctctgacaaaggggggcctgtgtcctctccagcttgactcggttggcctctccatacagagccaatgacctcaaagtcttgataaaatagtggccctgtatttggtcacttgtcccaaaaatagcttcagggcaatcagtgatagatacttacatgctcaattaagtcggctcgctggcctgatgtggaaacgggcaggacagccctcaattcaattcagcaagtatctgg

SEQ ID NO: 701025 - DNA, 145 bp, Homo sapiens
atgcccgagacataataccacaaacacacgcacaccaccacatacagctcccagtgcgtcgtgcctccctcctgccccagtggagagcttctggtgtgagtctcgctggcactccgtgccccgggcttcctgcgtctcagtgcct

SEQ ID NO: 701026 - DNA, 156 bp, Homo sapiens
acatttttgtcaaattattagcgaaaagcaggctgtaaacatcaattttgtcataggcttgtttccctgtatgataagaaaatggattttactcaaaaacagtgacataaggagcatataccattaatcttccacacatattaaggtcactcctag

SEQ ID NO: 701027 - DNA, 709 bp, Homo sapiens
gtgacgctctgggacctgagcagtacttagggccccaatggggcgaatctccttcatggccactcgttcgctacgggtcgtatttgtgtaggcaagactaaggccacctgtaagatgcctctctgttcactggcaacgtgcacaccctcaggcctacatacgattggtggaataaggctcaacgaatcgggcagaccgtgcacgcaggcagacggccaacggttcatgagagaggaggactggccgcgttcagtaggttgtccgttctccagacaacccctcccccgcatctggtgaagtttcccgctgaaccgccctcctggtttcatcaatagagcacttaagcaaaggtctgccggtggatctgacgcaacagtgagccccaagacgggctgaggcctcctggcctgccttgcccgcccacccatgggacgtcccagttggtgagggctcagagaagcttctaaggggaaagacagcagcccggacgtattctggttgaatgtgaagtaacggcagcgtgtatgtgccgtcccacctcgccacagcttctttcgcctataaatcttcctagcagcaatgttgagctagcctgaggaggaggcagggtcagaaagcgtaagggcctgcgctctgacctgccgtgtcctttgcacggaaggaggtaggcacctttctgagcttattctattccccacccacaccttaa

SEQ ID NO: 701028 - DNA, 278 bp, Homo sapiens
tcatcagctggacctgtagcttccagcaggggcacagttcggagaccaatgctagaaggcaggcagcaaaatgccacgatggggacggtggaacctgggaagacggctcccatctcaggggtggaggggcttcgggaggccctcatggctggtaatgggatgtgtatctctgctcttctccagaaggcaccaccaaaggtgcccacttctggaaggttctatctcctggtgggctggtctccacaagctcagtgtcctgagtttggtcctcgccatcc

SEQ ID NO: 701029 - DNA, 357 bp, Homo sapiens
gacattttgtgggtagtaactccccaggtgggctgcatggctcatggctgcagcctcatgtgggtctcctgttccacagtgctcccctgcatcagcggctccttccccaggctctggggcagcgcatgaggggtcatgctgggaggggctgccgccgctgttcacttgggcaggacgtcagcggcatcagacacccagcttccccatccacgtgtctcgcatcttcttccacaacccactggcccatggcaggcagctaggtgctggctgcacagtgcagctatggagccctgcgcccagcagcctacacgcttggagccccagtgcttgtcagctagaggcctggggcattgtgca

SEQ ID NO: 701030 - DNA, 831 bp, Homo sapiens
ctcgtgccgaaaatatatatatatatatatatatatatatgccatacgcagtggctcacacatataatgggaggtcaaggcaagacgatcatttgagcccagcagttcaagaccagtctgggccacatagcaagaccccaactctacaaaaaactttaaaaattagccgggcatggtggcatgctcctgtagtcccaactactcaagaggctggggtgagaggatcacttgagcccaggaattcgaggctatagtgagctatgatcgtgccactgccctccagcctgggtgacagcaagaccctgtctctaaaaaattcaaccattcagacataaacttaatacctaaatatctttattcagtcaaatagttattcaaatgtgcagaccataacacaatatattctcatacaaacacagcttcagaggcttcagcaacaacaaaagtgtccttttctgaaagcacagtaagataataataagataataagcataacccagtcaagggcagcagttatcagattcatggtcagactgctcaccatccacacggagcaacaagtctcagaacacatggcacatcttccgcacggccgaatctgcatagaaaatccaatatgaaggactaacacccagtgagagatggccgcagggacccacagccaccccctaactcctaccacatagacatcaaaagcgtacggccaaacgcgaccacagccgggctgcccatacacggcaaacagcatccgcccacaaggacccccgtacgggctaccaaacgcgccagccgacagcagtcaaggcggccccgcacaaccccgcagcccgg

SEQ ID NO: 701031 - DNA, 638 bp, Homo sapiens
  misc_feature (415)..(415): n is a, c, g, or t
cccatggggttcttcgttgacctgaggcattggccacctgggccaattctccgtttttctaagcgtggttcttctccatgcgcatttgaccaccccgagttaggcctcttgttgaggcttcacatggcctccagataccctgagggtcccagaataggggccctctcattgggcccctctgctggcccactggctcacaacctgccttttagctcccagcccccttgtggccaaaccaacctcgtgttccctcaccaattcccgccatgtgactttggtcgcccgttaccttgtggacaatctattctcgttgtctttgatgtgtcccagaaaattcggtgtagtcttacagtaacaaatcatctgagctctcacctaggaagacccaactcgtgatagtcttgtcgatgggcanagttcataaagtacgttgctagacccactttcaccaaatatgttctgtgtccacccagatagtgttccagaccattgctgtcgcccattgttcggggcagggttagggggacaaagcgcagaggagatactttttggtttttttgttttaataccttcccccagaggggcccgatttggcccacttgctcccgtaatgccataaagacattcgccataaagta

SEQ ID NO: 701032 - DNA, 600 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttccttagcgctaatatattgatgccggcaacgaggcactctatgatactgtgttagacgccagtatgactgctgacg

SEQ ID NO: 701033 - DNA, 1072 bp, Homo sapiens
gagatgtcggggcggcggcggcgggagctacggagagcgaggagtcgcgcaggcaggcggaggctgagggcgccgctggccggccctcccagccctctccgcgcggctccgccggggttccaagaggagctagtaggttcggtgggggccctggcatggacatgcacagcgctcggcttgacagcttccttagccagctccgctgggaactgttgtgtggtcgggacacaggctcaccctcaatgcctggtcccctgcagccaacctcccaaactggcccagatgtgcagcccagccaccagcttagggcctcgggtgccttggaagaggactcagtctgctgtgtggaggaggaggaagaggaggaggaggaagcagtggtgacagaagacagggatgcagccttgggaggccccagggagcatgccctggactgggactctggcttctcggaggtgtcaggcagcacatggcgagaggaagaactgcctgtatcccagcgcccagcaccctcagcacagccccttcgtaggcagtgcctctcagtcagtggcctccccatgcccaggcagggcccctgtagccagtgtaccacctgtccaccatccacggcccaagtccaccccagacgcctgcctggagcactggcagggactggaagcagaggactggacagcagccctactgaacaggggtcgcagtcgccagcccctggtactaggggacaattgctttgctgacttggtgcacaactggatggagctgcctgagacagggagtgaagggggtgacggaggtgggcaccgtgcccgtgctcggccccctcagttcctgcttggcctctctgagcagcttcggcgccggctggccagggctcggcggacagctatggcaggaaagcggctgtcatgcccacctcgcccagaacctgaactgcctgcggatgtctcacgctttgcagctctcatgagctgtcgtagccgccagcccatcatctgcaatgatgtcagctacctctgaccctgccctccagcctgggacaataaaagccttttttctagacaaaaaaaaa

SEQ ID NO: 701034 - DNA, 2357 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (1250)..(1250): n is a, c, g, or t
  misc_feature (1254)..(1254): n is a, c, g, or t
  misc_feature (1977)..(1977): n is a, c, g, or t
  misc_feature (2052)..(2052): n is a, c, g, or t
  misc_feature (2071)..(2071): n is a, c, g, or t
  misc_feature (2075)..(2075): n is a, c, g, or t
  misc_feature (2085)..(2085): n is a, c, g, or t
  misc_feature (2118)..(2118): n is a, c, g, or t
  misc_feature (2172)..(2172): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagntgaatgtcagtctgaaaaataaatgtactatattaattcaaataccactctttgtgtaggtattttgtcatatanttaagaaaaattaaatagnatgnaaatcatatnacaataacttaagtctttcttcaaagtgcatgnggtcctttgcaatacctcattcagccaagtatttgttctcttcctcattcagtntaaggcagctttcaatttgcttagaaggcaacattagaagggtagagtttaatcagaaacatagaattttaaagtgtgtgttcaactgaataaatttgaatttctgtaggaagaattaaaaacctatttaaagattgcaatatataatcatttttaaagtatttgattaaacctgataggctttc

SEQ ID NO: 701035 - DNA, 2108 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (1250)..(1250): n is a, c, g, or t
  misc_feature (1254)..(1254): n is a, c, g, or t
  misc_feature (2043)..(2043): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcatgtattatcaggaaacatgtctatacgatcgcagagttgtatttcctcacaaacttctttacgaagagtgaaatacgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataangcggctagttaacagtgggtacgatttctagcccgtgggtttaaaatgcacttaaagtcctgtcc

SEQ ID NO: 701036 - DNA, 2114 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (2049)..(2049): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcatgtattatcaggaaacatgtctatacgatcgcagagttgtatttcctcacaaacttctttacgaagagtgaaatacgtttttgtacctctcagtttcagtcagggacatattttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataangcggctagttaacagtgggtacgatttctagcccgtgggtttaaaatgcacttaaagtcctgtcc

SEQ ID NO: 701037 - DNA, 1790 bp, Homo sapiens
  misc_feature (683)..(683): n is a, c, g, or t
  misc_feature (687)..(687): n is a, c, g, or t
  misc_feature (1410)..(1410): n is a, c, g, or t
  misc_feature (1485)..(1485): n is a, c, g, or t
  misc_feature (1504)..(1504): n is a, c, g, or t
  misc_feature (1508)..(1508): n is a, c, g, or t
  misc_feature (1518)..(1518): n is a, c, g, or t
  misc_feature (1551)..(1551): n is a, c, g, or t
  misc_feature (1605)..(1605): n is a, c, g, or t
ggttgatcgaatcctaatcacagagagctcttcattagctcaatatgttgtttgccctctggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagntgaatgtcagtctgaaaaataaatgtactatattaattcaaataccactctttgtgtaggtattttgtcatatanttaagaaaaattaaatagnatgnaaatcatatnacaataacttaagtctttcttcaaagtgcatgnggtcctttgcaatacctcattcagccaagtatttgttctcttcctcattcagtntaaggcagctttcaatttgcttagaaggcaacattagaagggtagagtttaatcagaaacatagaattttaaagtgtgtgttcaactgaataaatttgaatttctgtaggaagaattaaaaacctatttaaagattgcaatatataatcatttttaaagtatttgattaaacctgataggctttc

SEQ ID NO: 701038 - DNA, 2355 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (1250)..(1250): n is a, c, g, or t
  misc_feature (1254)..(1254): n is a, c, g, or t
  misc_feature (1441)..(1441): n is a, c, g, or t
  misc_feature (1444)..(1444): n is a, c, g, or t
  misc_feature (1448)..(1448): n is a, c, g, or t
  misc_feature (1456)..(1457): n is a, c, g, or t
  misc_feature (1975)..(1975): n is a, c, g, or t
  misc_feature (2050)..(2050): n is a, c, g, or t
  misc_feature (2069)..(2069): n is a, c, g, or t
  misc_feature (2073)..(2073): n is a, c, g, or t
  misc_feature (2083)..(2083): n is a, c, g, or t
  misc_feature (2116)..(2116): n is a, c, g, or t
  misc_feature (2170)..(2170): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaangtntacnactgcagnncatctactgttcgtgaatgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagntgaatgtcagtctgaaaaataaatgtactatattaattcaaataccactctttgtgtaggtattttgtcatatanttaagaaaaattaaatagnatgnaaatcatatnacaataacttaagtctttcttcaaagtgcatgnggtcctttgcaatacctcattcagccaagtatttgttctcttcctcattcagtntaaggcagctttcaatttgcttagaaggcaacattagaagggtagagtttaatcagaaacatagaattttaaagtgtgtgttcaactgaataaatttgaatttctgtaggaagaattaaaaacctatttaaagattgcaatatataatcatttttaaagtatttgattaaacctgataggctttc

SEQ ID NO: 701039 - DNA, 1730 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (1250)..(1250): n is a, c, g, or t
  misc_feature (1254)..(1254): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgttgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttctttgagttcagtttaaagacacttactttaactccattttaaaccctcgggctagtcgtaccactgttaattagccacgttatttggtctcagtttttgtttatcattctgctgagcttt

SEQ ID NO: 701040 - DNA, 237 bp, Homo sapiens
caatgatgtgagccatccaacttagtgtgtcatgagtagtgtggcctgcagtaaatgtatacgcaggttatgtgcgtacgacacaggactatcggttgaatgattagctgatggtttcgataataactagtatggggataatgggtgtagcgtgttgccttgtgcgtagaggaagtgggctagggcattttgaatcttagagcgaaagcctataatcactgcgcccgctcataaggg

SEQ ID NO: 701041 - DNA, 395 bp, Homo sapiens
aaaacttcacaaaaaggctttatttctctttaagaaggaaaaaaagtcctataactctagaagaagtaacacacataaaaaagcattgggatatatccagcaacaaaagatgagacaggaaacgcaaaccaaaagaagtatctccagtgacagccacacaaagcagtgaacaggagagcaacaataccaaaggtgtgaaccagacattaagaacactttgaacaaaagcatgcaatctaaaaacaggtgaattaaaaacatgcacacagaatacaggtcaataaataacgagctctctctctctctctctctctctctctctctctctctctctctctctctctctctctctatctctctctcctcgtgcagaatcctgcagcccgggggatcca

SEQ ID NO: 701042 - DNA, 2359 bp, Homo sapiens
  misc_feature (38)..(41): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (71)..(71): n is a, c, g, or t
  misc_feature (73)..(73): n is a, c, g, or t
  misc_feature (156)..(156): n is a, c, g, or t
  misc_feature (279)..(279): n is a, c, g, or t
  misc_feature (304)..(304): n is a, c, g, or t
  misc_feature (1979)..(1979): n is a, c, g, or t
  misc_feature (2054)..(2054): n is a, c, g, or t
  misc_feature (2073)..(2073): n is a, c, g, or t
  misc_feature (2077)..(2077): n is a, c, g, or t
  misc_feature (2087)..(2087): n is a, c, g, or t
  misc_feature (2120)..(2120): n is a, c, g, or t
  misc_feature (2174)..(2174): n is a, c, g, or t
ttgccataaaaactcctttgatgtttctcacgaagagnnnngcntccngccnagaagaaggagataaacancnccatcatcaaacagctgctcaagaaatttttaaataagaaaccaagttatggggttaatctcctacacaattcatttacttcntttgaatgttagagctcactcatgattatttgtgtttctaatttatagtttaagtttatttgtaaaaagttaaaagagagtgggtctctgtggctctcactgatgttcactctggcatccttnagcatttttcttttttcatttcatnattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccaagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcaatgacctaaaaagggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggagttttagtagacagtattatactacatttgaaaatcaaggagcagtttatgcaacgttgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagntgaatgtcagtctgaaaaataaatgtactatattaattcaaataccactctttgtgtaggtattttgtcatatanttaagaaaaattaaatagnatgnaaatcatatnacaataacttaagtctttcttcaaagtgcatgnggtcctttgcaatacctcattcagccaagtatttgttctcttcctcattcagtntaaggcagctttcaatttgcttagaaggcaacattagaagggtagagtttaatcagaaacatagaattttaaagtgtgtgttcaactgaataaatttgaatttctgtaggaagaattaaaaacctatttaaagattgcaatatataatcatttttaaagtatttgattaaacctgataggctttc

SEQ ID NO: 701043 - DNA, 115 bp, Homo sapiens
aattttctcctgggtaattgtttgtctagtatatatctctcaatccatttactttcaaccgttgtgttcttacaattagggatagcctctatataatagcatatagctggccctt

SEQ ID NO: 701044 - DNA, 1208 bp, Homo sapiens
  misc_feature (101)..(101): n is a, c, g, or t
  misc_feature (105)..(105): n is a, c, g, or t
  misc_feature (828)..(828): n is a, c, g, or t
  misc_feature (903)..(903): n is a, c, g, or t
  misc_feature (922)..(922): n is a, c, g, or t
  misc_feature (926)..(926): n is a, c, g, or t
  misc_feature (936)..(936): n is a, c, g, or t
  misc_feature (969)..(969): n is a, c, g, or t
  misc_feature (1023)..(1023): n is a, c, g, or t
tacgacgtgactgggaaagccgggcgtggcatctctgtgtacatggagcttatttgaggctagaagattgattttaccatctagacctctctggctaatanctantcttcaaccggttactctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagntgaatgtcagtctgaaaaataaatgtactatattaattcaaataccactctttgtgtaggtattttgtcatatanttaagaaaaattaaatagnatgnaaatcatatnacaataacttaagtctttcttcaaagtgcatgnggtcctttgcaatacctcattcagccaagtatttgttctcttcctcattcagtntaaggcagctttcaatttgcttagaaggcaacattagaagggtagagtttaatcagaaacatagaattttaaagtgtgtgttcaactgaataaatttgaatttctgtaggaagaattaaaaacctatttaaagattgcaatatataatcatttttaaagtatttgattaaacctgataggctttc

SEQ ID NO: 701045 - DNA, 541 bp, Homo sapiens
  misc_feature (310)..(310): n is a, c, g, or t
  misc_feature (401)..(401): n is a, c, g, or t
  misc_feature (438)..(439): n is a, c, g, or t
  misc_feature (523)..(523): n is a, c, g, or t
  misc_feature (539)..(539): n is a, c, g, or t
aattcgcggccgcgtcgacacgacagaaggggtcagtgaaaagctctgggagtcggaggacggataggcaatcctgttcagagaggggagggccgggtgcggtggctcacgcctgtaatcccagcactttgtaaggccgaggcaggcggatcacttgaggtcaggagttcgtggccaacgtggtgaaaccccgtctctactaaaaatacaaaaattagcggggcgtggtggcgggcacctggaatcccagctacacggtaggctgaggcaggagaatcattgaatcggagtggaagctacatgatggaantgcgccactgcactccagaccgaaaaaaacaaaaacatgaccggtggggtggctctgctgtaaacccagcacttgggaagccgagcgggtngatcactgagtcaggattcgagaccagctggccaacnngtgaaccccgtctgtactaaaaatacaattagctgggtatgttgcagtgctgtatcccagtactctggagctgagggtcgcttnacctggagtggagttnct

SEQ ID NO: 701046 - DNA, 578 bp, Homo sapiens
  misc_feature (513)..(513): n is a, c, g, or t
ccgcgcctggtgttgcccgactctagcaggctcgcctcttcatgttgtgtccgggacactcctttgtgcaatatttctgtgattgtgcctatgcgtgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataangcggctagttaacagtgggtacgatttctagcccgtgggtttaaaatgcacttaaagtcctgtcc

SEQ ID NO: 701047 - DNA, 397 bp, Homo sapiens
ctgcatgtcgacgccatagtatcccccctctaaaccagttcatgcatgttacccatgacatcgtgtgctgtgaggggtatctcccttcctttaaagccgtgcgtcatctcttcatgaacaccggatgtttctaagtcaattcattcattcattttttgcagaccttctattagcctcacattgtgccggtgggaactcagaagggaactgttgattacatcgtccttgccttggaaaccctcctggtgaaggagacagacatataaaagtgtaatagttggaagatgtgatgctacatgctcattgaggctatgatgaagcatgagagagctcactgaccttgacttgtctttacatagtctttccctttagagcccttggatatgccacacagagg

SEQ ID NO: 701048 - DNA, 117 bp, Homo sapiens
tcaggagaggagagtggaggagtgagaagcgagggatgtgtgagcaggggcatggagccaggagaacgagcctccgccagagtctggagcctggagcagtgtgcaaggctgggcagc

SEQ ID NO: 701049 - DNA, 260 bp, Homo sapiens
ctgtttaatctagctctggggtcacaatgacacccacgccacattcccgctcgaattccacagtgtacgataggggtccaaggggtagactaccgcacgatactcaagcggcagtcgctatagcttgggctcagtgtaggatctatctatactaggctatagtagcttaacaagggaaaggacgagacgcacgggtaatccctagagtacgggcaggctaatcgaagcgcgttagggtgacccgagtctttgaatatcgt

SEQ ID NO: 701050 - DNA, 773 bp, Homo sapiens
  misc_feature (238)..(238): n is a, c, g, or t
  misc_feature (343)..(343): n is a, c, g, or t
  misc_feature (353)..(353): n is a, c, g, or t
atagccaaggttcttggggcccaccagccaaggataattcttctaaaaggccaataatttaccttccccaagacatatttttagttaataaggttatccattgttaaaacaagttagggcagtaatgatgtttaatatgtactgcatccattatgggctggtgcatttgctaatgtattgaatcaaagaattggtaatcatgaatattgttatagaccattaaaatgggccactgcangtggctcatgcctgtaatacatggggaggctgaggcaggagacagtttgaggccaggaggttgagactagcctggacaacataaggagatgcctgtctctacaanaacataaaantaaattagctggtatcaagcagagttccatggaaatattaaaatttttttaaaaaataaaaataggctgggtgtggtggttcatgcctgtaatcctagcactttgggaggccaaggtgggcggatcacctgaggtcaggtgttcgagaccagcctccccaatatggtgaaaccccgtctctactaaaaaacaaacaaacaaaaacaaaaacaaaaaattagccagatgtggtggtgtgcacctgtaatcccagctactcaggaggctgaggtaggagaattgcttgaacctgggaggcagaggttgcagtgagcaagattgcaccactgcactccagcctgtgtgacacagcaagatcctacccccccaaaaaaagttccacccaattccagagaatgttctagatcgcgagcggccgct

SEQ ID NO: 701051 - DNA, 425 bp, Homo sapiens
  misc_feature (6)..(6): n is a, c, g, or t
  misc_feature (76)..(76): n is a, c, g, or t
  misc_feature (124)..(124): n is a, c, g, or t
atcccnatttccgagtagaaaggtggtttaacctgaagggtaagagaaagattatggcccctaaatgatttttttntcctcctaatggtattagggcaaaatccctcaatgatggatacctgcncctcaaagaatataaaattgatgagaaaaactttgtggtggttatggtgacccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattaaaacaaaagaaaaaaa

SEQ ID NO: 701052 - DNA, 148 bp, Homo sapiens
gtgacgagggcaagatccagtttcatgcccttactcacacttgtgtaggtgctccataaatgtatgtcatgtaaacaaatgaattaagtatggctcgtggtctacaagagccccaagatctttttctccccgagacagatcttcagct

SEQ ID NO: 701053 - DNA, 546 bp, Homo sapiens
gtgatctagaggatcccgaagggtgatgcggttgggcatggggctcacacctgtaatcctagcatatttgggagggtgaggcagaaagattgtttgagcccaggagttcaaggttgcagtgagctgtaattgcaagactgcactccagcctgggtgacagagtgggaccttgtctcaaaaaaaaaaaaaaaaaaaaaaaaagaaaaaaagggggtgtaatgggcggcctgggtagtggaagaacatgagagggaggtattggaccgggtatcgggggatgagtagaatctacttacggaatggcggggcataagaggttggggtcaacaacagacggcatacttgagggtggtcccatgagattataatagcatattttaacggtacccttttctatggttaagatttgtgagagatacacaaaatttaccatttcggtggcggtggtctacggtatccaggacggtaatatggtggacgggttggtagcctaggatcaatagattcaacggaatagccggagggtatggtaggctataccatcca

SEQ ID NO: 701054 - DNA, 157 bp, Homo sapiens
ttttaaaaggacaaaggcatctgccacaaatatcatacagagtactaataacaggccggaaaacaaagtagctaaagcaaaaacagtatataaaccccacactgacaatccaatgtaaccaataaaataagttaataggcaagtcctgatccacata

SEQ ID NO: 701055 - DNA, 238 bp, Homo sapiens
atctacccagcgactaacatacaaagccagaagcaacaggatttgactggcactctattagacagagaaaatcgtgaagaaagaacctatccgtaactggctgcactctcatgagagtcaatcctcacgataaaccatctctatgctgaactgcaagatgccctggtactcttacagttatatgaacgaattaaagttcctgtagactggagtaaggataataaacctccatacccga

SEQ ID NO: 701056 - DNA, 248 bp, Homo sapiens
tgacacatcgtgcactgcactccagcctggtgacagcctgagagtgatttaaaaacaaaaaaaaaaagtgagtggggcctataaataattatgtcaggaaatgagttaacgtaaaagtatttggatttccccagtttgtaagtcccctagtgtaaaatctagtagcccaggatggtcctggttaaaagacccctccaattctctgagtggcaggtgccggcaatcaactccaatctagcagtgacatc

SEQ ID NO: 701057 - DNA, 368 bp, Homo sapiens
aggcaactttgcaatatagaatagatcgtggtgtacaccacacacatatattacaggggcacataacatgctggtcatattcatgtaactcataattccaatttgcaacatttatactaacgttgttctgctcttaatattccttgagctgccagattaaaactcagagttcattgcaagcacatacagcaggactttatttattaagaaatctctggatacctcttacatgcccagaactctcactgtaaattggaaacacaaattaggccacaatctctgatgtgttgtgaacctttaaggaaaattagaaaattcttacgcacaaagcgttctatatgaaaagtgtccgtgtaagcccgtcgggg

SEQ ID NO: 701058 - DNA, 281 bp, Homo sapiens
tctttggttcttacagtgaaccacctactctttcagttttctggcccaggagtggggtaaatcctttacttagtgcatttgaacttgatacctgtgcattcagttctgtgaatactgcccttattatggccggggtattcctacatctaccccagccttgaacttgcttcaactacttaacacccagaatatagtgtcagccgacaagtgaggtttcaaagataagtccctgtccagtattctgtagggtgaccccttcagcattaaggacagtacttcca

SEQ ID NO: 701059 - DNA, 318 bp, Homo sapiens
tcttcacatgtgtagggtttctctccactataaatgatctgatgtatagtaaggttcgaagaccacttaaaaatttcgccacaatctttacatttgtagggttagtctcccgtatgaactatgtaatgttgagttcggcctgagggatagtaaaaagctttgccacattcttcacatttatagggttactctacaagtatgaaatcttttatgttctatcagtcttgaggatttgctaaaggctttgccacattcatcacatttatagggtatctcgtcccaaatgaattatcttctgtatagtccggtttgaagacg

SEQ ID NO: 701060 - DNA, 201 bp, Homo sapiens
ccattgacataagcacggtgcggacagcaggagtagctgcagcggctgcagctgcaggtcgtggacccattgtctgtgttgatgtgttagcaacacgctgtgttgacatgactcgtggaacctgtgatataagctggtctcatagtactacactggtggtctaggagcagctgggcggatcgcaccgtgccttatctcaat

SEQ ID NO: 701061 - DNA, 155 bp, Homo sapiens
gcctctacaagatccccctcttatagtgaaggccgtagcacgaacaggttgaacagtctaccctccctaagatagaggagacacctgctaggtgtaaggagaacatggttaggtaagagtcacaagcttatgttgtttatgcggggaaacgccat

SEQ ID NO: 701062 - DNA, 1014 bp, Homo sapiens
  misc_feature (721)..(721): n is a, c, g, or t
tgtatttttggtagagtagggctttattcccaggaaacagggtgtagcgggagaggggtgtttttaaaaaacatcagggtagatctaatatgtccaacaaagggggggggcctcagccagaggcgaaggggaaagattctctagtattggctggtcatctgggggcacccagaattccacagggtggaaagggggcccaggagtacggccctatagcaaagtggtccggtctcgtgcatcataagaggctaactcatgggctcctccgtgctaaagtttcgcgcagcacaaagctgcttcctcgggaccccgatcttgaaaggaggctcgtgtaaatctcgtgcagtctaaagtgtggacagcaaggccatatattacgggaaaggggttaccggttatcactcccggggtcatttaaattcgtggtcacacattagagtctcacataagtgtgaacggtccactctttcgtgggccgggtcaaatttcacttaagaaagtgtgagtgaggtgagttttgttgggacaacgtgccgtgttcgtcactgtgaaaggccctccaaacagagggggctacctcaccaagcctctcacacaagtgagaggcggtggtcaagaaacaggggactaaaacgggagatccagtgaatccagggggggcacccctccacgcctatggcggtgactcgagaacaccggtcacacaaagggtgctcaaagncgagtggtggtcgcccccctatataccccgagggtgttgccctacaaaggagacccaccaagatgggtggaccccaaggctaaggtggggcaactctactcaaggaaacaccaagaaatcgggggacaggaagtggggaaggcccaatcaccttatgggggcgggaaagggctcacctgtcggaacaaagtggcggcggacaattgaggcagagggaaaacccccaccctcctgtggaaaggaaggccctatgaaagcgggacatttggaagagagaacacggggggaaacgg

SEQ ID NO: 701063 - DNA, 265 bp, Homo sapiens
  misc_feature (55)..(55): n is a, c, g, or t
cccttggagagctaaggtcgggcggtgatgtgagggtgatggtagatgtggcggngttaggggcctttggtgagagttatggcgtcagcgaaggctgtagtagcccgtaggggctacacgttggggctttgcgtagttgtatatagcctagaaattttcgttcggtaagcattaggaatgccattgcgaattagaagtgggttaccatgaggagtaggaggttggccatgggtatttttgttaagaaggaggaatttgaacctct

SEQ ID NO: 701064 - DNA, 793 bp, Homo sapiens
gtcctcagctgctcacttgcacagaaactccatctatgactcgtgatgctttatactagaagacccatctagacttcaatcatctttagaagtccatccattctgggagagacctggcgttgctgttgcctcctgtggccgtgtgtatctgtcaagttctgtgtcccaggccgttctattcaggcggttgcaacacggtgtgtggactttgttgacattggggttggcttgttcttccgggaacttgcttcctttccctggctggtgctgtcaggaaggaccatctgaaggctgcgaatttgttcttagggaggcaggtgctggcctggcctgggatcttccaccatgttcctgtttgctgccttttgatagcctgattgtcacaccttctgggcatctccctgactgtcctcttcaccctccttctcgttttcactcatagtgccagccattttggagtctccttgtggtatccgtaaactctacatgaaatagtctgttagaaatctttgcgtgggctagcttgagaatggggcgaggagccgaggagaagaacaccagctttacaagccctacatccaaggtgaatctacttgcaaaggatcccacttcactagaagcacgagatcaacagagaattcgtcgaaagtggtagtagtaagggctctgtacgagctgtcccagaagttcgagcttctctggacatttttctaacttttggcggacaggaatggggaccattatggctgatgcggtgacaagggagagtccccaccggaagaactggggcctg

SEQ ID NO: 701065 - DNA, 572 bp, Homo sapiens
  misc_feature (2)..(2): n is a, c, g, or t
  misc_feature (85)..(85): n is a, c, g, or t
  misc_feature (102)..(102): n is a, c, g, or t
  misc_feature (107)..(107): n is a, c, g, or t
  misc_feature (127)..(128): n is a, c, g, or t
  misc_feature (131)..(131): n is a, c, g, or t
  misc_feature (133)..(133): n is a, c, g, or t
  misc_feature (141)..(141): n is a, c, g, or t
  misc_feature (150)..(150): n is a, c, g, or t
  misc_feature (160)..(161): n is a, c, g, or t
  misc_feature (172)..(172): n is a, c, g, or t
  misc_feature (186)..(186): n is a, c, g, or t
  misc_feature (188)..(188): n is a, c, g, or t
  misc_feature (194)..(194): n is a, c, g, or t
  misc_feature (198)..(198): n is a, c, g, or t
  misc_feature (209)..(209): n is a, c, g, or t
  misc_feature (243)..(243): n is a, c, g, or t
  misc_feature (252)..(252): n is a, c, g, or t
  misc_feature (265)..(265): n is a, c, g, or t
  misc_feature (275)..(275): n is a, c, g, or t
  misc_feature (283)..(283): n is a, c, g, or t
  misc_feature (299)..(299): n is a, c, g, or t
  misc_feature (310)..(311): n is a, c, g, or t
  misc_feature (318)..(318): n is a, c, g, or t
  misc_feature (323)..(323): n is a, c, g, or t
  misc_feature (347)..(347): n is a, c, g, or t
  misc_feature (366)..(366): n is a, c, g, or t
  misc_feature (398)..(398): n is a, c, g, or t
  misc_feature (414)..(414): n is a, c, g, or t
anggcaaaaaagccacaggcaggcccagaggggcgggtggacggcactgcaggggatggtttcatgccttcttgaggttatatgntttcatccagataaaantcgtnatggtcgtcttcggtgggtnnttnangtggtggntccgggcangcggaatggnntcatcaactcnaataatgtatatangnagaaanttgnacatcatttgnatacataagtcacacatggtctctttcccagaanaagaagagnacggtggtggagnggtttgtgcnctaccaanagcccgtgccttactnatacttcatgnnaattaanttttnataataggggcaaatacataaaanccaaatgccaaagttggtnggagagcccccgagtttgggtttctgcgaganaagcttgaaggggcanaggcggtagacgtattcgttggtggtgagctcgtagcactggctgtacaggtaagcaaactccccgttggggccaaagtcaaaagaaatctcttgctccaggttcctgatggactcctccatgtccttcagcgaccgctcggcctcctcgaacttgtt

SEQ ID NO: 701066 - DNA, 197 bp, Homo sapiens
gtatcactgcttattctgcacaatcttctacgctttgccagtaagaaggtcatgaggtaactttattcccaagatctcgggaatagtccacagtgaacacgacacatagctgggcattgattccattttacacaagttgataggtgatgttcttatgttttgtttttatcttcatctcctgattcccaaaaggtttc

SEQ ID NO: 701067 - DNA, 800 bp, Homo sapiens
  misc_feature (298)..(298): n is a, c, g, or t
  misc_feature (669)..(669): n is a, c, g, or t
cacagtggatcatgcctgtagtgccagcactttgggaggccaaggcaggcagatcacaaggtcaggagttccagaccagcctgtccaataaggtgaaaccccgtctctactaaaaaatacaaaaattagccaggcgtggtggcgtgcgcctgtagtcccaactactcgggaggctgaggcagaggttgcagtcaggtgaggttgcaccattgcacttcagcctgggtgacacagtgagactccgtctcaagaaaaaacaaaacaacaacaacaaaaagcagatgcttaaagatagacngtagattggtggttaccagagacctgttagggttgggggagggaggatgaaaagagtttgattaatggatataaatatacaattcaacagaataaataagacctatggtttatagatcagtagggtgactatacagcacaacaatctattgtgtatttccaaataggtggaagagaataatttgtttatggcataaagaaaagataaatattgggccgggcacagtggatcatgcctgtaatcccagctctttgggaggccaaggcaggcagatcacaaggtcaggagttccagaccagcctgtccaataaggtgaaaccccgtctctactaaaaaatacattacccaagcggtgggggcgtgcgcctgtngtatcaacttctcgggagggttggtgcagagaaatgctttaatccaggagggcaaagtcggacttgggccaaatatgaccactgctttttacccgggctgcagaggggaccccttctttaaccaaattgct

SEQ ID NO: 701068 - DNA, 352 bp, Homo sapiens
agatgatgccttgctctgtcgccaaggctggagtgctgtggcacgatctcggctaactgcaacctacacttcccaggttcaagcaattctcctgcctcagcctcccaagcaggtgggattacaggcacacgacaccacacctggctaggttttatatttttagcaaagatgggggtttcaccttgattgccaggctggtcttgaactcctgaccctaagtgatccgtcagccttgggttcccaaagtgttgggattaccggcataaggcactcgccctggcctcaattttaaactcgttaactttgagggtgccagggagacaatccggggggatactgttaaactacacag

SEQ ID NO: 701069 - DNA, 596 bp, Homo sapiens
ttattttggcgcacggcactagaaaggaactgttgtaaatcaactgattaggttggtaaagggcacggccacctaaggaatcctatggcaaagcgagggcaaattaattctacagactcaaggttatgatggccacgcatgaccacattcctcaggcgtctttaaaagagcttcttggagacacaactttcctaggaactgctccagaaatcggcagcacctgagaatgcttaacagggtagcccatcatggacacgtgaactgggatccgctatgatgatgttgcactctcgcaaaatcacctctgcttgtctaacatcgctcacaataacctgacgctttactagatggctctctgttatacccaggatcgccgtatgaccaatggtgccttaacgtgaaatcaactcagcgagaggactgtcttgacgtgaaagacatcgtcatctgtgcaccaggtatgctcttgtcgtaagcagcttggcgagctatcatgttggttaactgacagtgcttgagaaaagactcagtgcgccgagtcgtttactggggtttagtggcacgctgagtcccaacgataggccatcacgtcctca

SEQ ID NO: 701070 - DNA, 122 bp, Homo sapiens
  misc_feature (100)..(101): n is a, c, g, or t
ccgtcccttccctccccccgtgctctgccccgatggttcggtccgcgccgggggcggggccagggggattcctttagcccaggagtggaggctaagctanntcactccagcctgggtgatca

SEQ ID NO: 701071 - DNA, 382 bp, Homo sapiens
ctccccatctggctcacagtgtcacagtctcattgtcataaacggcagtcatgtttacgctggctattagtaagtcaagaacctggtgcagctctctgtctgtcacgcggaggtccaaagggtacctcagctcccgaagggtctggctggtacatgtgtttgtcagtgagcggggcccggatgatgagctgctccgcccggaagaccggcccacagtgctggtcaccgtactctttaaccaggcgagcctggccgctgggggctgaccagagcgtcaactggattggtagtgacccggacaaacaccaggcctgacgaacacgcagtacatgaaccccagcgagacagcacatgacacagccaggacactttgcatccagag

SEQ ID NO: 701072 - DNA, 888 bp, Homo sapiens
ttgggtttttgtttcgtttttatactgttggttcctttctcctgctttttgggttacgttagttttgtgctgttctacctgtgtctgcctatactctttgttcgccttctctcctttttgtgggtatatttatgtgtactgcatccattcgttcctacattgttctctgtggacgtgtactatggggctacatggtttatctcatctttttttttcgtaatcttgtgaccactgttgtttttgctctcgctgcttgctccctttagttttcctttgtggatgtcaaagtacctactgtgattataaaggtgaatttgttcgtagttttatatctgtgtgctctaatttattgcttattgcttatattctactgtcgtcgtgattcttaggatttcttatggtctgatcattattatatttgttgttgtcatttttgctatgttgcttactagtactactactaaactatactatttatagtagtagtcttatttgtatatagtgcataattataggttatactattgtttactatatatcttgatatcacattaaattagatgtaagatgctaatttgattataacgtaaattgaggtaataattttaatcaataagtctgtgcgaaagggggaatgtgctttctttgagacagtctgattcttgcaacttattctgtaagttggaacttatgttccacaagcatgtatctgaataaaagaatcccagcgacattggcaacttcttctctttttcagcctagaaatgtctgtgttaagtggttttttatttattgttgttgtttgttgttattgttgttcttgttgccaggctccaactcacaaaatactgagtttaaaaactgcgttgtattaacagcgaggtgtga

SEQ ID NO: 701073 - DNA, 1561 bp, Homo sapiens
ggcacacctatcgcgtatgtaccaccacggtggctagatggggcctggggagctgcatacctgcccctcggcagtagtggttgtgggttaatgtgggtgaagcagagaataaaacgaatgagaaacaagatatgacacaaacaaatacactatacatagcatcacacatatcattaccacactacacaccaccacaccacacaactcctcaccactccacccacacactccacacccccacccaccacaccacaaaaacctataacacccacccactactatctatcataataaacaaaaaatatctcgaatcacatatccccccaccacacaaccccccccgcacacatctaccacacacaccaacacacccctaacatatatactccaaccacaacaatactcctacccccacacccccctcacaacctacaacattagtagcactacatataaacaaataacacataccacaacaaccaccaccaacctaccccaacacagcccaacaaacacaacaacaaacaaccaataactctccaactcactaatacacccaccacacaacatacacgtcaactaatatcataccctaaacaatcacctaccacatcccattcaatctcactcactccccaaactcatatcattccactcacaccacacaacaaaaatcaaatcaccacacacccacactttaacaataaattattcacacaaatcattatcccaaaaataacacacccactaccaactacccacatacacaacccaaaatatacaactccaaatatactctacaatttcgagtctcaacgctctaaccctccccccttccactcaacacaccgctttctccacacacccacccctctatcgtcactacaaaatacaaactcactaataccactcctacctaccaactaccaacacacaccactcactcacactacaccctcaccacaacacatccatcccccttccccttcccctaaactactacacacattacatcacacccaccacatacaaaacacatacacaacatcaaccctctatacacctaaatgttaccacctacccaacatcttctccttcccacaatcatatctccctctccactatccaccccactctaccacacactcatcacaaccatcacaccctgcccctctcacactctacacacactctacacactacactcttctactccccctacctcacaaccccctttcactaccacacactcccccaccatcctctttccctcctcccccacctcaccgtctccctcctaccccccccactctcctcccccacatcccccccccacacaccccgccaccactcccccacccctccccacctacctacacaccactcctccactcaacccacccctccaccctaactcaccaaattaaacacactcacacccatcccccctccacacccacactcccccccacccccccagcccacctgcatcaccaacactccacatcctccaccaccccacccacctcccactctccacacaaacctccacatcacaccg

SEQ ID NO: 701074 - DNA, 152 bp, Homo sapiens
cggactcgttggcttcgtgctctgggctgggggcggttgctccgcgttgcgggcagcagcgtctgtctgtctgcgtaactcggagcggtaccactcttcgtgcttcatgcctgttgcttgtatgccattagtctcatacttgcgtgcggatc

SEQ ID NO: 701075 - DNA, 332 bp, Homo sapiens
ctggaggaatcggcacgaaggaattttcaatttcttcgggcactttgaccagcaggcacttgatgaatgccggtgtttttaccaaacagagttgtatattgggttcctgtatactctcaagggaccagggtgaacacaacctgggttactctggtgcgttccggctcctcctcttttaattcatcctttcctggttgcgccaaggcctggacgctgaacctgggcacccagacacaagcctcacctggccgaccgttcatccccgggggctcacgggtgaattcgttcgtttctacagaccctcccacaggtaagctgtgcctcgcccgctg

SEQ ID NO: 701076 - DNA, 442 bp, Homo sapiens
  misc_feature (277)..(277): n is a, c, g, or t
  misc_feature (280)..(280): n is a, c, g, or t
  misc_feature (291)..(291): n is a, c, g, or t
  misc_feature (297)..(297): n is a, c, g, or t
  misc_feature (321)..(321): n is a, c, g, or t
  misc_feature (327)..(327): n is a, c, g, or t
  misc_feature (343)..(343): n is a, c, g, or t
cgaaacctggctcagtgcaatactcccattgccatggggtccttcaccatggtactgtctccacagccctcagtccccaccacaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgaacaaaccaaaacnccnaaacaaggtgntgtgtncctacaaacccaaatggtgggagnctatgnaaaccaaacaaccatnctggaccccaaacatggtttgcatcccaggttcctcgcccacctacccccgccacaccccgtctatttagagatctctctaataaaaaggataataagc

SEQ ID NO: 701077 - DNA, 390 bp, Homo sapiens
  misc_feature (270)..(270): n is a, c, g, or t
  misc_feature (273)..(274): n is a, c, g, or t
tttctatagcctctcttaggaccccgccacacaataaaatagttgggaggctcgtcttaggccccaggcttttcatctgccctattacctggcagggcgggaagcggctttgataaaaccttaactgtaatcccgaagacagggagcccatagagggcgggatggtttccactaccccttccctgcacccagtccatgatttgagttctgcttgcttctttagcaaaatattctggtttctagaagaggaagtctgtccaacaaggcccnctnnctcaggcaccacagaccacacggtctgaggccccagcaaaaccgatcctgggccacaatagcaaggccaactctcaggacctcaggcagaccctcctctgctgggtttaatcttct

SEQ ID NO: 701078 - DNA, 485 bp, Homo sapiens
catgcatcaggaggaggatgcgacacagggccctttggactcccaaaaacatgaccagttggaggcttaacccgagctagacgggaggatgtgatgtgtcttggggactgtgcgtgagcctcagagtagaaaagagctaaaacttaatgacatcaggaggtccctatttagcggaatcagcaggatcccttgctaacgagcgcccgtgattactcacctcctcccagtgtacagaggggatcgaggctttctaaatctccgcatcgcttacatatgagcatgataaccaggggcatctgaagaaaagctctgcttaggggagattgagaccagaatacacactgggaaaccagagagcgtgcaggaaggagccttagaaagcaggctgtcattaatgtccacgcggaggtgagcgaaaatatcgcgaacatgaggcaagaacaggaagctctaaaaaaaagccaccaaaaggagtatcgaatatc

SEQ ID NO: 701079 - DNA, 122 bp, Homo sapiens
tctgaactgcacgatgggggcgccaggtccacggggatgaagtgcagctgattcactccttccagcaggcggatgcccagtggtgacacttggacaactgtagcggttgtccccgatgttcc

SEQ ID NO: 701080 - DNA, 627 bp, Homo sapiens
  misc_feature (56)..(56): n is a, c, g, or t
  misc_feature (91)..(91): n is a, c, g, or t
  misc_feature (102)..(102): n is a, c, g, or t
  misc_feature (105)..(105): n is a, c, g, or t
  misc_feature (112)..(112): n is a, c, g, or t
  misc_feature (117)..(117): n is a, c, g, or t
  misc_feature (128)..(128): n is a, c, g, or t
  misc_feature (132)..(132): n is a, c, g, or t
  misc_feature (135)..(135): n is a, c, g, or t
  misc_feature (185)..(187): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (228)..(228): n is a, c, g, or t
  misc_feature (237)..(237): n is a, c, g, or t
  misc_feature (247)..(247): n is a, c, g, or t
  misc_feature (267)..(267): n is a, c, g, or t
  misc_feature (290)..(290): n is a, c, g, or t
  misc_feature (303)..(303): n is a, c, g, or t
  misc_feature (320)..(320): n is a, c, g, or t
  misc_feature (323)..(323): n is a, c, g, or t
  misc_feature (330)..(330): n is a, c, g, or t
  misc_feature (359)..(359): n is a, c, g, or t
  misc_feature (371)..(371): n is a, c, g, or t
  misc_feature (373)..(373): n is a, c, g, or t
  misc_feature (402)..(402): n is a, c, g, or t
  misc_feature (449)..(449): n is a, c, g, or t
  misc_feature (591)..(591): n is a, c, g, or t
ttctctttgctcgttaccacgcaggccccctggtggaaggacatgtggggacagangatgctgcgcacaggatgtgagctctgctcgatgnggaagcttctnttnagctgcngggtnccctcgttgtntacnacnctgttgagcagcaacttgttgaggttagctttgatgagcagtgagggatnnngggctttgcggntnttncaggaccgggctgagatgctggtnacagggctnccctcatgcnccaccaaacgtttggttttngttagctttcctgtggccatatnatagaggaaaganaagacactgccacggtnatnacccgcncagagcagccggctaggggcatcataggncagagcaaggtnanggtctgttatcttgctggagctcttcttnactttcttgcctgtggagatgttcatgacatgcacgttgtgcttggngttccccaccacagtgaggttgttgttgacaggctggaaggtgcagcagagcagttcagcgctatcgggggtcagggatctctcggatgcagcgaccatcctcagaggcccagatgcgcatggtggcatccagtgaggtggnacgaggatgtcttggagagggacaggcgagtcggag

SEQ ID NO: 701081 - DNA, 1025 bp, Homo sapiens
gttccgtgcctggacccgaggccgcggaggaacttgtccaaccttcctcgttgggaacccgtcgccccccaatgctcgtcgaaatccagtcatagatgtcagttctctgccacagtttgcagaataagtctaaccagatcacacgaactagtactgaacactcataaaaggattctagcattatcaaacggcagatgtaactcaccacaagagagctaccgtttgctgtatgtcgagtggcctatgtgagtccgagcgagaaatggtctataaagcgtactgattcaggccgacgaattgggggtgactggagaatctctagccggctgtaggtttcttgccctctgcagcggtggtggtctgttaattgctggtgaccgaacgatcccagatatatcgaagtcgatcaagagatccttagtataccctacagggttaggggtgggtcgcaacttggtagaatgaaaaaacctccaaaacaagtcatcagtaggccatcgattgatacggcgagttcagagccactctgagagaggcgcgatagaggtatagatacttgttggacctcaagaattattatgagcacgccgagaaagtaatgtctaccaaaggactagggagtcacatatttgagaattttctgatacctagccgcaaataagatgtccagtgcgcgtgttatgtgacagtacgaaacgaaagagcataacgatatatgactttgtttgaacggttttaacacttcggttagatgacatggcgatatacccctcgatacttcgtttagacccagtctatccaaggagtgcttaacttaccaggacttactcgtatgtcctttgggattggcttccttgaattacatttgcaattggtggggagtagtcgttaataccgaacctaaggatctctggaggattagccatttgagttagggcaattagggaattccattggactttaaactcttgggtgaatgattactttggacattgcctagtaataattctcactttggaaaaatg

SEQ ID NO: 701082 - DNA, 160 bp, Homo sapiens
gtcgggcgtgaccttaactaaggcattatcacatactgcggtcataactttgggcagtttgaggtacaacagcaaaacaaatgtgaatttatttttccctcttcacattatcactgatagaagatttgttcttaccatagatcttagcaatttccacagt

SEQ ID NO: 701083 - DNA, 112 bp, Homo sapiens
actgagttccaatacatgaaaacctcccttctgacgctgctttcccaaaactccccctgcatctttatctcttcatctatcccacctctagtctgaacatcccacctttatc

SEQ ID NO: 701084 - DNA, 232 bp, Homo sapiens
agcatcgccgccgccagaggagaaatgtctgaagtaagacccctctccagagacagtgttgatggatgaccctcctgtagtgagcagcgtcctgtgaaccccgcgaaccaatgtgattggtttccttgtgcaatgaccttggaactcatgaaaggaagcgaccccttgggaaccccttaactggggaacggggaaccttttcgggaaattattccctttattattggggggg

SEQ ID NO: 701085 - DNA, 301 bp, Homo sapiens
atgtggaagtttccaggaggcctgtcagagcctggagaagatattggagacacagcagtccgagaggtgtttgaagagactggtgtcaagtcagaattcaggtctctgttgagcatccggcagcaacacaggagccctgggcgctttgggatgtcagacatgtacctgatctgccgcctgcagccgcgttccttcaccatcaacttctgccagcaggaatgcttgaagtgtgaatggatggatctagaaagcctggccaggactaaacacacaactcccatcaccagcagagttgctaggc

SEQ ID NO: 701086 - DNA, 204 bp, Homo sapiens
  misc_feature (25)..(25): n is a, c, g, or t
  misc_feature (34)..(34): n is a, c, g, or t
  misc_feature (90)..(91): n is a, c, g, or t
ccctggcgtcctccctctgtttcancaccagagnaggagagagcggcgttcctgcaggagagaggaggggctgctggacccaaggctcannccctctgctctcaggaccccctgtcctgactctctcctgtatggtgggccctctgtgctcttctcttcctgtcgcatctcgtctcttctctgtacatctcgtctcttctcttg

SEQ ID NO: 701087 - DNA, 322 bp, Homo sapiens
ccagcctgctgccgaagagaatcacttgagctggagtttgaggctgcagtaagctttgatcacaccacttcactccaacctgggtggcagagcaagatctcatctcaaaaaaaaaaaaccagaggctgggggaaagaaggcccaaaaggagggccttcgggcagaggcagaaggatctctgccagaaggatggggaccaagaaaaaggaggggggaggggtggtgcctcacgcctgtaataccaacacttgggggggctgaagcagccggatcacctgaggtcggaattccgagaccggcctgaccaacagggagaacccct

SEQ ID NO: 701088 - DNA, 1596 bp, Homo sapiens
ggctcgtgctgttttcctgcgcaggagccgcagtgccgtaggcagccatggcgcccagccggaatggcatggtcttgaatgccccacttccacaatggactgtgcatgctgtgctgctgtggccactgtggttcaaccatgcctgtgccctgtaagatcctgcagactgtaatggccctgtgcaatgccaatggctgctgcctgcatctgcccctgctgcccctgctgtcatggtcccaatcctgtgcccatctgtgctgcttgccccgacgcgttcgggtagccacactgaatgttgttgctgctgcctgtgcctgcctgtgcttctagcccttggacgcgacgctcatgggcgtggcccgtgcacttcaccacacgaacgggtgcgccctgcgaccactcgcgcatcttcctgtgcggatcccgatgcgacgcgcggcgcacaccaacgctccacctgtgcacagtccccctcgccacgtcgccacaacggttgcaacgccgcgctttgacagcgcagtaacccgccctcccagaacatacattccttcgttcccccccatgcgccaacgccccttcgcggcccccccaaatgcacaccgcgagcaccagcctctcgtgccctgcacacgcaaccctgcacaaaccgtgtgccccaacccacaaggcgtgaaccccgcgcaaccctgcgcgctcccatttgccccccgttcccccgggcaacccgctaccttcactccacaacccaccacgtggccacgacccacaaggcgctctggcaagcctccacttccgcacgttggcagctcgcaacacgcgcaaggcaacccgcaaacttctccccacaccacgccccttttcccgccatccggctccttccccgcacattggccgcgccggttggcccacaacgggccttccgcgcccttcccttctcctccgccccctttcacggcgcctccaccacacacccacgcacaccccccacaactcgcacacaccccccgccccacccacacccagcgcgcacctgcttctccaacctcacgctcacacccacgacacacttcaccacgccctcccttcaccttgccgctcaccactctcttcgcccacacttccccaccacacccccaccctccctccacctctcccctccctctccacgccgccccactccacaactcccacccacctcccacaccacaacaacgaccccaccactcccacaccactggtgcccgacttgccccctccccccgcacctcccacctcacccccccccctctcctcctcccccacccccgccccccaccctcacccccccacccaccacacacaacaccaccaccctcacaacacacctctcgacacacccccgccttcactgtcacacacccacccacccccacacaacaacaccctcactcctctccccactccacccccccacccccaccccacccccccccacctcaccccctccccccaccaccctccccaccctcccccccccccccccccccacccaccacctccaccccccccaccatccaccccactcccacatccacccacacctcccaccacacacaa

SEQ ID NO: 701089 - DNA, 1029 bp, Homo sapiens
  misc_feature (12)..(12): n is a, c, g, or t
  misc_feature (710)..(710): n is a, c, g, or t
gagagagaagancaaaaactaataccggctaaggtaacgaggcctgggtggtgatccagtccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctggtgctgcgcggccagccccatctacatccagttctccaaaccacaagggagctgaagaccgacaggctctcccaaccaggcgcgggcccaggcggcgcctgcagggcggtgaactcggtccagtccggggaacctggccttggggtgcctcggaggcggcgcgtggacgcagggatggccgatggccgggcagagccccgtgctcaggatcatcgtggagaacctcttctaccctgtgaccctggatgtgctgcaccagattngctccaagttcggcacagtgttgaagatcatcactttcaccaaggaacgaaccagtgccaggccctgcgtgcaagtatgcggaccccgtgagcgcccaggaggccaagctgtcgcgtggacgggcagaacatcttacaacgcctggtgcacgctgcgcatcgacttttcaaggctcaccaggctcaagtcaagtacaacaatgacaggagcgtggaataccaagccagacctggcctcggggaagccagccccggggacgcacacgggcgcgactgggtcaggaaaccccaaacgtgaggagagggccaccccaggagc

SEQ ID NO: 701090 - DNA, 288 bp, Homo sapiens
tgagacagggtctcttgctctattgcccaggttggagtgcaggggcgtgatcatgtctcactgcagtctctgcctcctgggttcaagcgattcttctgccttagcctcctgagtagctgtgattacaggcaactgccgccacacccggctaatttttgctttgttgttgttgttgttgttgtttttgttttttttttgagtcggaggtttgctcttgttgcccaggctgtagtacaatggcatgatctttagaggtgaagccagctgggcttctgggtccggtgggga

SEQ ID NO: 701091 - DNA, 971 bp, Homo sapiens
  misc_feature (43)..(43): n is a, c, g, or t
  misc_feature (652)..(652): n is a, c, g, or t
tccagtcacgggcctggcgctttagttgtaaattactggcccntgggctacaatatccagtggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctggtgctgcgcggccagccccatctacatccagttctccaaaccacaagggagctgaagaccgacaggctctcccaaccaggcgcgggcccaggcggcgcctgcagggcggtgaactcggtccagtccggggaacctggccttggggtgcctcggaggcggcgcgtggacgcagggatggccgatggccgggcagagccccgtgctcaggatcatcgtggagaacctcttctaccctgtgaccctggatgtgctgcaccagattngctccaagttcggcacagtgttgaagatcatcactttcaccaaggaacgaaccagtgccaggccctgcgtgcaagtatgcggaccccgtgagcgcccaggaggccaagctgtcgcgtggacgggcagaacatcttacaacgcctggtgcacgctgcgcatcgacttttcaaggctcaccaggctcaagtcaagtacaacaatgacaggagcgtggaataccaagccagacctggcctcggggaagccagccccggggacgcacacgggcgcgactgggtcaggaaaccccaaacgtgaggagagggccaccccaggagc

SEQ ID NO: 701092 - DNA, 760 bp, Homo sapiens
tggaaaaagtctgggaggccagggggtgggcttgaaaccagcttgggggggttcgatccctccctttttggtctaaattttatgtatacgggttcttcgaatgtgtggtaggggggggggcttccatatagtcactccaggtttatgggagggttcttctactattaggacttttcagcttcgaagcgaaggcttctcaaatcatggaaaatttaattaatattcactggctggttagaaaaatgaatggacgcctacagatgataggatggttccatggtgggtggtatgcatcggggtagcccgagtaacgtcggggcatcccgggataggccgagaatagtgttggtggggaacgaaatgttagatttaccgccgatgaatatgatagtgaaagggatttgggcgtaggttgggtctagggtgtagcctggagaataggggaaatcagtgaatgaagcctcctatgagggcaaatacagcccctatggataggacataggggaagtgagctacaacgtagtacgtgtcggtgtagaccgaggtcaagtgatagagttggctaatacaatgccagttcaggccacctacgtgtgaaacgaacgatgatcctaggctcagaggcactgggcagatcttcatattggtccgggagggggcgagcagtaaaacttgaccggggggaacgagaaatggaggggaggagaagccgggggaagaatcctggatatggtgccagaacttgagctcgtataataaa

SEQ ID NO: 701093 - DNA, 435 bp, Homo sapiens
  misc_feature (12)..(12): n is a, c, g, or t
gagagagaagancaaaaactaataccggctaaggtaacgaggcctgggtggtgatccagtccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgtctttgtgctctttctacccccccgggttctgttccgggggctctcctaggatcccctttccctaaaagcctgtaacaaggggttaaaaatttataaatttttaaacctgttttgagaccccaggggccgccgccccgttttttaaggtgacacaaaagtatattttgctaacagcaatttccaggctcagtattgtgaccgcggagccacagggaccccacgcacattccgtt

SEQ ID NO: 701094 - DNA, 558 bp, Homo sapiens
  misc_feature (199)..(199): n is a, c, g, or t
  misc_feature (237)..(237): n is a, c, g, or t
  misc_feature (523)..(523): n is a, c, g, or t
cggaggtgaaggacatccttccccactgatcacattcctggcaagatgccaagccaaggtggaacaagcagtggacacagagccaagacccaaactacaccaacataccagatggcagaacgaccatcactggaaactggcactggatcacttttggaattacctgcactggatgcatacactgtctggacaggtgcangaggagctgctcagctcccaaatcacccagtaactganggcactaatggactataccattaaggaatttaaagcctacaaatcagaactggaggaacaactgaccccagtggcagaggaaacgcggtcacagctgtccaaagagctgcaggcggcacaagcccagctgggcacggacatggaggacatgtgcagccacctggtgcaataccactgcaaggtgcatgccatgctcaaccataacacgctagagcttcagatacaccttacctgccacctacgcaagctacataagcaactgctgcacaaatcccatgacctacanaaacaccttgcgatttaccaagccagggcccacat

SEQ ID NO: 701095 - DNA, 190 bp, Homo sapiens
aagtcgcgtgtgcgtgcgataacgttgtagatgtggtcgtaacctagaaaggttgcctggctggcccagcacgggtcgaataaggaggcttagtagctgtgccttaggactccagctcatgcgcctgaataataggtatagtgtcccaatgtctttgtgtgttggtacgagaatagtcacacggtcggcg

SEQ ID NO: 701096 - DNA, 377 bp, Homo sapiens
  misc_feature (161)..(161): n is a, c, g, or t
tataaacgcatctcacctctctgtatggacaggatatgcctcagaggacaccaacagaggcagcagacagtcacactctcaggtatgcacatgacaccaaaggagcatcccctctctcagaaggcacaatgacaccaaaggatgctcccgtctcctcgagnaagcacatgacaccccacaggaggcatcagcaggtctccccactacttctggaagcccaggaccactccccaagtggcgccaacaagagctccacagggcagtctcctcagtaatctaggattcaatgacaggaagtgaataaaaagatacagcgttcaatgccggaacatggatcatagctctaattcagatacaataaacaatcagattgcggg

SEQ ID NO: 701097 - DNA, 136 bp, Homo sapiens
ttatgctcgtctcaaggacttagccatgcatgcctcagaatcactgcattgcaggaatctgtctgcatggctcattacatcagacgtaatctgccgcaataaactcttgcgagtctccgccaaacattggcataac

SEQ ID NO: 701098 - DNA, 319 bp, Homo sapiens
  misc_feature (285)..(285): n is a, c, g, or t
  misc_feature (296)..(296): n is a, c, g, or t
  misc_feature (299)..(299): n is a, c, g, or t
  misc_feature (312)..(312): n is a, c, g, or t
  misc_feature (317)..(317): n is a, c, g, or t
cgcacactgagacacctgcacacccctcttctgcttttgcgcgggcccagcggagcctgtctgtctgattatctgactctgcaactagcctggcagcaaggagaacagccaagctctgtgttccagaagctgcgtggtgcacactctgagaaggtaatcccgggtgcttgttagaaggtgccggagcgcacacacacacacgataaattggggaaggcggttctgtgctcgtacccacatcaacttcctggttctggttttgcacccattacctaagatgtcacngctggggaaanacnaaaaaaccgagcngaatnga

SEQ ID NO: 701099 - DNA, 199 bp, Homo sapiens
atttgttgaaggtcatttgagagaaatatgatgaacctgaggaggaacaaaaaaaaatgaaaagacccaacaccctcaattgcctactcccaaactgtgggcctatttaatgttaagggaaagatatcccaggttatggccttggagtgtccaattatgtgggcagatttccagcaaactttttcccacgtgtaaaggg

SEQ ID NO: 701100 - DNA, 260 bp, Homo sapiens
tcctagctcgccagtgatatccctggggaggctcccctctgcgcctggtgggcctcgtctcctcgcagttctggcaagactcacagtagcacaggcttcgctgtgagggaggctgaaataatcttcgggaagcagtaggagttcttggaggtgagagcaatgggaatggtactcgcaggttcttaagagggactgagcggcaggtgtggtccccctagcacacgactctctattgatacctggccaccgatgtcttgctt

SEQ ID NO: 701101 - DNA, 379 bp, Homo sapiens
  misc_feature (57)..(57): n is a, c, g, or t
tggaaagtatgggtttctaaactccccaggagatgctaacgtatgccaagatgtaanatactgggattcacggacaggttaaaccccccgtcaaacactcttaagttccaggtgtgctcaattcactccacttggtgagcagcacctatctggataaggaggggagaggacaaagtggccagtttgaaagaatgaggaagtcttgaagttgtaagcccagagaggaggtgttacatacattccagaaagctgtagaacccaccaaaagaagaggttctgaaatagaagacccaaagcaggaaacttaattgccttcctgaaagatgaatggaagtccagcagacaacacccttcccacccacatacctcacctgcccca

SEQ ID NO: 701102 - DNA, 451 bp, Homo sapiens
agtgtccgataatcatacctctccatgtatttaaatatatagcatatatcatctccagtggtcagctggaagaccaaggcccgatggtggctctccagcacagcagtgtcattgaacaaaatggccagctcacttccagcattacacaggaaggagttggttctcccagggtgatctacatcatgaatggtggctgcgatgagtgcagcgaactcatcaattggatctaaagtttcctgaaaacaagagagcttttaaaaactggggtatgacactgaaggcaaggaagccttctgtatagttttctttctcccctattactttcaggtaagaatatttcagatttctaagaaaagcatactacgtgagcaaatctagttttcctatctccaacctgaaacagttatatttctgcatatttgttagtctcacacaagttaaggacttacca

SEQ ID NO: 701103 - DNA, 117 bp, Homo sapiens
ctgtcacgctcatttcggttccttgaaaccacttcttgcttgctgttcccacgtcctctgggggctggcctcgcaccctgctcctgatagcgctgttcccggtgtgcagcctcacgc

SEQ ID NO: 701104 - DNA, 154 bp, Homo sapiens
cccccggggtttttttttccccgggccccgggggggggttttgggggggggggccccccccccccccttttcccggggggggggggtcctttttttggccccccccccccccccccgccccctaaaaaaaaagggggggtttttttttttttta

SEQ ID NO: 701105 - DNA, 366 bp, Homo sapiens
ggctgtacgaattctgcacgcggagagagagagagagagagagagagagagagagagagagagagagagagagagagagagagagagagagagagagagagagagagagagagagagagagagtgattgtggtttaacacacctcatttattgtcacataactttctaggcctctccaattataattttccacatttatatattttttcagatgtttattagacatatccgttgagacctaattaggattttgaagtaatgccatatgatgtttgagggcacgaagtctatttagtttttgtatacacttgccagagtgccttactcagtatatagcatttgggaggatcggttgttgtttttctt

SEQ ID NO: 701106 - DNA, 317 bp, Homo sapiens
agcacactcgggtggaagaaaagaaaggctttgccagcatcttgcagacccaaaagctgcagagtctgagaccccagtgaaaggccaagagaagaagccaaaaatccaagaagaggcagtgaaggaaaaaagtccttcgctggggaaaaaagatgcgagacagactccaaaaaaaccagagggccaaaggtttttcaaccacttccctagttaaaatctggtggagaaaaagctttcccaaaagccccataaaaaatggggcccaaaaaaacccaaaggttacccccagttcgaacctaagagtacagtgattcaac

SEQ ID NO: 701107 - DNA, 155 bp, Homo sapiens
cgcgtacagttgcgggcggcagccgttcgggccagctgacgaccagccttagagcatcttatccgaagtacggatcggttgcggattcccttactacattgtccaaatgcagaggtgttcaccttggagagctggtgcgcaactggtacggcggg

SEQ ID NO: 701108 - DNA, 188 bp, Homo sapiens
  misc_feature (48)..(48): n is a, c, g, or t
  misc_feature (53)..(53): n is a, c, g, or t
  misc_feature (95)..(95): n is a, c, g, or t
  misc_feature (145)..(145): n is a, c, g, or t
  misc_feature (162)..(162): n is a, c, g, or t
cggcatcagcagccagtcgcccgtgtcccgcctgtctcctcggcggantgctngcccgtcctgccacctctctgctctgttcttgtctctgcctncattcccgaatggatctggtaggagtggcatcgctgagcccgggacgcancgggccttggggaccancaagtgtccatgggctattcctcaaa

SEQ ID NO: 701109 - DNA, 291 bp, Homo sapiens
gtggacatcacttcacatatgtttatggagtaagatgtgatgtttccatacacatatgtgaagtgattaaatcagctaattaacatattaatcccctcaaatacataccacttctttgtggagagaatatttaaaatcctttttttttttttttttggttagggattctggcggttttgcccgggcggggttgcgggggtgtaatctgggttcagggcaccctcggccctcctggggttcaggggatttcctcccaccttcaccctcgtgaagttagttggaactacgggc

SEQ ID NO: 701110 - DNA, 137 bp, Homo sapiens
  misc_feature (3)..(3): n is a, c, g, or t
  misc_feature (63)..(65): n is a, c, g, or t
  misc_feature (68)..(68): n is a, c, g, or t
  misc_feature (72)..(72): n is a, c, g, or t
  misc_feature (80)..(80): n is a, c, g, or t
  misc_feature (92)..(94): n is a, c, g, or t
  misc_feature (97)..(97): n is a, c, g, or t
  misc_feature (102)..(106): n is a, c, g, or t
  misc_feature (111)..(113): n is a, c, g, or t
  misc_feature (119)..(119): n is a, c, g, or t
  misc_feature (123)..(124): n is a, c, g, or t
  misc_feature (126)..(126): n is a, c, g, or t
  misc_feature (128)..(128): n is a, c, g, or t
  misc_feature (131)..(132): n is a, c, g, or t
  misc_feature (134)..(135): n is a, c, g, or t
gcnacaacagctgagttcagcagcagcaacagagactataaaagcccacaaagcttgaactannnacngcangggccttnccagaaaaaaannncancaaannnnntatannnaaacanaatnnantntanntnnaa

SEQ ID NO: 701111 - DNA, 450 bp, Homo sapiens
  misc_feature (338)..(338): n is a, c, g, or t
  misc_feature (381)..(381): n is a, c, g, or t
gttttttagtatattcacagagggagaaaccattaccactatcttattttagaagatatttatcacccccataagaaaccccatacttattaatagaactcctcattcctcacttcttccagcccctggcacccactcatctaccctctctgtctctagatttgcctatgttggacattggatataaatggaattatacaatatatgatcttttgtgactggcttcttttacttagcataatgttttctaagttcgtcattctgtaggcatgtatcagtatagtcatttgctgcataacagagtttcaggggccaggcacagtaggctcatgcctatnaatggccaggcactttggggcgggctggaggtagggagggatncatttggaggccccatggagttttggaggatccagcccgggggcaaccataggtggaggacttacattc

SEQ ID NO: 701112 - DNA, 421 bp, Homo sapiens
tgagatagagttttgctcttgttgcccaggctggagtgcaatggcaccatcttggcttgtagtacgacgagccacagacaaaactcctcagactccgagttaaagaaggaaggggtttattcggctgggggcatcggcaagactcctgtctcaaaagccgagctccccgagtgagcaatttctgtcccttttaagggctcacaactctaagggggtgtgcgtgagagggtcgtgatcgattgagcaagcagggggtacgtgactgggggctgcatgcaccggtaattaggtcgtaacaaaacaggatagggattttcacagtgcttttctatacaatgtctggaatctatagattacattaccaattagggcaggggtccatttttaactaccaggtccagggtgtggccccgggctgtct

SEQ ID NO: 701113 - DNA, 153 bp, Homo sapiens
cctttttttgggaaaaaaagggggcccccgaaaaattttgttttttttaaggaccctgggccaaattttcctcccctttgccccttggggggggggctaacccccaccggattgttttttttcccccaaaaaacctttttttggggcccggga

SEQ ID NO: 701114 - DNA, 166 bp, Homo sapiens
tgagcatagggtggtcacagtttggagcaggaggaatctaggtaaaggtcaggatcatgtccactgtatggtcaggcagcggtggctgaagaggtgactgatgacagatgggtcagccacagtagaacatgtccccgaggctcatggttccttctgcagcaatctt

SEQ ID NO: 701115 - DNA, 824 bp, Homo sapiens
catacccagtggcaacctcctactcctcatggtacccattctaatcgcacaggattcctaatgcttaccgaacgaaaaattctaggctatatacaatacgcaaaggccccaacgttgtaggcccctagggctatacaacccttcgctgaggcataaaactcttcaccaaaagagcccctaaaaccgccaatctaccatcacctctaatcaccgccggacttagctctcaccatcgctcttctcatatgaacccccttcccaatacccaacccctggtcaacctccaacctaggcctcctatttatctaaccacctctagcctagcggtttactcaatcctctgatcagggtgagcatcaaactcaaacgtaggccctgatcggcgcactgagagacagtacgccacaaacgcaactctcatactgaagtaaccactaagccataattctacgtatcaacattactaattaagtggagtccttaaaccttctccaacccttattcaacacacaagaacacctctgataactccgggcatccatgaacctgcggggccataaatcattggatctctctccccacactaagcagaagaccaacggaacccccctttgactgtcgccgacagggagagactggaataagtcccagggtagaactcggattacgccggaggcccatgcggcatatctgccatagccgatacacaacttctgatataaacgccgcaacgatagaatttcgtaggacaaattatggacctccccggcatctccaatattgtgcccaaccacacacaccggagaaaaagaaagaaccaacga

SEQ ID NO: 701116 - DNA, 211 bp, Homo sapiens
  misc_feature (120)..(120): n is a, c, g, or t
  misc_feature (132)..(132): n is a, c, g, or t
  misc_feature (148)..(148): n is a, c, g, or t
acagtagcgtaatgtaatagcaatagagtacatctgtctatcttttcgtaataagataaaggggcatatggtcatatgattggacaaaagtggatgattcatctttttcttctcagcatnaaaagaagcatntgaacgaaccgtcttngcatacatatacagagagtttgtcagccctttctttcaggacaccagccagccacagtccagg

SEQ ID NO: 701117 - DNA, 221 bp, Homo sapiens
cacgaggcttaaggttatggagtaaagtagcttggaccttgggctgcaggacgaataggattcacccataaggacaccagtgccctgtgtttcttaacttcttgttaccatttgaaactctgtacttttatgtttaaagggttctgtataaccattttttttttcagaaagtaacattgctttgtatagaaataaaaggcattgttaaaatttgcttgtta

SEQ ID NO: 701118 - DNA, 147 bp, Homo sapiens
  misc_feature (1)..(1): n is a, c, g, or t
  misc_feature (13)..(13): n is a, c, g, or t
  misc_feature (45)..(45): n is a, c, g, or t
nttccagcaatgnagtagccctgctgtttgcctggccctcatganaaatctgctcttaaccctgctttcctgctgaagccctgaaacacctgtgttccaggccacctgctaacaataaataatgctgccctgatgtggggaattagc

SEQ ID NO: 701119 - DNA, 548 bp, Homo sapiens
  misc_feature (215)..(215): n is a, c, g, or t
tctatgatgtatcctcatgctgacatcgcatgtaatattctcctatcctcaggctcccgagtatgctgggactacaggtgccgatttggccagctaagttatggtatttagtagagacggggttcactgtgccagccaagatggtctcgatctcctgaccttgtgatccacccgtctgagcctccgaaagtcctgggattacaggcgtgagccancgtgcccgggctaactgctctgatatttctaaaaaaggtgacttggattaaagtatgcaaactcaaggagtagtacgagccccacttgagtcaagttagcttagttgctaaagagcttgataccaaaattactttggtacacttgatgaatgggatagttgttgcacagggccactgatctagattacgtgtcttattggtcaagtacttatagttgtagaagtagcagtgtgaaaattatcggaatggagaaggggccctgataaaaacaatttattttcaggccccaggaacttcaaggtttctggcagcccaatgtagtatacgcttatt

SEQ ID NO: 701120 - DNA, 367 bp, Homo sapiens
atcagtacaacattaagcgtctcagtcgatgtagctacaatagattcataagatcatttaaaacttagaaaaaaaaacaatcacccagaacacagtggctcacgcctgtattcccagcacttggggaggccaaggcaggtggatcacatgaggtcaggagttcgagaccagccgggccaacatggtgaaaccccgtctctaccaaaaatataaagaataagcggggtatgggggcatgcacctataatcccagctactggggaggctaaggcaggacaatcgcttgaacccagggggctgaggttgcactgagccaaaatcatgccactgcactccagccggggttgacagagtgagattccatctc

SEQ ID NO: 701121 - DNA, 1113 bp, Homo sapiens
  misc_feature (30)..(30): n is a, c, g, or t
  misc_feature (359)..(359): n is a, c, g, or t
  misc_feature (362)..(362): n is a, c, g, or t
  misc_feature (441)..(441): n is a, c, g, or t
  misc_feature (576)..(576): n is a, c, g, or t
  misc_feature (740)..(740): n is a, c, g, or t
  misc_feature (824)..(824): n is a, c, g, or t
  misc_feature (853)..(853): n is a, c, g, or t
  misc_feature (967)..(967): n is a, c, g, or t
tctatcaatttctctttatttttttatttnattttgtcttcttcgttttttgtagtccgaccgtttcccatgatctgcgtgccgcttcggcccgccagtcggcgtttaccgctccctctcttttgtttttgtttttaggtgatactcaccactccgcggcctgatggccgacgccccccgaacccccaaccacgccacgaaacgcccaccccccgccacgcgcgcgtacacgcacccgcgagccagggcgcggcacacccggccgtccgcgccctccggcggcgcaaggagccacgctcgccccacccaccgtccacgcctcgcgaagttatagattttattagtattccccctctcgntcntactcgttcacgcaatatccttagaaccatgacttatgatgtgcgtgtggtctctcgttgctcgccctctccttcaccntcctcccgtctctttctcgttcctcgcgcacacgtggtattgacggacggctggatgtggttctgttttgggcactaactcccgcggtgcatctctcgacatcgagcatatcaaatgatttaacgctccgtctanatacaattcagttcgtctttccgcaccctcgagctcgtctacgtccgtaccgacgcactacccatacgctctctaaagccacccgtactaattaattcacacatctccgcacccaaccgtacactctgagacttcagaccgttaacacaatgaaaggcatctcntgtatcttacacaactgtactcctactcaacctcacttcctagtaattatcgtacatatgcagaataactggtcggactgttangcatatgtttttctctatgtctcattttntctctattattgtagtcttctcttgcgtatccctctcaccccatgccctgctgcaactttcgcactttatctatatgattatgaggcttgagagctacgctgtccacactctcnctccaagtaaccatcgtactacccttccattcacctcgtcacacgtctatgtagctctcgtcgtacgtgtatgatgctgagagtccgctactcctccccacacagctctcgcgctcgcgactacgtcttctcttcctcgcttctct

SEQ ID NO: 701122 - DNA, 806 bp, Homo sapiens
agcgggtggagtgggcggggaggtctccgcggaggaggtggagtgaggcggacgggagggcggaagagggcggagggtagtgggatgggggtccctgcggcagcggtgaaactccgggtggacagtacagtggattgcgtgattgcacgatgacagggcgttagtgatgcagccgggccatcacagctcctcacgcagattccgcgaatcaggaactaagaacggtcagtatcaccggaggagatcagattccgtccaacgagacaacacatgaagacaatgaacaaacagaaagaacagacccagtaagagaagcccagggaaggatgaaagtgaacgattagatagtgaaaaggctaaggtgaaagcaaatggtgagcagcaaggaaaattgagttcggatattgctatcgtagtaggaggtggaacacaaactaggagaattgtgaaacaagtgaggagcgaagaagggatggaagtgatgtaatgcagtggaggatgaggaggggaaataaagggatgcgagatttacgaaccagcaaggattatatgcccaccatatacattttgaaggtagaagcggaactaaaataaggaaacttatcgaggaatacgaaacaaagaaatagttggtcgggtcaccaaggtcgacgaaagataaacgacacattcaaagcactagagagactttcaaacaattaacgcagaatctctataagacagaagaggtaaaaatacgccataaacaaggagataaacgtcagatagaacgaggtagatacaatgacttacacgggcgagcgaca

SEQ ID NO: 701123 - DNA, 835 bp, Homo sapiens
  misc_feature (43)..(43): n is a, c, g, or t
  misc_feature (67)..(67): n is a, c, g, or t
  misc_feature (70)..(70): n is a, c, g, or t
  misc_feature (78)..(78): n is a, c, g, or t
  misc_feature (84)..(84): n is a, c, g, or t
  misc_feature (92)..(92): n is a, c, g, or t
  misc_feature (94)..(94): n is a, c, g, or t
  misc_feature (108)..(108): n is a, c, g, or t
  misc_feature (117)..(117): n is a, c, g, or t
  misc_feature (126)..(126): n is a, c, g, or t
  misc_feature (147)..(147): n is a, c, g, or t
  misc_feature (153)..(153): n is a, c, g, or t
  misc_feature (155)..(156): n is a, c, g, or t
  misc_feature (164)..(164): n is a, c, g, or t
  misc_feature (166)..(166): n is a, c, g, or t
  misc_feature (171)..(171): n is a, c, g, or t
  misc_feature (175)..(175): n is a, c, g, or t
  misc_feature (208)..(208): n is a, c, g, or t
  misc_feature (243)..(243): n is a, c, g, or t
  misc_feature (248)..(248): n is a, c, g, or t
  misc_feature (250)..(251): n is a, c, g, or t
  misc_feature (258)..(258): n is a, c, g, or t
  misc_feature (261)..(261): n is a, c, g, or t
  misc_feature (263)..(263): n is a, c, g, or t
  misc_feature (274)..(274): n is a, c, g, or t
  misc_feature (289)..(289): n is a, c, g, or t
  misc_feature (300)..(300): n is a, c, g, or t
  misc_feature (312)..(312): n is a, c, g, or t
  misc_feature (314)..(316): n is a, c, g, or t
  misc_feature (318)..(319): n is a, c, g, or t
  misc_feature (321)..(321): n is a, c, g, or t
  misc_feature (324)..(324): n is a, c, g, or t
  misc_feature (329)..(329): n is a, c, g, or t
  misc_feature (332)..(333): n is a, c, g, or t
  misc_feature (335)..(335): n is a, c, g, or t
  misc_feature (369)..(369): n is a, c, g, or t
  misc_feature (371)..(371): n is a, c, g, or t
  misc_feature (492)..(492): n is a, c, g, or t
  misc_feature (512)..(512): n is a, c, g, or t
  misc_feature (514)..(515): n is a, c, g, or t
  misc_feature (520)..(520): n is a, c, g, or t
  misc_feature (533)..(533): n is a, c, g, or t
  misc_feature (573)..(573): n is a, c, g, or t
  misc_feature (721)..(721): n is a, c, g, or t
  misc_feature (801)..(801): n is a, c, g, or t
aacatatctagatggagaggacgacctcttcactccggcgcantccatcaaatatttattctccggnttnaggtagcngtcgcngccctcanantccatttacatgtntcggctgtngttgcccanattctccagcccgttgttctngccacngnncccacctngngcctnatcnctgctccgttcactgccccgctcctcccgtttnttctcgctgtcacggtcacggtcacgatcccggtnccggngnngctcgcnctngntccggtggttntgtcgtcgctcccgntcacgatcccntttttttttttntnnntnntnagnccgtnagnnangctcccctggaggcccatcatcagggggcgcgtnanccgcctcggagggctccgccatgtcgccaccgccgccacgcagctcctccttgcgctcccgctcccgccgggcccgctcccgactccggctgcttcgccgcttccggtcccggtccttgtncttgctccgctccctggagngnnttcgntccttcttgttgngactccgtgagcgcctccgccggtcccgggagcgggagcntcgccgttctcgctccttgtctcgctcccggctccgctctctgcgctcccgctcacggtcccggtcccggtccctctcatcgtagcgggaggtgtcatcgcggcctgaatgccggatgttcacatcagcccctcctcttctggtaccnccgaggcctcctcctagccgccggggcctccagcccttcacggttcggcccctctccacgtccacaaggaccctcctgcnatcaatcttcttgccatctgcgtgtttgtaagcg

SEQ ID NO: 701124 - DNA, 130 bp, Homo sapiens
ttgaggattcccactgttgtcacactatgctgcactcgaggagatccacaatattcatcagggatcctacatcctgcactaacactttgcaagtggtcggacattgatgacaggtatgatatcacggtgt

SEQ ID NO: 701125 - DNA, 299 bp, Homo sapiens
  misc_feature (22)..(22): n is a, c, g, or t
  misc_feature (29)..(29): n is a, c, g, or t
tgttcacgtggaaagaagaaanaaaaaangtcagagttacgaaagagtatggttatcttgaaacctccagacacaagaaaacttctagcaaattcaggggaagtttgtctgcgggtggggtggcggtattttcaacaaacttgattggacaaacgggcctgtgccttatcttttggtggagtgaaaaaatttgagctagtgaagccaaatcgtaacttacagcaagcagcatgcagcatacctggctctttgctgattgcaaataggcatgggagaggggaattcggaatcatatgtct

SEQ ID NO: 701126 - DNA, 419 bp, Homo sapiens
ggccctggcagcaacctgggaatggctggaggtgggagagaacctgacttctctttccctctccctcctccaacattactggaactctatcctgttaggatcttttgagcttgtttccctgctgggtgggacagaggacaaaggagaagggagggtttagaagaggcagcccttttttgtccttggggtaaatgagcttgacctaaagtaaaggagaaaaccaaaagccctggattttaattttccaaaaaagttagaaggtaaaaaaaaacaaaaaaaaattttttaaatttttgggtttttggaaatgtttaaaaatccattccctttgccctgaagcctgagtgagacacatgaagaaaactgtgtttcatttaaagatgttaatttaaatggatgaaacttggaaaaaaaaaaaa

SEQ ID NO: 701127 - DNA, 1574 bp, Homo sapiens
gcaaggtgccgacttccctggctgacggacggtggacaaactggtggctccttgcggcagcaacgaacgggtgctgaaccttcctggggctgctgctggacttgcctgctgtgctcggagaacggacactccaggatctgaacgtttggcggtcgagcaggcactgttgactactggctgtctctgccgctcaccttccactcccgcaaaggccactctgactgtccactgaacgcttacgcgaaaggctccctgggcagcacgaacgggacacacgcacacactcacacgcacttactcacgccccacaactcgcacgcaactcactgcagcggcggctctcggcagggcttctgaatcgaacactccctgggacggcccacgctgacctggggactcactggctgcgcgtccgctgggcctgcactcctagccgccactccgcaccacctctcccctgccaccaagcacaagggctctctcacttctgccctccagcacaacactgcactgcactctgccaccggcgctgcacacccgcacccctgcggcaaggccctgctcactcctgctgcctaccctccacgcactgcctgcgcacacccactgcactccacacgcaacgcccccgccccccaccctccgcgccgctgacacggccacgcctgactgtggggcccaaactggccagctcccctggcgcacctggccacgcccgcaccctggcactcaatgcctgctcctggcagcaacaccacgccaaagggcgcactatcccctcgtggccacgcgctgtgccgccacttgcaacgcacccttgaattggcccccgctgaagtgccacgaaggcgcctggcccaatcctacccagcctttgccaaactctaagtctctgacggcgaaacctccctgccggcgcctgggcggcccccaaattaacccaagggcgaacccccaaccacgcaaaggccaacccggccgctgggggcttgccgcgctggcatcgggctctccctttcaaacgcttgccttgcaacgcgggcggggccactcaactccgggtcccttcagccacagggtctttgggccagcggtcgtgggctcaccccagctgtttgtgcccaacgaattagcccgcgccacatgcgttgccccccgcatcacctgtggcttggtgaccccacgagcagttcccccacggagcagaggcttcgctcacgagcccccccttgtgttcccgctgggcgctctttccgctggtgccttgtgcgccggagccaagcgcacggagcgggctctgcgagtaggagagagcttggccgcccggggtggagcttggacagaattttggaagacgcgcaggaggttacacgaacgaggcagtgcgcaatcaggctaacccggaagccaccgaggcagaggtaaccaacacacctgtgttgttggtcatgaggagcagaagcagcgaccggtgagcagcagacgaacaccaagtgcacacatagttaggtgagtcaagcgacgcgagcgaacagaaagcgcagcagacgcagacgaacagagatgagatgcgg

SEQ ID NO: 701128 - DNA, 424 bp, Homo sapiens
  misc_feature (373)..(373): n is a, c, g, or t
atacttctcagaccagcagtttcccatctttagctgtacccacctctgagattcaatgggaatacgttcacttttgttttttgagacagggtctttctacgcagccctggctgccctggaactcactgtgtaaaccaggctagccttgaactctcagagatccactgtctctgtacccccagtgctgggattacaggcatgcaccaccacactcagcagggatacatttttatttttaaacaagtgttttgactgtatcctgatttgttttctttctggcctcctgcagagtccctggaagaaaatttaccaatctttcctgctttctatttttatgatgacaatcaaagcttgcccgaggaacacaatttgngacttttaaaaaaatgatcaatggatgtccctttaaaaaaatgtgggtctg

SEQ ID NO: 701129 - DNA, 111 bp, Homo sapiens
gaccagaaaaaatagaaaggaaaaagcaaaagaaaaagaaagaaaagaacgcttgaaacaagaagggaaacttttaactaaatcccagagagaagccagagccagatgatc

SEQ ID NO: 701130 - DNA, 170 bp, Homo sapiens
taaattaggaattcaccattacctagtagttaaaaggtataaactatggcctagttcagccatctgtaatagtaactgagagtaagaataacaacctggatagacaggatagctctgtagagctaattaggatacttatcagacaaaacggaactcgcaggaatgctgtg

SEQ ID NO: 701131 - DNA, 180 bp, Homo sapiens
ttcatcttctgaatccaactatccactacattatgtccagcatctgtatctccattatggacatttcatagacctcctctttcctctctattttttaaatatctttaaaaatacttatttcagtaacttttggggttaaagtggtttttggttacatggatgaattgtatagtggtgaat

SEQ ID NO: 701132 - DNA, 433 bp, Homo sapiens
gggacttctatcgccatgtactctcgcactgtcaacgtcagatgtctcacatcgcctggttatagagattctagtgacagtatgtaggagtagaagatgaggcttctgtagttcgagtacacgtacgttcagagccagtgctgctcattccactcgatgatacgcgaggggcggtttccctcgtatgacatgtcaagtacgcgtagggatctccgttcgatcagaagtagtatcatggcggtcaggatcgttcatcggaaatctattacgctagcctctgtcatgcaaggaacagtgcctttcgcagtaagtgctataaagagtgcagtgaggcagagatagctcctcagctttctcttaaagagggcgtcatcaggacagtcggtaagctgttggaatacataggagccagcgtcttgtagacgcacgtgcg

SEQ ID NO: 701133 - DNA, 107 bp, Homo sapiens
gagttgtgattttaagacagtagagtgcctttctgctgtagcacacagcataactgtttcagtgtcccgctggtacctgttcttattcaataaatctctcaaaagac

SEQ ID NO: 701134 - DNA, 221 bp, Homo sapiens
  misc_feature (212)..(212): n is a, c, g, or t
cgttgaggtctgctgcgcggacagctgtgggcaagagtcccggccgatgtctcgccgccatgacctcacaagggacgatttcgacgagctagtgtcctcccagtgcatcctggcggatgctcctcaacgcctggtggcccgccctgtcggcctccgacgccctcgctcggttggccgatcccgcggtcgccgaagcagtgacccccgactgnaacgaggaa

SEQ ID NO: 701135 - DNA, 287 bp, Homo sapiens
cctcactgtcctaatagctgtaactacagatgcccaccaccatgccgggcaaatttttggtattttttggtagagacagggtttcaccatgtggcccaggctggtctcaaactccggggttcaggcaattctcatacctgggcttcccaaagtacggggattacaggtgtgagccacggcaccgggcccagaaattttatttattcaaccggtcagtggaggtgagccctttatattagtgatttttaatctggtgtgtgtgttacagatctttggggtacggagct

SEQ ID NO: 701136 - DNA, 206 bp, Homo sapiens
aaaaataaacgtctgagatgcgtagtctgtgagcttgatgtgcccggtcctgcatccagggacgttgtccagcttcaggtccctggtagatgatccccctctcggtgcaggaagttgagggcgatgcagatctcggccgcgttagaacctgtgcgtgctccttcagggtagcttccttctgcctctgcaagtgaacccacgcgggg

SEQ ID NO: 701137 - DNA, 159 bp, Homo sapiens
ccgtgggggaggcccttggcccttcgaaatttttttttggacccgggcctcccccccccccccgggggtttggggttccggtttcccggggggggggttttttcccccttcccagggggcccgcccctttccattaaaatcccggttggccccggggga

SEQ ID NO: 701138 - DNA, 578 bp, Homo sapiens
  misc_feature (13)..(13): n is a, c, g, or t
  misc_feature (578)..(578): n is a, c, g, or t
ggcttggatgttntgctggagtggcctgagccgggtgctgcacggggagtgcggagtgcagctgtgctgtgcgtgctgtgcgtgctgtgcgtgctgtgtgtgcgtgagcagatgaagaaactgatgtgccctgtgatgtgaagtgacttgccccccagccacacatgctggaccattctggctgctgtctggacaagaagtcgtagggggtgatgtggtggaatgcttggtgaaacccacatggatggcaaccacactagtttacgatcttcttggttgaccccaacttctctgctgctcattgcctgctggtgactggtgtgctggctgtgaaacaatgtgctgccccctctacgtgtgaaaattgcagtgagtgctgaagccagtgcctgttggacgtgggccttgtgggccggtttggcgcggtgactgcccactgtggcccttctttggggcttgtgctgggctcggtgtctcgttcttgttgtgccccccgctgcacattgtgtccctttggcccccctccccattccacgcccatgcccctgcctcgcgcccttgccttcggtctgttcccn

SEQ ID NO: 701139 - DNA, 180 bp, Homo sapiens
ccgaagggtaagaagctgccactgcaccttctgccagctgagtcctgggaccccatcttcaaggatgcttctgactgcgatcacgtaatttcaatgaaacgagcgagactatgcaaacactggattagacgaaacctggtacagtcaacaactggcacaagcggaggtacacaggaccga

SEQ ID NO: 701140 - DNA, 274 bp, Homo sapiens
gccatccccggtatgatgggtgacagtctccacactcgccaggtagcatccactgtagaagaggcattataccaggttacagatggcagaaaatactttgtagtctctcccatcaagtcttttttgccatcatttaaatctgggatggccatgttacttgctttgagaaatacaataaggcagaaatgacaaattgtaagttctaagccgtgacttcaagaggacatgtagtttctgctcttgctctattggaacatttttaccctgagctagg

SEQ ID NO: 701141 - DNA, 180 bp, Homo sapiens
  misc_feature (65)..(65): n is a, c, g, or t
  misc_feature (122)..(122): n is a, c, g, or t
  misc_feature (132)..(132): n is a, c, g, or t
agtcctcttcggtcccgttgtcatcgttcagcatagacttaactcccttaagcccagacatctgntgagacctgacccctacgtcatggttaccagtgtgtcaggcaatctggactttccangtgatgccanctgagatggcaccgtggtcaaagagagcagtggttccccatttctaga

SEQ ID NO: 701142 - DNA, 263 bp, Homo sapiens
tctagaggatcccggtcaatttctacacggctacagtaccaaaacagcatggtactggtacaaaacagagatatagatcaatggaacagaacagtgccctcagaaataatgccacatatctacaactatctgatatttgacaaacctgacaaaaacaagcaatggagaaagggagaagtgtgtaactgacaaaaagcacagtgactcacttggagctggcgtacttggtgaccgccttggtgccctcggacacggcgtgcttg

SEQ ID NO: 701143 - DNA, 620 bp, Homo sapiens
  misc_feature (117)..(117): n is a, c, g, or t
  misc_feature (120)..(121): n is a, c, g, or t
  misc_feature (165)..(166): n is a, c, g, or t
  misc_feature (542)..(542): n is a, c, g, or t
  misc_feature (548)..(548): n is a, c, g, or t
  misc_feature (550)..(550): n is a, c, g, or t
  misc_feature (567)..(568): n is a, c, g, or t
  misc_feature (571)..(571): n is a, c, g, or t
  misc_feature (574)..(574): n is a, c, g, or t
  misc_feature (576)..(576): n is a, c, g, or t
acaccatgatcaggacactgctgctatctgccttggtggctggagccctcagctgtgggtaccccacttatgaggtggaggatgatgtgagcagggtagttgggggtcaagaggccncanncaacacctggccctggcaggtctccctgcaggtcctttcctccnnaaggtggcgccacaactgcggaggctccctggtggccaacaactgggttctgacagctgcccattgcctcagcaactatcagacctaccgagtgctgctgggcgcacacagcctctccaaccccggagctggctctgctgctgttcaagtctctaagcttgtggtccaccagaggtggaactcccaaaacgtcggcaatggctatgacattgccttaatcaaactggccagcccagtgaccctgagcaagaacatccagacagcttgcctcccacccgctggcaccattctcccgagaaactatgtctgctatgtcacaggctggggcctgctgcagaccaatgggaacagtcctgacaccctgaggcagggccgnctgctngntgtggactatgccaccnnctncancnctagctggtggggaagctctgtgaagtccagcatggtgtgcgct

SEQ ID NO: 701144 - DNA, 220 bp, Homo sapiens
gtgtgcagtgtcaatccagttgcgcatgcagtcagggacaagggagcctactcaggtgtagatatgctacgggtggcgcttccaattcaggtgcattagtaggtgcctgcagtatgttagcggttaggcgtacggccagggctattggttgacacataactagtactaacttataatttaatctaatgtgacaaatactacttattcacttctctaaaat

SEQ ID NO: 701145 - DNA, 313 bp, Homo sapiens
ggcagctatcgtttctgcaactggcaaccgcatcgatcatcgcggagttcgtggcactcacgcttgtgtaggttgctcgcaaatatgtcagccccctgtgcgcgatctcgatacgcattccgattgtggcactcgtgaatttcacgttcgcctaccatttttccagaagaaccgattttggacgcccaagacctgggatgcacttctctgctgtggccccattgctcaaagtgtccggctaccagctcgcgttcaatgtgcttaacttcttctcgcgcaatctcgacaacgtacttgtcggcaagtacctagg

SEQ ID NO: 701146 - DNA, 4058 bp, Homo sapiens
  misc_feature (4011)..(4011): n is a, c, g, or t
  misc_feature (4039)..(4039): n is a, c, g, or t
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatgccaagcacttcacagccttgatgctttgacttgcctttcctncacctggaaaactccacatttatcttcngataggccgatatattggg

SEQ ID NO: 701147 - DNA, 353 bp, Homo sapiens
tgagtgctctagcggatccttacctctaacactactcctctacctccattataactactcctaattttcacattctcacgacacacctactacccatgcgtgctctctgcaattggactggctggctggcttctggaaaagccaactttcacaaaccaggtggcgacacagaattgcttggcgacgtctgtggaccaggctgggcagctaacatctcttgcaagagccaccatgtatcctgatgttcccattggacagcttggacaaacagtggtgtgtgatgtctctgtggggctgctatgcaaaaatgaagaccacaaagccaggttggggtcatcccatatggccttctg

SEQ ID NO: 701148 - DNA, 2993 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgag

SEQ ID NO: 701149 - DNA, 133 bp, Homo sapiens
aaaataaaaatttgcgaggcgtgttggcgaacgtctatagtcccagctacttgggaggttgagggagagtcctttgagccgagatggcgccactgcactccaatctggccgacagagcgacactcttatctca

SEQ ID NO: 701150 - DNA, 2145 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaaggtactgaaaggctgagccgcagcagcgtggggcacacagttggttgcattttgattaatgacagaaggtcaaatcacagcttcaaagtaccaatttccagaaggcttttctgggagacttggtccttttcgtgaaggtctaattccttgtggatgttgtggaattctagcttaagccagtcccgtcccagacctgggggatgtttgcagtgccttcctttccttttctaattggaattccttgttggttttgggacatgtttttaaggaaccttaatattttatagaaggtaccatataatgctatggattccttgggaaaaaataggccatagccacaaagctaaattatgctgtaatcaaataaagcttcgtggaattgtttagaaaaaaaa

SEQ ID NO: 701151 - DNA, 663 bp, Homo sapiens
  misc_feature (149)..(149): n is a, c, g, or t
  misc_feature (205)..(205): n is a, c, g, or t
  misc_feature (208)..(208): n is a, c, g, or t
  misc_feature (213)..(213): n is a, c, g, or t
gggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataacangttaccaagtgttgaagggctccatgccattgttgtgtcagatagagatggagtanctnttatnaagtggcacatgacaatgctccagagcatgctttgcagatccgtggattgtctctagtccaacttgtttgcgcgcttgcaaacctatgaccgagaggagagcaaagcttggagcgtttgcctaaaaataaatagtatcatctgttactatagacacctaccaggtggttcaatttaatcgtttacctttggtggtgagtttcatagccagcagcagtgccaatacaggactaattgtcagcctataaaaggaacttgctccattgtttgaagaactgagaccaagtcgtggaagtgtcttaatctgacagtggtttgcagtgtgtaccttatcttcattataacaacgcaatatcaatccagcaatctttagactacaatagtactttgatccatgtgctcaagaaagggccctttttccgagttatactaaagagctagcatatagatg

SEQ ID NO: 701152 - DNA, 2014 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggtgagctgctgtagaagcttctggaagtggtgcctggctgtccctatactgtgctgctgggtgttccagcctgttgccttgtgcgtggtctcagggaccatgtcctttggagccccaaggttgtcctcatctcaaaccatccaccagtgattggtgatgagaacgtttgtcagagaaatgtgtgttcttggctctgtggcttgcttaccagggccgatgtgctgggagccactgtctcaacgaagcagacattccctgggccagccccgtcctgtgcgcgtgtcgccctgttcttgctgtgttgatggcctgtcctagggcaccttgctggtgtagcgaggctgcccgttgtgactaggaagtaccatgt

SEQ ID NO: 701153 - DNA, 377 bp, Homo sapiens
  misc_feature (149)..(149): n is a, c, g, or t
  misc_feature (205)..(205): n is a, c, g, or t
  misc_feature (208)..(208): n is a, c, g, or t
  misc_feature (213)..(213): n is a, c, g, or t
gggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataacangttaccaagtgttgaagggctccatgccattgttgtgtcagatagagatggagtanctnttatnaagtggcacatgacaatgctccagagcatgctttgcgactcggtgtcttatccacttttgcccttgcaacagaccaaggagcgaacttggactttccaaataaagtgtctctgttactctaacacatccccggtggtgcacattatcgcttaccctggtggtgg

SEQ ID NO: 701154 - DNA, 364 bp, Homo sapiens
aaatacgacgatacgtgacgccgtatttctgcttccgaagggcgatgaccgcctgcggtgtatgccatgcgcttcaaccattccttccttgtcagcaaggtaatcgccgccaacgtcgcgatctgaatcgcggtcatcgcctgcgcccagcggtgatgctggtgcagcgcctgctctgacttttcatcccattccttcgaggtggcttcaagcttttcggcttgtttgcgcacgtcttccttctgggttttataacgctcgatctcgtcggcgtagtgcttggcgtcaacccccggaatatgggtcgccagttccgcggttctgccggctggatttggcctggtagtagttccctggttggcgg

SEQ ID NO: 701155 - DNA, 1470 bp, Homo sapiens
agcggggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgagctccaccttgacccagcctcacaacaaaaagtttgtgtatgaccaggcttcctgtaagtggaa

SEQ ID NO: 701156 - DNA, 285 bp, Homo sapiens
  misc_feature (21)..(21): n is a, c, g, or t
caaggatttctcagcaggcanaatgtgcttctgcagaagggtgctgctcattcttgtcacttgcaagagcacactgagcaagagaagggaatgggtttttatcccttagacagtccgtccctactactgtgtccagtccccattggctggggtcagactgtactacctaagctgattctgattggctacattaaactggatcagttgtgggagctacagcggtgtgaagagcagtttcggaactatgggtgtctagtcatgcactgatgtgcattgtttaccgat

SEQ ID NO: 701157 - DNA, 591 bp, Homo sapiens
  misc_feature (79)..(79): n is a, c, g, or t
  misc_feature (222)..(222): n is a, c, g, or t
  misc_feature (225)..(225): n is a, c, g, or t
  misc_feature (229)..(229): n is a, c, g, or t
  misc_feature (251)..(251): n is a, c, g, or t
  misc_feature (284)..(284): n is a, c, g, or t
taaagcaaagtctcgttttgtccccgaactggagttccattgaagtcacagctcactagcttcaagcatttctcaagcntaagctcccaaagtagtggatttcaggcatgaatcacacacttggccttgaaacattattttaaaagcctaaattccagttggtaagggtacaaaaatttagttaacttcaaaaatcacagtactgcgagaaatggcgggtcntanggtncagagaagtgggagtgaatcanttctggtggttttatcttggcagcatgcatggnaatcacatgagtagaggctgtgggctgggatcacacttcaaagctgtggtacttttacttcaagttgaaacttttaaaatacatctgtcatatagatgtacaaatatatgtagatgcaaacatatatacacactttttgacaaaagaattgtggtaatatacgtgaccatttttgtaaatagattctatttggttaataaaaatattcctcccatcaacctatcgaagtccagaccaactatgaagataggatgcccatccagaagaacgggaagcattttcttcctcacctttggaaagtaaacca

SEQ ID NO: 701158 - DNA, 654 bp, Homo sapiens
gtgatcctcagcgtctggacacattccgtggcagcggcagctggccctcatcgttgtgcaccgccaccagcaacgggcaggagcccagcaggctggggggggccgaagaggagcgcccgggcaccccggagttggccccggccccatgcagtcagcggctgtggcagagcccctggccagccccgggccagcccctggtggaccccggagacgccgggccagcagggcagtcaaggaaagccaagctggtgtttgctgtgaaacctgccactgcccagttgtcgtcaagcggattagaggagaccaggaggagctggccgaattgggttggtgccaccccctgaagagtttgccaaccggggtcctgctgtgcacccatcgcctggccgggcaccctcgcccaacacgggtgcccgagtccggcctccagggaaagcccagcagtgagcgcaccacgctgcgcctgagtctggagacgactctggggtggaggaggctgacacacgcagtacagtgaacccacaactggagaacacaagacacatctcaacggtgtccaagcatgtaccacgttggagctcgggagagcgggaagatcactgacaccacaaacacttcatttcgctgacgggacagcactttatctatcggaga

SEQ ID NO: 701159 - DNA, 502 bp, Homo sapiens
  misc_feature (420)..(420): n is a, c, g, or t
gtagagcatccgcctatatggcagaggtccagcaggtcaaggagatgcggtgcctttccggcatggtttactatagccgatcgcggtgtccctgtcgatccatgctgtgttggtatcattagtcctatcggagcaggtctcgagtgcgtgcttgctccatgctgctgctcctaccaggtcgcgcgtgcttgagctctcgtggccgtgagtgcgttgaagctatgtatctcccgtgctgttcgccgtcctgcgtcgagtgtctcatacgaatatgagagcgcgcctggccctcgagtggtatatacgactccggaatacttggcctgtaagtcagcgcctcactgacggtgcaacattgcattcaaatgccttatcacgctgagaatggcctgtggcccacgcctactgagtgttgcgcgncgctttcttagctaaatgcgcgttcaaagtacctcttgtctacatcacacggttgagcagtactcaggcgcccgactattac

SEQ ID NO: 701160 - DNA, 309 bp, Homo sapiens
tcctggacggcgaggattgatgtgtctctaacctagaggtcaggacagagatagtctcagtgtgagagacctcatgacagtcactctttggtcgaaaatcgaagagcactgagagaaggcacagaggaagaagagcagcgcggccggagccaaggcctggcgagcactggctggctgggctctgagcaagagggaggagtcagaggcagtcaggctcagcacagctcctaggaactgcttccaattcagtgaagattgaaagaccctgccctaagtctgcaccactagaaaggaagtggcccccaggtg

SEQ ID NO: 701161 - DNA, 717 bp, Homo sapiens
tcccatgaaaacaaatgattgtcccttttaatttaattgggaaggcagggggaatcaaaaggcccttctttataatgagctattcatattgcaggagtcagaatgatttgatacaggtgaattttaagttacaggctaaatggcttaaaagctttgtcagtcttccagcatcaggggagtcatttaatagcctttttccttattggctagtatggttaattgagaaatatagtaaaatagatacaagagtcatctatataggtgtgagaccggtgggtgacttttccaaagtttataatttaaaaagctccaaataacgttggcttttctcaagaagacttatactcattgctctgggctatacgtgtgaatcactgaattgcttgaacaaccctgtgaaagacatactttagccctttaagatggccaggagctaagcttgagtctccttaactgaattccgtcctaagtgcaggttacttgtagattctagtcttcacaggctcccgggggctcttaactagtcacactggggacgtcatgaatgtcttctccaataatctcaggcaatcctagaagatcctcaaactgtcaggtctattcatacctcaacacagggaaaaaaacgctctttaacaatttactgactaactcaggaggcaccgttaaccaaaagcacagtggaatgaaagttttcattgctagggttcaaccctg

SEQ ID NO: 701162 - DNA, 225 bp, Homo sapiens
ggttgaagttgtttatacaattgacattcagaaatatattccatgctatcagctttttagcttttataattcttcaggcgagtaaatgagcaagcactgaaggaaatattatcaaatgtcaaaaggatgtggtaggttggtcaattccgtgcgtcattcagttcagtctgacgttgagagagaggttttacacaaaacttgcaggagcatttttcaaaccaagag

SEQ ID NO: 701163 - DNA, 512 bp, Homo sapiens
  misc_feature (5)..(5): n is a, c, g, or t
  misc_feature (182)..(182): n is a, c, g, or t
ttacngtctgctcaaaaccctccacgcttcccatctcacccagaggaagaaccaaaatgtctcaccactgctcacacaaactttcctttccaatcacttctcctctgcttactctgttctagccacactgatctcccgtgctcttcctcaaacatgccaggcacaccattcccaccctttgncctctgcacttgttccttatgtctggaatgttttttccatagactgttacatggtttcctccctcagacagatcatgcagatctctgctcatatgcctgctcctcagaggccttccttaattatcctttattaaaaaggcaaacacataccagaagctggctaccaccggccatgtttccctctctttacatcttttaaaaatgtcaagttggccgggtgcggtggttcacgcctgttatcccagcactttgggaggccaaaggcgggtggatcacctcaggtcaggagtttaagaccagcctggctaacgtggtgaaaccccgtctcta

SEQ ID NO: 701164 - DNA, 486 bp, Homo sapiens
gcgtcgaccggcggcgcgcatatcatcctcattgagacgatcttcgatacgctgaacgccaaggcggcgagtcttcgcctgcgaggagcgtttcgaggccaagggatccgcctgccggtcatgatctcgggcacgatcacagacctatccggccgcacgctttccggccagacgccgtctgccttctggaattcggtgcgccacgccaacccctttaccatcggcctcaactgcgcactcggtgggagtgcaatgcgtccgcatctgcaggaattgtccgatgtcgccgataccttcgtctgtgcctatccgaatgcaggcctgccgaacgagttcgggcaatattacgaaacgcctgagataatggcgcgtcaagttcacagggtttgtcccccaagggccttcttgaaaatctttgggggttttgtttcggctcgaacgcgagagagtagttccgggggattttccaaagcggtgataagaatt

SEQ ID NO: 701165 - DNA, 778 bp, Homo sapiens
gtgtgtgaaaagtcagttcttttggccttttctcgttatcggggagacttgcaatttacacagggatacccatctgaagaataattgagacctgggaggcgtgcaggttgctagatgcacgccgagatttccactgcattccagcctgggcgatagagttagctctgtctcaaaataacccactagtatcatgctctgagtaacattggctactcccgaagtatgcacttgtgaggaacagcaggcctcagtatcaccagggatacttcattagaaataagtctctagtcctcaaccagtatacccacttaattgtaatctggatattaacaagattacccgatgtgggtcaggtgtggtggctcatgcctagttcactccgcacagcttaggtgaggttccagaggctcgggcggcatcatcttgagagctgggagtttgatgaccaggctggtgccaacgtggggtaaaaacccagtctctatcaataaccataacaagaagattaggtcgtgtgtggtgacgcttgcgtgttgtcccaggtgcttgggcggctgaggcgggagaatcacttgagtctgggaggcagcaggtggtagtcgcagctcgaggttgtcgccactgctgtccagtctgggccccatggtgacgctgttggctgctggagcatgttggatgtggcctggagagcctaatcgtgatatggaacgtgggcagtcttctgtcattatggggcctttaggagtgattcactcgggtgcctattttccctgtcttg

SEQ ID NO: 701166 - DNA, 221 bp, Homo sapiens
agatgagctcggtacatcattcaaaactaaaaacgaaggggctgtccgatatggatggccctttatttttttggttggcttcgaagtgaaaccatactgaaagtaatgtgaaagtatggttttactatgttttgcatacaaaaacatggtttaaggttgctttaaccgtgtttttagagcgaaattaaccttgtaactgctagactgtctcatttttttga

SEQ ID NO: 701167 - DNA, 272 bp, Homo sapiens
tgtctgttcatgtggcaggcagcaacaaagttcacggggtgcccactgcacctgtgtgaactgggggtcctcgctgggggcacctgctaggcgagcattgacccttttttggattgtcctcagcaagaggacagcggcgttgggactccccacccggtgcatggaggcggcagccatctgctcgaagtggctagcgcagtctcggcagccgaagaagtagtgcacgtagcctcggatggctgggaggacctccttggccttgccatatgcga

SEQ ID NO: 701168 - DNA, 619 bp, Homo sapiens
  misc_feature (232)..(234): n is a, c, g, or t
tagagacagtgtctcactctgtctcccaggctagagtacagtgtgcaatcatagctcactgcagccttgaactcctggcctcaagcaatcctcccaccttggcttcccaatgtgctaggtttacagccgaaagggagggagggtgtgggtgtgcgtgtgtgcatgtgctggtgtgtaagggggaaagggtctttcctggttttatttaaataaagtagtttatgtaacagtnnngaagacaaaaacaaacacagaagaaagacatagaaagaagagaaaaaacgacaatgaacccagcagagcgcggagggccgcaggagaagacccgcacgatcagtgggcgcccgcactacgaggcctgacccgacgcgcggtcgaggacgcccggacctcacccaaaatagaaggcggcgactctgagggatcccctcgtgacagagtgtgcgtctccttaccctcccaatggggagccatcccgccgattggcgtagagcagaaacagagccttagaggcactcagcgcacggctcgggaactagcggaaccggactagctgtaccgaaggggcgttggtccaacctcgtcgtgaggcagatacatctggccgccgcggaagcaa

SEQ ID NO: 701169 - DNA, 924 bp, Homo sapiens
gcaactccttgcactcatcgccctctggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggcctgacctggagctgcaattcaagtgctaccaccacgaggaccggcagatgaacaccaactggccagcctcggtgcaggtcagcgtcaatgccacgccgtcaacattcgaagcgtggggagaacaagagcctcgcacaagacactctatctgctaggcatgtgtggtaggccaggacgcaagaacatccatataaatgtcaggactggtgtgtgggtgatcccacttgatcgtgctgcatgtaggtgcacgcgccacatccgtccggtcggtgctgcaggggcctcctcaaaaagcgcttctgcctgtgagcacttgattcaccaaggataaagcggaacttcagcagggcaccatccctggcacccctgggccaacggagaggacggggtggagcagacagtatcaggtgtccctgaagtgcccatcaccttccgaggatccaagctccctgcccgaggtcatgactggtcggcacatacagggcttttgacctggagtcgataccctgcagactccaatggagcgggggacttggaggggtctggtgtggcacaaaaccaattgctgggagggccgggaggggggcccaacaacgcgggggactccctgatttatttcggaaagttcgcttgtgaagggagacacattcgcacccgtgtggtgtaatacaaggcctggatacctacagataccaaggaggacgcgagtgggaacaataagagcgcgaatgatgccccaagtttgatgcg

SEQ ID NO: 701170 - DNA, 343 bp, Homo sapiens
gggcacagaagatgatggcagtcacatcgttgaagcactggatccactcgcggcgttcatcgggctggccacccacgtcaaacatgtggaagcttgactttgcgcacgctggaacttggtctcaacagattccagcacgtcaggacacggcagcgaacgcgtgtcctgatcggctcgcgacatacgtcagcctgctgtgatcaggtcgatcttgtccagggaagtactgggcacagtcaatcagctggtactcgtgggagcgttcgtagcaggcacgcactcctacatcctcccagagagccttggaatgctcatagcattcgggaggcaagtcaaagtcagg

SEQ ID NO: 701171 - DNA, 3125 bp, Homo sapiens
  misc_feature (9)..(9): n is a, c, g, or t
ttgctgggngggagggggggagattgtttgcagcatagaagctccgcgggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatg

SEQ ID NO: 701172 - DNA, 2075 bp, Homo sapiens
agggctgtaccggtccggagatttaggatcctagaggtgacaagcaggcgctcgctcagtgagctaggtgcaagtccagaggcctcgaggagtgggatttacacatcggagccgtccgctcagacgccgttagtggagggttccgcgacttcacgggagtgaggaaagtcacttttggaaatcgactttgccttcgcccgcgaagcccgcagcgtccggactcgagttgcccccggagccactgccggaagtttaccagctcactttcggcgtcgcgcccgcctccgtggagcaggccggaagtggctttccggcagccgcgccgcagctccgtaaagcaagatggcactactcactctgagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatg

SEQ ID NO: 701173 - DNA, 3520 bp, Homo sapiens
  misc_feature (9)..(9): n is a, c, g, or t
  misc_feature (3133)..(3135): n is a, c, g, or t
ttgctgggngggagggggggagattgtttgcagcatagaagctccgcgggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaacagtnnngaagacaaaaacaaacacagaagaaagacatagaaagaagagaaaaaacgacaatgaacccagcagagcgcggagggccgcaggagaagacccgcacgatcagtgggcgcccgcactacgaggcctgacccgacgcgcggtcgaggacgcccggacctcacccaaaatagaaggcggcgactctgagggatcccctcgtgacagagtgtgcgtctccttaccctcccaatggggagccatcccgccgattggcgtagagcagaaacagagccttagaggcactcagcgcacggctcgggaactagcggaaccggactagctgtaccgaaggggcgttggtccaacctcgtcgtgaggcagatacatctggccgccgcggaagcaa

SEQ ID NO: 701174 - DNA, 1035 bp, Homo sapiens
tggcacgagggtgctgggcctgagtactcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatg

SEQ ID NO: 701175 - DNA, 3071 bp, Homo sapiens
  misc_feature (9)..(9): n is a, c, g, or t
ttgctgggngggagggggggagattgtttgcagcatagaagctccgcgggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatg

SEQ ID NO: 701176 - DNA, 3077 bp, Homo sapiens
  misc_feature (9)..(9): n is a, c, g, or t
  misc_feature (2690)..(2692): n is a, c, g, or t
ttgctgggngggagggggggagattgtttgcagcatagaagctccgcgggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccattgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaacagtnnngaagacaaaaacaaacacagaagaaagacatagaaagaagagaaaaaacgacaatgaacccagcagagcgcggagggccgcaggagaagacccgcacgatcagtgggcgcccgcactacgaggcctgacccgacgcgcggtcgaggacgcccggacctcacccaaaatagaaggcggcgactctgagggatcccctcgtgacagagtgtgcgtctccttaccctcccaatggggagccatcccgccgattggcgtagagcagaaacagagccttagaggcactcagcgcacggctcgggaactagcggaaccggactagctgtaccgaaggggcgttggtccaacctcgtcgtgaggcagatacatctggccgccgcggaagcaa

SEQ ID NO: 701177 - DNA, 419 bp, Homo sapiens
aagggtttatttactggactctggattctgtttccattgtatctgtgttttcctttcttttgccagttaccactacactagtattcattatctgtaccttcgtagataaaatttgatattgagacatgggatttctccaacttcattctttttcaagactgtattggctattctgggttattgataacactttgtcatatttgcactcttgttgttgttgttatgatgtgtctcattcataaagctagctactgacatcatgggaatttgccattgatacttccgcatatcttttctacgataatatgcatttctctacaagaccacaataccattgtcacatccgaatcacttaaaattatggaatatgtaatccatactcacatttcccttgttgtctttattctatattataataa

SEQ ID NO: 701178 - DNA, 2771 bp, Homo sapiens
  misc_feature (9)..(9): n is a, c, g, or t
  misc_feature (2384)..(2386): n is a, c, g, or t
ttgctgggngggagggggggagattgtttgcagcatagaagctccgcgggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagccagccgaaagggagggagggtgtgggtgtgcgtgtgtgcatgtgctggtgtgtaagggggaaagggtctttcctggttttatttaaataaagtagtttatgtaacagtnnngaagacaaaaacaaacacagaagaaagacatagaaagaagagaaaaaacgacaatgaacccagcagagcgcggagggccgcaggagaagacccgcacgatcagtgggcgcccgcactacgaggcctgacccgacgcgcggtcgaggacgcccggacctcacccaaaatagaaggcggcgactctgagggatcccctcgtgacagagtgtgcgtctccttaccctcccaatggggagccatcccgccgattggcgtagagcagaaacagagccttagaggcactcagcgcacggctcgggaactagcggaaccggactagctgtaccgaaggggcgttggtccaacctcgtcgtgaggcagatacatctggccgccgcggaagcaa

SEQ ID NO: 701179 - DNA, 1303 bp, Homo sapiens
gtagttctcaatgtgctgctgattacctgtcttatgtaactactagagaccatctgcaaggagacatgatttagtgtgtcgtgtaattcaagtcgttcgctgtgtgtggtagaagcagtagtcacttgtgtaagccagtctcttcatgcctaaaagacactaccagtcaccttggattcgcgacgttttaatttatgattatacttagcctcctcctccttttgatttatttgcccaagtggactggacttggcttttttccccccaagtagaactaatgctagcttccaggctgtgaaagtaaaactccagttgtggacgtgaatccggtgtctaagttgataaaccggtaaccaaaactcagacatcgggtacgggccttggcactggagatgggtccctgtaaaaccccctttaaaacgcatatggcatctagtacagagctctctcggaaagtgaaggcgtggacgatgtcgcatcacccaccggggctcaccagggctggaactcgtcaactcagcacaggcagacttggcggcgctccaccgaagctgctccacgcatgcagctgcgcctcacacttggccaggcgaacagctggcaggctgcacagcacagggcacgtgaagacagctcctgcggcaagcccaacactgggctgacattcaaggggcctgaatctactacgaagaccccatggggacatcacacaccactatccaccataactccccaggaaccattaccgggggccattaccggacacggcaagcaaaagagtcgcaaccggcacacagagcgaggtgcgcgctccacacaagacacgtgggcacgagtcggaactaacactccgcgaccccattagcgcccgaccatggacaaaccacagagccaccgaagagaacaccagacgacctgagcatcagcgcaccagacgcgaacgaaactgcggacgcaactcatcgacgaacgccccactatcacgacgaactaggccccactcagccagcatgacacagttcgaccccaatgggagacacttcgctgacacaaggagagaccaaggcgccaccaacgggggcacacaccccatactgaagccgggcgcacctcaaactttacgtcagagcgaaacaaaaacaaggggacctccaacgcgggacatcgtacgagccacaccagcaccacagcacacaacggacacacacatgaacacagcgagctgcacacccaggcagagactgctccaacacacgacagcgaccgcagtcatccactcgccccccaaccgaccgaccacggc

SEQ ID NO: 701180 - DNA, 112 bp, Homo sapiens
ctggaaccagtccagtgcccgatggtagtgtctgggagcgtagatatcacatgtccggagtcttggtgaggcagcacaatctgtggacagcacaagctggtgaccggcacaa

SEQ ID NO: 701181 - DNA, 565 bp, Homo sapiens
agctctcagcccagagaggagggtagactgtgtcgcgctgagcgtatgatagggtggcctggaacaaggtttgggccgatgtataagcgggaccgggcccgtgaaacagcagaagaatggcacagattcgggccaatggcttcaagctggagactagggacccccgcatggtgaggtgcccacctgatcaggccactcgtctgtcgagcgtgaatacgtgctggcatcccaaacctgtgatgggcctgaggcccataggtgccatggccgccaggtacacctagcatgcgcgaccaacatgggcagactatctgcggagaccaccacgcaatctagcacattggccctgtcgcccccgggtgccacacgggtccaaactggccttggctacgctcataccacttgcctttcactggcacgtgccaatcaaacgtcttgagatacccctggacgccttaattgcacatggcgccacatcagcactgcggctagccggtacaggttacaccacgagcacctatctatggacgggcccaacgtggccctgcgctcctccttgcaactg

SEQ ID NO: 701182 - DNA, 268 bp, Homo sapiens
tcctccagagttcccccttctgttctgacccacctgctattagaatgcattgtgaaacgactgtagtatgattaaaagttgcgttccccaatgcttggggtagtggttgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggagggtcagaacataag

SEQ ID NO: 701183 - DNA, 787 bp, Homo sapiens
ggattttaaaatttggatccttcaggttcctctcaatctttgaggcatttcaaatgcttaccccttgctttctggttatacctgcaatcagcttgtgttgtggccatattagtgtgattcagatgaacttatagtaggaagaaatacttaggcattgtactctcagtaagaagtctcaactttctgattacggatcatgattattatatgtaaatggaaactccttgtagagttttcttttcactgttaatttgtactatttcgtaagtattgttttctactgattatcgagtagttgtggattattcatgtatcaacttggtttttctccttatccctgtgttcttataggattcctttgttagattattaaagcctgtctgtgatctgttttaactcattaagaaactggcggtagtgggccaggtgggtactgcctaatatctgtgatgatttatcttaaccttttataacagtattaatatttccccacatggcttgtgatgagactagtgtcactgaactgagcttgtacagacatttgggaagctggtctgggtggtcccgggggaaattttgggtgctggaaaataccaccaaaaattatctgtgagtattggttatagctttgtaggggcagtgggtttgttagaagggcaccggaaggcactcagggggggtatatggggcttgggcggtaagtttccagctttgaatggggccggtacctggtgggccccaggagtggggcccgttaaggaccggccttagaacccggtattggccc

SEQ ID NO: 701184 - DNA, 218 bp, Homo sapiens
gcggccgctactactactactaaattcgcggccgctcgacgagcagcttgcacctgtaatcccaggtactcctgaggctgaagcaagaagattgagcccaggagtttgaaattaaagtgagctataatcatgccattacactgtagcctgttcaacagaacaagaccttgccttgaagaggaaaacgaggaaggaaggagggagggagggagtcgacg

SEQ ID NO: 701185 - DNA, 210 bp, Homo sapiens
cctacatatctgtcttataaatcacctagattaacatccttgagggaaataacaataccatgattatctatgtatacagcctgtactagaaactcacacatagtacatactccataaatgcctgtccttggtagaataagataacggcaacatataaaccacaattaataggattcaagtatgtgcatgtacatggatatagttacaaca

SEQ ID NO: 701186 - DNA, 1149 bp, Homo sapiens
  misc_feature (177)..(177): n is a, c, g, or t
gacatctttttaaaaaaaataacaacaaaaaaaaaatgagagaaaagctaaaaaaaaaaaagttaaggggttgagcagttaagttggttattcatttccacattacaatattctggtgttaaaacgattttcctgtgtagaagttagctttaagtggttttggctctagaataccgntaggtctatccttagagcacttcacgccagtgcttttcttccctgtgggtttttaaacttcattattaactttcagaaattgtggagagcaaaaattttggctgtgtcactgcacattcaatattaaaaaagcttattttaaccttatcaaaaccgtattttattggccaaacctatgcttttttttgggttaactttggtccatatttatatcgggatgacaaattccattagaatatatttctttatatgttaacacttatgatcttcatattaatcttaaaactttggtgacggtgctcttttccctttttttccaaagtttcaatatattatctcttcaacgacattttcttggtaactttacacttttcttgggcaaattctccattttaacaaacatctgcaacaaattcaatttcacaaaattgcaaaaaactgctcggattatccatcttagaaaattcccccctttgtgttggactgccaacttgagtccttctccttaaggccctttcccaattaggcacggagactgtgtctgctaccagcttctggcgacagtcacagcaaggaaaacaactttacatgtatagcttctaacacacggggcacacacaaacacaacgaaaaccccttgagatctccagagttgtccacttttaaagaattcccgttcacaaaattttgagagacccacgaactccgggttgggaatttttaccaggtctcatggctaccagacctgcggccacccacaccttagcgatgacgtactctatatattcctcgagtaggcaacaacgcgcgcacacaaatctcacatacgcgggagagccttacaacgaaacaacttcgtgtcgcactagggccatgaacataagccggtttatcaaaaaaagggcggctaaatactagggaacaagacaacattcgtacagacccactagtaaataagacgactaaagcaac

SEQ ID NO: 701187 - DNA, 315 bp, Homo sapiens
agtctctagtatattgtgggctgcacaatgggaagcattttttttaaagcattggatattttgccaacccagaagagatataataaaccacaaaggtataaacttaacttctaaattaattaaatttattatttgtgatttgaaatatttaaaaaaccagtttgaactctccctttaatattaaaaaaattaaacaaaaagaaccacttaaaagcagataggttaatgtatacacaaaggcaatttttttccttcgcttttattaatctttaaagttttaatgggtgaatgaccttgctggaattcccctgtcag

SEQ ID NO: 701188 - DNA, 404 bp, Homo sapiens
gcaaataagaatagcttcgaatgcaattccatatcgagaatgacttccaccgctggtctgtcttgctgccatcagcactgctcaacatgtcatagacgggctctccgagtctttgggacattcatttaggatctgaagataaaaaggctgcttgttagaggcgtggggtttcaaagaaaagatgaagttgatcttaccggttcaagctaaaagttaattacctgcagaaataagcactttgaaatagaccataattaaggctcattgcccattgtggattttcttctattagacgagctgtgtttttctcccaaagctttatgtatctttttattatttgtatttatgaccaggcatgtgccacgctccaggttgtgaattaaactgatgggacgaagacggcg

SEQ ID NO: 701189 - DNA, 197 bp, Homo sapiens
tatccagagagagttataagcaattaggctgaaatcttggtaagatctgtgaccagatgacaaaccacagagaaacaataaagaaaggaagaaggtgtcctggccaggcacggtggctcacgcctgtaatcccagcactttgggagactaaggtgggcggatcacctgaggttgggagttcgagtctgtccaacatg

SEQ ID NO: 701190 - DNA, 287 bp, Homo sapiens
tccaacagaagccatactttatgtatgatagaaacagtacaaatccaaatcacgcggcagttactccttggagacaccaaaaaaggtggcttccatatggttacatggttaattccataatcgcatatacaatatcataagggtggttcttcagggctcggactgccttggctctcgacacattggctggtgacatgaccaattcaaggtccttaacttctacaccggtatcatcgacctcttcctcttcactctcctctggtacagtgggagaaggacgggtgggg

SEQ ID NO: 701191 - DNA, 283 bp, Homo sapiens
ccttctctggctcagccatcttatgaggcacagaaaacgtcaggtccccaatcacctcctcactggggtaggtaaacttgacgcaactagagtggatcagatcgtagtactacatcttcactgtggtcttgtacccaaactcaaaataaaagtccttgtcaacaggcaccggcgatggcgtgcgttccagagaggacagcacgaccatgatgtgctggatgaagcagagcgtaagtgtactgtcccgcgtcaagcacgtgaccaactgcatcggtgtagaacc

SEQ ID NO: 701192 - DNA, 290 bp, Homo sapiens
  misc_feature (20)..(20): n is a, c, g, or t
  misc_feature (22)..(23): n is a, c, g, or t
  misc_feature (91)..(91): n is a, c, g, or t
  misc_feature (225)..(225): n is a, c, g, or t
acagcactacccacaccgtncnnatgggggtgtgcaccagtaccgactccagccactgaagggtcaggagtcaagactcagacgggacttncctagggcttctggatttgggcaaacagaactgaatgagcccatagctgcttccttccagctgcctctggaacctaggccgagcatattgctgaggaacggggggtacaaggtgccagatgattgggtctggtngacaagaaacaagacttgtggtcacaattggcctctgcttcggagaaagctgtaaatcttgtctg

SEQ ID NO: 701193 - DNA, 1123 bp, Homo sapiens
gcaacaatctcgtatggagcatgtgaacaccgttgaagccttgcatgagtatccagtgatgtggtatattatgcatgaggtcgatccagagcataactagctctctctccgaagtcgtcgttaagctccagacactagaattagcctgcacgagtcccgtttcgcgttacccactactgataattgtagtagtgatcgcatcgagtcagagggggagctggatgatgaactgctgcatcatggcactacggtgaagcaccttgcgcgtgtgcctgtgtggtgtcagatgctgattgtgctggagtgagattctggtagagatagacgggacgtcgctgaggatagaaactggcccctggggtattggtggtcatggactctgaatacacgtcccatcgcatctactgacgagccacgaagtacacaagactcggagggtctttgttggtcggtaggagttccctacttgggatgcttatggggtagtcaggaattgcaccgatggacttgtggggattgggcgaaggagaagataaggctaggtatgcactcgtgggactgacctatttcaaccacatcatctgactgagcgtagtgatggagtgcctcttcctagtaggaagcgagagcctgcttgatcgatggcccacttggcattactatggaatgattacagccgcctcagtcttgggcgtggcctgaaaggggaacatcttggagagtgtccaagtgatccttctggcatttatggcgtcagacggttcaggggtcatcaatgctaattatgccagatcacgctacttcccgtcgtggggggactcatgctagatcaggggaacttggaactagaaataagaggactcttggctttgagactgccttcaaagagcctggttggagcactttgaatttgacggaaaacatgggaccgatggccacggaggaaggtggggccagaagagcccgcaaggtagtgttgtataaacctggactggttctgtgcttcaggctccaggggacttcttagaaagagtgtgtcgcatatgccggtgggcagtagcctgggaatccagattttccccgatcagggaagggctccactgccgcactctttgaaggactc

SEQ ID NO: 701194 - DNA, 426 bp, Homo sapiens
gaggggctccccccccaaatacccccccaccagggttaggtgaccattcaggtgatggtctggcggttgttgactgtctttctaaagtaataattggtcacacccggcaacagggaaaagccggctcctaatagatagaaaacactccgaaactggtgagcagtagtttccctataagatctcaggagttgagccagtgggctcaggcaggcacatgggacagcccaccccaagggaagaaccaggggagaaataacgcaagaccccgaaagcatgctgacgtataaaaccccaagtcaaaaggtcaaaccacgcacttgctttttaagtcgtccacttggccctcttccaagtgtactttccttccttttgttcctattctaaagcttttaaataaacttttactcctgtgctaaaacttgaaaa

SEQ ID NO: 701195 - DNA, 177 bp, Homo sapiens
  misc_feature (11)..(11): n is a, c, g, or t
gatcttaaganctaaccccactccaggccacaaggtatggtggggccatgtgcagcctgcacaggacttcagcccccactatgcacccaacacccacagatgaactacggtagctctggacatcctgtctatgacctcctacatcctagaaaaccctattgcccatgagttttgacc

SEQ ID NO: 701196 - DNA, 800 bp, Homo sapiens
gggtgcgcgcggagcgaggtggccgcagcgtctccgcgcgcggccaagcccggcaggagtgcggaaccgccgctcggccatgcggctcccggccggggggctgggctggtgtgcccgagcagccccctgggctcacgtccccggtgagcctgagcccgagcctggtggcgcctcccgacaggcaccatggtgcaggaatgtcgcgcaacgggtggcgtataccccgtgctctgagctggggggcgactgatgctgatggtgggcttcgtggggcatggaccccggtgctgcgcagagatcgcaaccgggtgacgtgggcgctgctgacttcgcctgggtctagaggccacccaacgccgcgagagcgatccttcagcagaccctcgctgctggggtggctgccggacgcaggtaaagcctccctaatgtgcaaaggcgttcttagcgaaagcatggacgaattgtcctctacagggttgcttggagcggctgcgccggaatacggcgccggtaacttctttagccacggcattaccgttgtgacccttcgcgttggtattcacttgcacgtgcgttcgtggatcggtccgtggggtttatgccccacccagtacaagggacgttattggacaaccagaacgttgttcggtaaggtgagggggcccttcctctacaatcccgtggggaacactcgtggaccatacttccggcggggttcacgacacgtaggacgtaaccatccagacggcgggactcctggggcgcagagcgcgtaggtagacatcgccagggtaaccttg

SEQ ID NO: 701197 - DNA, 133 bp, Homo sapiens
acatagatccgtgtggttgagagctgggtagggaagagtgtgttcagttgcactggggtggtgtggactgttgttgattcctcactacgggccaaaggttgtggaactggcagaaaagtgtgttgtggagttg

SEQ ID NO: 701198 - DNA, 278 bp, Homo sapiens
  misc_feature (54)..(54): n is a, c, g, or t
cagaaacagggtgtgtgcttcccaggcgcacagaacccccaactgtgtgcaccncccccaccttctatcacaaactcactattgacagtgcaccacccacctgctttgtgcaacacaaggaaacacccaataaacactggagacagtgtcaggccaggcatggtggctcacacctgtgctcccagcactttgggaggctgaggtaggaggatcgcttgaggccagaagttcaagaccatcctcagcaatacagagagaccctatctctacaaaaagtt

SEQ ID NO: 701199 - DNA, 225 bp, Homo sapiens
  misc_feature (35)..(35): n is a, c, g, or t
atggtgatagtgctatgaaaaagaataaaacaaanataagaaagaggcagaaaatgatgggcaagttgtcattttataaaccatcaacctgtaatgcttctgtcataggtgacatttaagcagagacctgaaggaaggcagggagtaaacagaaatatgaggcagagcctcaggggctttgcccttgctgtttcattttttctccattatttgctgaatggatga

SEQ ID NO: 701200 - DNA, 244 bp, Homo sapiens
gccaacccatgccaatgtccatcaatcccagtattagcctctgttaatctattttctgttgcttccatatacatttttcaatgcatatgttgctcaaaggtggcaagttgttctgggttttgtgagtccttaaatggattttattttttatgctggggctaaaagtaggtcttcaaatatgggattgttgttcccaccctgtgctgttctcccagtggcccaactttttttttctgtttaatta

SEQ ID NO: 701201 - DNA, 485 bp, Homo sapiens
ctgccgctactactaccaaaacatcttcaaagaactagaaaaaactatttgaaaattcatatggaaccaacaaagagccagaaaagccaaggcaatcctaagctaaaagaacaaagcgggaggcaactttacccaacttcaaactattacttagggctacaataaccaaaaccgcatggcactggtacaaaaacaggcacagagaccaaggggacagaatagagagtctagaaataaagccgcacacctatgaccatctattcttggacaaagctgacaaaacaagcagtgaggaaaaagagtccctattcaataacgggggatacgggctaggctagccatatgcagaagatggaagctggactcctttcttataccatacacaaaaattaacggaagatggattaaagacaaggtaaaacccaaaactataaaaatcctggaagaccggccgggcacagtggcccacgcctataatgccagca

SEQ ID NO: 701202 - DNA, 345 bp, Homo sapiens
agggaagtgtagacatatggagagacacaaacagatttgtgcgatatagtgttttttcaaagacaccacgatgtggtaaatgagaaattatataggtcactttcctgttgtcatgaaactttggcttaagaaggtgctggatttcaagggttgtaaaggcattttggtaaagactggtttttgaatgcgctatgaatttgcattaacttgacatgagttgattctgaccagacttgaggggtttaagtcggaaccggtaaattttaaaaaggagaaataatttgacctataagtatcatgaaggtttaatgggactttggtatgatagtgggctctcttagtcgt

SEQ ID NO: 701203 - DNA, 291 bp, Homo sapiens
aacggaagagcgggtgttgcatgtgacccacagaacggggggaaagctgcccagaataggtgtccctgtgaccatcatcagcaggggggaacttagcgccgactgcatgctgagcgtagtgacaaggtcttggctcgagtggaaaactcagaaacaagtcaatccttgaagcagttttctaattattacacccattttccctgaccaccttgcctgctgaggaaggggccgggggaagacggctggattttgacttctggcaagtgaacccaccgccgggggattcctcct

SEQ ID NO: 701204 - DNA, 505 bp, Homo sapiens
  misc_feature (18)..(18): n is a, c, g, or t
  misc_feature (50)..(50): n is a, c, g, or t
  misc_feature (120)..(120): n is a, c, g, or t
  misc_feature (421)..(421): n is a, c, g, or t
  misc_feature (477)..(478): n is a, c, g, or t
  misc_feature (480)..(480): n is a, c, g, or t
attagaaaaaaaaaattnggtggtgttgcggccggcgcaattaaaatagnaaatttaatttttttttttgcgggaaaaaaaacaaatcacacaggggggccgggggttttttccccgccnccccccaaaaaatatattccccccctttttttttttaaaaaaaaaagggggggggtcctcttaaatctttttaaaaaaaacccttcttttttggggggggtataaaaatgggcccccccccccaaaaattttttctccgggttctcccccaaaacaaaaaaagaaaagggggatacccccccccaaaaaaaaaacgggggggaaaaaattttttatcttttcccccccgggggggggaataatatttttttttgggccccagggtttttaaaatttcttttcccccaaaaccttttatttnggggtaaaaatgggtttgggttaaagcttgtctggcctcgtaagggtgcttcgtgnncngaaattccctgccaggcccgcgggg

SEQ ID NO: 701205 - DNA, 517 bp, Homo sapiens
cccttaagattttgagcatcacaatcaaaacctgatcctgatctcacacacacagacacacacagtacatatatcaatacaaaacactgtattttttaaatttttttgcgacagagtctcactctgtcacccaggctggagtgcaatgacatgatgtcagctcactgcaacctctgccttctaggtttaagtgattcttctgcttcagcctcctgagtagctgggattacaggtgcacgccagtgtgcccagctaattttggtatttttagttgagatggggtttcaccatatgggccaggctggtcttgaactcctgacctcagctgggattacagcatgagccaccacacccggcctaaaacactaatgtttttagtggtttctaaacatatcctcacaaggaattttttatatctaaacggtgagggggttcccctcttatggtccaggttggattgcagtggcgcaatctgggctcattaaaaacatcgcgcctccctggtccaagtgatcct

SEQ ID NO: 701206 - DNA, 151 bp, Homo sapiens
gtctgctggccctgagacatccagtcttccacatcaactctggatggacgtgcgtgcttaccccatgaggctgtccaggctctggcacacagctgtctcacaaatactggctggcttggtagagctaattgtagtgagcctcaggtaggta

SEQ ID NO: 701207 - DNA, 865 bp, Homo sapiens
ggggggttgggccggcccccacgcagctcggctgccctccccgccccagagtgaggcctggtgccggagacgcatctgtcatctcccacgccctgggcctgcgcagcctccgctgtgagttggtgccccagctggctgggctcagccgcggctgctctgtgctaccactgtgcagttctgggccgctgcggggcggggaggcgcaggcgggtggactggtgccctgctggtggcctgcaaactgcaccacgactgcatggtggccctggcgcacgggcaaccgcctacctgtgtgaccgtgacctgcctgccttccgctcgtggccgcgaagagcgcgctgtccgccaaggcctgcacgcccgacggcccgacgcccggagcccacgccccgtgccccgagcaccggacccggggacccggcagccggtgagcccggaagccggcgtacacccgaccaccccgagagggccggagccgtacctgaggggccgcattgtgtgccgaaagccggagcggaaggcgcccaagcccggggcagactgggttgcagggcacgggcataacaccaagacgagactaccgggcggagcccgggaccgtactcacctggggcgcgcaagagcagtaccgcggccgttggggaccatgacacgtcacaaggggggtggcgaggacgaacgccctggcgggggagaccgagggagggagcggcaccgggacgcaatagcacggcgggcaggagccgcgggcggacaggagaggggcaccagggggagaggggaggtggacgaggggagtacggagcgagcgaaggggacaagggggaggaaggccagggggcagaagcaccggaggggaggaggc

SEQ ID NO: 701208 - DNA, 879 bp, Homo sapiens
  misc_feature (879)..(879): n is a, c, g, or t
gggcgccttggtgtcgcgggagaggctgggggccctcaacgctgccctggggccaggcggtccggtgtggagtcaaggagacgcgcacccagcacactgcgttcccgatactttctggcaccgaaccgcgcgctgcaggcgcgcttcgatgacggccaggttccggagggtgggctccatgccctcgcctgcctgcagggccccggtgtggccccggtgctgcgctgcgcgccgacccccgtcgggtctgtctctccaactgcagcggtccgccgatcttcgacgcgctgtcctcatgcgccgtggccgcctatgccacgcccgcctcgcctgcctcgctgggccagcgcgtcttactacactgcccagcactgcgcagctcccccttgcgcactccgcttgagccacgctgcgtacgggtgctcgtggcccgatcaccgtggcgcggagcccttgctgcgctcacgggggctgtgcggtgcggccttagttgcccacgctgtgcgggatccggagcattgcctgacccttccttgcaggtaactgcgtggtggcactgggccgcttgcctcgagagagagcttcactcacaacgaccctgaggagcccatcgccctttgacagaaacttaagccttctgctaacatgacggggaggaccactgtccccctggggatccgtaggacagaacttggtgatcttgaacgggagctggctgagaaccacaaagtggcccgcaccagcactgagacttattgaaccccaagcttgcaacaaacatgtcatggctgactgaagggatactccctcttctgtagctgcgctgacgctgccaagagggctccttatggcaattggccccgaagcacacgccaacan

SEQ ID NO: 701209 - DNA, 167 bp, Homo sapiens
  misc_feature (106)..(107): n is a, c, g, or t
gattgagaatccgaagtttttgagaaaggtgtcaatcagttagaaagcttatttgggcaaggttaaggaaatgtttgtgaaaaagcctcaggaggtcctgaaaaannttcccaaggtggttggggcacagattgtttttaatacattttcaggggagacgcgaaatt

SEQ ID NO: 701210 - DNA, 105 bp, Homo sapiens
  misc_feature (3)..(3): n is a, c, g, or t
gtnatacaagaaaatgtagggacttttgtttgggtctttttctctttgtggctgaggggaaacaagtcagtgtccaataaagctgtaaactcctctgctctaaga

SEQ ID NO: 701211 - DNA, 179 bp, Homo sapiens
cagcacacatctgcatcaataattacggtatcctgcacttaaagtttgcactacactatgcggactaacactaactgaactacagatacttaccataaccacccaaaccatcaggagtaccatatcctccactgtaattgttccccattcccattcttccaactgatccatagcctccc

SEQ ID NO: 701212 - DNA, 314 bp, Homo sapiens
gtaagacattcaatcaactgctatgagagtacttaaacatatatgtatcactgagtttacaaatgatcatatgaagtcacactggcatatgctttatgagtcatgtacaagcaatgcaatgaaacacgtacctcaggtttcttcgttatcgcgatgcataacgtgtgcttgttcattgggtaaataatgattgaaacatctccaaaggcagttgggataatacccctgcggtagtctctggagtgttcagaccagacgatatggacctcgtcattccccaagtgacgaagctttttggtgagggaatcatctga

SEQ ID NO: 701213 - DNA, 682 bp, Homo sapiens
gagcggagtcacttcatgcgtaccggtgtggctgtgaccgttggtcctgtgcggtcacttagccaagatgcctgaggaaacccatacccaagaccaaccgatggaggacgaggagggttgagacgtacgcctttcaggcgaagaacatgcccagttggatgtcattgttttcatcaagtactttctactcgaacaaagagatcttgctgagagagctcatgtcaaattcatcagatgcagtggacaaaatccggtctgatagcttgacagatcccagtaacttagacgtctgggaaagagctgcactattaatccttataccgaacaaacaagatcgaactctcactattgtggatactggaattggaatgaccaaggctgcacttgatcaataaccttggtactatcgccaagtctgggcaccaacagacgttcatggaagctttgacaggctggtgccagatatctctatgattggccagcttcggcgtcggttctctcatactgctatatttggttagctgagaaatgtaacctgtgatcaccaaaccataacgatgatgacgcagtacgctctgggactccttcacgcaggatgaacctaatgggtcgtgggaaacaaacagttaatcctacaccatgaacagaatgaccaacatgagtacttgaacagaacgaccga

SEQ ID NO: 701214 - DNA, 235 bp, Homo sapiens
cttacgggttctacaactaaatctgattaaccctttgcctcttccttcctcgatcagacatagagcctcaccttttcctggtagatccctaactaggacatagtgacagagagagcccatggccggtcctcatcaccctcctcccttttgagctgcatgaggtccatgagagcgcgggggatcaccccaggttgctctgggccgtaagacactaaccgcggtggtaccgagctcg

SEQ ID NO: 701215 - DNA, 428 bp, Homo sapiens
aataactagagcaggcactttaccacctccagctgactatagcatcttcaagactcagctacacgtcatgttgtccgaaataagccttactaatccctgcaaagggaatatataatagaatctccacttcgtttaacgatcctatggaacgaggatgtgtttcctagcttcaacaaattttctagattttgaaaatggttatacgcgtgtactttaccaacatactacctagacactattcctaggggttgtactggggcagagatgctataagtcaaatcacataaatcttttctccctgaagaatacaaaaattatgagcagcttttaatgctgaaagttaatgactacaatgcagttttactggcactgtactgtcaagatttagcgtgccaaagtgaagttcacagttatgttcatagttttaa

SEQ ID NO: 701216 - DNA, 796 bp, Homo sapiens
  misc_feature (445)..(445): n is a, c, g, or t
tctgagatggagtctcattctgtccccaggctggagtgcagtggcgcgatcttggctcactgcaacctctgcctaccttgttcaagcaattctcgtgccttggcctgccaagtagctgggactgtaggtgaacattaccacacttgggtaatttttagtagagacagggtttcaccatgttggcctgtctgggggattctttataccattctgctagtggtagggcggtatttattaggaattttttgcttcattaaattgaaacaaaagtacagtagaaaatgttgtcaggcccatcatcagaccaggatatttgtacggcaaaatgctcagcatgagtcatacttctggtacgcacttctgttgcatgtgacagcacactgccattcgcaacttcatcatttgttctttcttgcggccatgactgtcaaatatcatacatatncattatgaaagctttaggcaccaagccaatggctcccttcatttgtcctacccaccagccatatctatagaattccttgctaagagtgcaaatcacatctccacgcttaatggacactcatctgaaaagctccagtacagtacacatccctgggtaaaataaccataatagtgtttttatccctgaggtggatgacgttatctgactcacttcctttgttcttcacttgcactggaccctggcctctttttttttggaagttgtcataaattaaatcacttttggttaactgctgctagtggttgctatccggaaggatgacaacctactctaattctccttttccaaaat

SEQ ID NO: 701217 - DNA, 379 bp, Homo sapiens
  misc_feature (236)..(238): n is a, c, g, or t
gtctattaggtgactatcacaaacccttgaaagagttgaaacaaatgtgtttaaacacagaatgggttgaaatgaagagcaaggcggggattgaatgaggaaacagtgagctccgggattatcgaaagggtcaccggattgcctgccacaggttttggagctgtctttcctagacatccaccggattggagcaaaatgttagtagtccctaaactgctacaactgtacattactgnnntcttgagggagagggcttgtttgcaggggcaaaggtatgacagggtgagccaaggccaacaaaatgccctttacatgacatcttcgacttgcctttaaccaaatgttttctcctttcacacacacaacattaataaccgta

SEQ ID NO: 701218 - DNA, 1180 bp, Homo sapiens
  misc_feature (484)..(484): n is a, c, g, or t
  misc_feature (957)..(957): n is a, c, g, or t
  misc_feature (1180)..(1180): n is a, c, g, or t
agcgggggtcggggcgtggcgggggtgacggcgggcgctggcgggcctgtgtgtgctggcgtcgggggcgcggcgggcctggcggctcggtggctctggtgacgtgcagcgggcggccggcgtccgggtcccgcgctgcatcgctgtgcagccgggtcgctcggccggtggcttggccggggtagtgcgtgactgggcgcgaggcgctggaagttcagagtgtcgctgtgtctctacttcatcctggataccgtgcttgggtcatcggcgcttcttacctgctggggacctctggggacgcgggcatgatgtattccaccatgcgcgaaatgactaggactctccccatgtagatcggaggagacttgggcaacggtaatgactgacatcgggaaatggacaaggtcttgtgtcctgtcggccccactgaggcaacacagtcggattggcgcagtaagtaactttgcaccaccggtgacaggtnttcgcatagaatccggaatttgcgacatggacaccccgaaaggagagtgactggaacagcgaaggcaatcgaaacaagagggtttcaccgtatgagaggggaatatcgcagacgcaagcgccgttaacgcagagggtttcggtgaaaggtaggaaggaagcgcaattgcggggaaaatttgtggcacttaccacgtacaaaggcgttcctttgctaaggaagttcgttgccaggtccaattagattcacaatagcacctttaaattaccctagggaagcgttaaagaaaaatttcctagtagcaccgttatggaacgcggacggggaatagaggaattccgattcacatttggaatccctacgagtggaatggatccagagaggctaatccgtgtataaggtgagaaggataagggttccacgcgaaatcaagagaaatggagcttccatcttggcagtgcttagggcgaacngctagtcatcttgagttcgtacattggctacaaacacgaattataggttagcgctccacactctgggggtaccgttttgggaagtaaattacgacgcgtagttttttcccctttagagaacccctttcatgcttgcaccatggttcgtcgaacgtacaagcttaaccccccccctggtttgtaaaaaagcacttttcttccctttagacttgtatacaccccn

SEQ ID NO: 701219 - DNA, 552 bp, Homo sapiens
tgaggttccccccgatcccgatggcccactgaggggtctcgcttatggcggcgggcagagacgctcctcactttccagactgagcagccaggcagatggggctcctcacatcccagactgatgggcggccagtgcagagacgctcctcacttcccagacggggtggcggccgggcagaggctgcactctccgcactttgggaggccaaggcaggcggctgggaggtggaggttgtagggagccgagatcacgccgctgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaacacgaaaaccagtcaggcatggcggcgcgcgcctgcaatcgcaggcactcggcaggctgaggcaggagaatcaggcagggaggttgcagtgagcagagattgcagcagtacagtccaacttcggctcggcatccgagggagac

SEQ ID NO: 701220 - DNA, 223 bp, Homo sapiens
catgcatcccaaggggccctgcctcagtgatgtgtcgatctctatgtactgcctgcgaggctgtctgtatagaggatagtgcacatgcagctaggcccaggtgcagccatggatcatgtagacttccagatggtctcctgaaccgccttgcttttccggcggccctcctaacgtaagagcaagcagccgtgaccctaagccgagctgttgaaggccctcccgt

SEQ ID NO: 701221 - DNA, 171 bp, Homo sapiens
tacaggatcccttatcgaggaaggagaggtgatcaagaggtttgctgcccagttgaatgctgttgcagaaggctgaatggctcttcctcgtatctccacagggtagatctcgctgagtgacaagccaggtcactggcccaaacccaaaggggaaggcactgacaacgacct

SEQ ID NO: 701222 - DNA, 1250 bp, Homo sapiens
gaccgcgtgtgctcgcctccctgggactaggctttcagcgggcgcatggggatgaccagaaataatggcagatcccagcacggtgtccctgtaggctaccagtgccgagagtgcatgttgttaccggtgtggtagcgcaccttgtaccagtgtagtctggctaggtcgaaccatagtaacgcgcctcatcagacgcaagatcgccatggacgtattctcggccctgctctctactgcgggaaggcatcgtatcgatagagttgcatcataggagacagcgagtgaacgctagaagcagattgcggagcgggggtgaacagagggttcagaaatttgttatgaaaggagagaaggggatctatggttttgggctggtaggacatcacgtgctccattcgaggtataactgtccattcgtccacagtcgatgtagttgagggaacgcggacaattttgcgccgtatgtctattagtccccgctcagagacgggaatcgggcgtgcgatgcgcagctaggagttccgaaagcgccccaacacatgtgtggattaatgggtccaaacgcacacgatcgtagcgtagttacccaagggagtgcttacggatccgagctgccctggaagcgagggatgggagaacccatgtgccacatatccctcataatgacgggtgcatccgtgatataaaccatggggcaaactgaccgggtgaggaacgctagtatggggcatggctgcatgggaacgatgttgcgatgttcctccctggctcatcgcatcagggtgaacggggcaattcttacccaagggttgtcccagagggacatgggccctttacttttcccagcggcaatggtacttagcatgggcctttttcactggaagagggttaaactgctaaggtcttcgtgggtccccttcgaagggggctagttctccctggttggaaagcctaagaggggctgtttcccgaagaaatgttggtagctggaggaaaagtgttcacattgttaaccacctagtggagatacgccacacaggaggacacccaaacagaagggccaggggggcgttgcatctggagggggagagggaatacggagcggttcccgacagggggaaacgagggccaaagcaggggtacggaggaagaaagcacactggtcgcacagggggggacccacgggggagcaggacaacagagggaaaccgtcggagaggcggaccaaccatggtagggacagcgcacga

SEQ ID NO: 701223 - DNA, 942 bp, Homo sapiens
actagacctgtcgtgtgggtcgcgctcccagacggtaatgtgacactattgattattaggtgtttatctagcgtagatcgtggtgcacagccgccctcagttgcttcgtgattcctcaatcaaaggttacactacgtccctgggtgtggccctctctgatgcgtacctagatacaaaatcacaggactgagacgtatctagatagtcatttacagaaattctcatcgacatagcagtacccagtgctgagagctcaagatcattgcacattcacgcatcgtacgtgctcaatctgccctccccatcccctaagggcattccttttacaataaccacggacggagcgttcaagagatcaccttcgcacgtttaaagccatttcaagagtccaaattttgtggccacacaaagttggattagccttggaaaacccataccggcatattaaccagcacgaaggtaacctgggaggcactataattctttacaacagcgtcccgtaacagttagccttgtagccgcagccaagataagtttccccgtaacgaaaaactccagggggacggaaacctggcaggaagttccattaggacacgggttaaggtacaaactcggaaggattagttaaaccgtccccaggaagttgtgaaaacggaccacacccgaaaagaacggaactaagacatagccgtttacctgggtccagcacaaaggggaaccgtgttcattatgccacactcaagtagaaggccttggaccagcccaggcaagttgaaggggccgtgtacgcacagcaagcaggggcattgcagaagtaaccacgtggaaagggatcatacagagcaaagcagaccagagatatagacagccggcaaacgcaccgaacgcgagggggtacaaaccaacggggaacaacgactccaggcaacacccaggtagagg

SEQ ID NO: 701224 - DNA, 322 bp, Homo sapiens
caaagatgttaagctgttatattaatgggcttttatgtaagttatatagttttaatttggaacttgaaatagcattagtgtgaggtaagtattttagtaaatgctctgtgagttgatgcagaagagaggaagagagggatttagaaagaactttgttttttttttttttttaatgatcagttaatttcccatgtaatattgctgtaaatgatgtgtacagataactctgttcatgtattcaattgtaaacttgtcaatatttgcatttctattgcttttgtatggaatgataattgcaaaaataaagatgctttaactgata

SEQ ID NO: 701225 - DNA, 980 bp, Homo sapiens
gatcctattgcctggctgtcttgggatactagacccaataaggagggttgcagtgttgagtcgcagagagactccaataaacgatgtgtggcagatatgcgacaggtgtcccagggtgggaagatcatcgcttgcggccgttctgactcgcgattatgctggtgacaggagacaggtaagaaaatgtggaccccattgtgacgaacgcatctcgcttggcgttggtgaataggtggatcaaggaatgcacgtggtgaacgctgatacccgtacgaggtcctattggactaatagcacgaagcatagggtagaagcaggtcaataggtgatgactagcgggtcgactgcagatcgatgctggtgtttgtctacccgtgactcgaacgatcacaacgtacgcacaaatcatctagagagagccaaatgatgagtagccaccataagagaaagacggaaatgataccttcgagtggttacaagctggacggttgggagctttaccttctagggaatgcatgcatacaaggtgtgcgttgggagatcgcttcgtgagcacgttttggtctcttgatcgttggatggacaattcgactttaagggcgccgaaagatggaaaccgtgcgggtggcaacaatggaattccgttgagtacttgtacctggacttgaaaacattggcggtggacgcccgatcaacggggacggaccgcggaagataggaggcgcgatctccaaggcgaaagtgttaggcgcacgcaaggaccgcgggcaagggcaaggacataaccgaacgtgcatgagcgaatactggagatgccgaatgcacgtttggacaccactgaacgcaggaccggcgcgagagagtcgcccacaagcgggtgaaaccagcggcaagggaacacgaaaaacgaaagaggcgagtcgattaaaaaagggagcaaattagaacgccgaaaaaaatcgggccacaaacgattaggc

SEQ ID NO: 701226 - DNA, 101 bp, Homo sapiens
ctcagctcggtaccgtgatgttatcgcccaacactatagtaaggcttaggttctcacttcctgtaagacaaaaatcttgtaaatctcttaacttttcttaa

SEQ ID NO: 701227 - DNA, 180 bp, Homo sapiens
agctttggcttatacaagtgtgtagccagaatgttgctggcaggcggaggtgctcctgccaggtcactgtggatgatgctccagccagtgagaaacaaggcccagagatgaaatccggaggccaagagctctcttcctcccgtgctaggcactgagagtgatgagactgtgggtggcatt

SEQ ID NO: 701228 - DNA, 172 bp, Homo sapiens
gaggaattactatttgcgaggaattactatttgcgccgtaccaaaaccactgatggtgatatttgaactgtcatctgcccaggcaccagacaccgcagcagacattaccaataaggccataaaaggttttaatttcatgctatctcctcgaaagtttcttcattttattcct

SEQ ID NO: 701229 - DNA, 258 bp, Homo sapiens
atcgcgaaaacacgatcacacacagtaactaccaacaccatggacacaaacacagtcacgtcacgttccatcaacacatcaaccaccaacaccatcaccagggacacattcatgtccatcaacacatcaaccaccaacaccatcaccacggacacattcatgtccatcaacacatcaaccaccaacaccatcggcatgagtacattcacatccaacaacacatcaactaccaacaccagtgccacaaacacattcatg

SEQ ID NO: 701230 - DNA, 899 bp, Homo sapiens
agcagacctgatagatatctgcagaactctccactccaaaacaacagaatatacatttttctcatcatcacatggctcttaaaaattgatcacataatcggaagtaaacactcctcagcaaatgcaaaagaactgaaatcataacagtctctcagaccatagcacaatcaaattgaactcaagattaagaaattcacccaaaaaattaaaacaaaaatgaaattaactcagaaccacacaactatgtggaaacttgaataacctgcttgtgaatgactcctgggtaaattactgaaattaaggcatagatcaagaaattatttgaaactaataagaataaagacacaatgtaccagaatctctgggatgcagctaaagaagtgttaagacagaaattaatagcactaaatgcccacatcaaaaagctagaaagatctcaagttaacaacatcacaactaaacatagagaaccaaaaacaaaccccaaagctagcagaatacaagaaataagatcagagcagaactcaaggagacagagacacaaaaaatctttcaaaaattaacaaatccaggagctggtttctttgaacaacacaattaatagactgctaactagactaataaagaagaaaagagagaagaatccaacacaatcagaaatgataacaggggatatcaccactgaccccgacagaaatacaagcaagcatcagagaatattataaacacctctctgcagcgtaaactagcaaaatctacgcaaaacgagaatacattttctggaacacatacaccctcctaaaggctgaacctgggacagacatttggaatccttgaatagaccaataacggacttctggaattcgaggcagtatacgttaccaagaaaaacacaacaa

SEQ ID NO: 701231 - DNA, 1084 bp, Homo sapiens
ttcaatggatgctgctgaccaaaaatgggcagctacagatactacttcaatgaaatgtgagctgactgagttctgacttgtggggctggtgttttgacggatgtgttctgatgatgtgactgatggcctgtccctgccctgtctttgagtgatgaagatcatctggcaaagttggagaaggtggactgataggctggtgtgtgcttggccgcttgtgccatggctgatggcccttgtgctggtgcactgggtgtcactggccagtgcatgattgactctctgtacatcatgtgatgccctgattgggtgaacatgttgtttgtgtgttgtaaccacccaatccctgttggtctaccctgatgtctagatggcacggtaaggaggtgtcccatccaatgtggtccacaatgcttcttgtcctgcccccaaggcaggcagccttggaccacatcctcatatgcaatactttggagtggcccagcccaatgtgaaggcagccgatggtcccatgctgccagcttcagtgtgaccccacccacatccccctggcaacctcccttgggcacgtgtgctggcgatctactttccctctggcgatttgcccacgtacccaggtctggctggggcccagtgcccggatgcagatggcctgctagggcctctgtcaatttgtacgcgccagcgagtgccttcaacacagcttgtctcttgccttggcacttgtgttgactccgcgcgactcgagcccttgcacctgccttccagccgccggcttgtgcatgtcctggggtcctccttttccagaaggcccgtgtacacacttgttacatctattacaggctatcgccagcagtgggatagaccgaaggtctaggatatccatttgcggattggacgctggtaccaatactgatctcccaaacagccacatcggaataactacatgactcaacgccggcttctttgaccctctacacaataattcaaactctcggtgcgcgccacattagaagacacactagagagccaacaggtcatcgtagcgcgcacatttatcacaccgggccacataaggatccaactc

SEQ ID NO: 701232 - DNA, 756 bp, Homo sapiens
gtgctgccttcccatccagcgagtctgccagcaatggcttcttcatcctttatatgtctgcttcctattccctgtcttccacatacgtcacttactcggcagtctttctgcttttcattaagcctcaaattcctctgtctactggacacaagctatgtctatatttttctgactggcaggatagtcagggtcgcagtgtataccttcatataaatgggcctctgggatgtgctcttcaggagctttggtaatcaatacttctctcagaagtatgagacatcctctgactctgctctgtcatcaaggctgctgggtggagataccctttgaaaggggcttggtgagaggtatggagccagtctctagtgtgccaatcactctatctctggcctctgattctcaattgtacctgtgtggctcctctgttagtgcaatgttgactgttgacaaagcagcagtatgcttacaggttgcttagttggggacaccgttaccaccagaattggctgctctgacaatatgcctagggactttctacatggctctttatttaaataaggaggcttggcaccctataaagcctcatgcacttcacacctttgcagcatggtttatgcctcagtgttatgtgcacctggaatgtttccacttcagcatttcccaagtagaaatattagtgttacggaagtgccttagtatccagtccaacatttttttaaattaaatttagtgacgaaacagtttgttgcgtgacac

SEQ ID NO: 701233 - DNA, 502 bp, Homo sapiens
caatatctagatcattgtgctacagtctatatccagtactagcattgctttggcttttatatatggacatggttctttacttaaactcatgaaccagctctgctagtttccaactattcttctgcagcttcctcaaactaaatagttagaggcttgctctgggattaggcactggcttacaggaatgcgggggctggtttgatcttcaatctagaccactgaaaattcctccatgtcagcagtgagtctgtttcactttcttaccattgatgtgttcactggagtagcacttgtgattttcttcaagaactatcctttgcatattgcaactcggctgactggtgtaaaaggcctagctttttacccatctaggcttttgaaatatcttcctcattaagcttaatcatttctagcatttgatttacaagtaagagatgtgcaactcttcctttcacttgtatactaaaagggcatcatagtaggattttttcttttgatcttt

SEQ ID NO: 701234 - DNA, 395 bp, Homo sapiens
tacggggacatgagacacagcctaatagcacagaaactcacagaggacgagtttcttagttttgtcatctctgaaatgggaataataatattactcccaccttgcaaggctttgggattagagagaatgtaaaaaggtccatgtgagaggtcctcgtgggttaatgtgtggggggagtccccagtccctccccgggcactcagagcgatgtgggaagactgtggagcccatgcttattgatgctgtttcatttcaattaaacctccgtcagaaacatcgcatgacatcaaaatggaagagatgttgagtctgaacggtgaggtcatagattttgtttttatttatgtattttccaaataaaaatatgtatcatgttttctcatcaaaaaaaaaaa

SEQ ID NO: 701235 - DNA, 213 bp, Homo sapiens
tgtcggtaccgctcattgggtggctcatcgggtggctcgttgggtggcgtggagtatgacaagttcattgagtccgggcgcaagtggttttgccacgtggatgatgacaattatgtgaacgcgctcgtggtgcccctatctccttgttccaagggcctctcttgccttgaaagccctcttattacaccatgggacccgaagtgcccctaagag

SEQ ID NO: 701236 - DNA, 549 bp, Homo sapiens
  misc_feature (507)..(507): n is a, c, g, or t
accgacccaatgagctacttatgtggcaaagggaaatatttaaccaaccccagcccactccagccatggggttcaccgaaaaatccaggaataagcagtggggaaaactgagaagtcccttgcaaagttcacggtccagaggcacaggctcaccaaaagactgagacctaattatggtgctacagaatgctgcccctcccacacaccttactaccacattaataaaggccagtttacatcagtttctttaacccaatacatgtctggtcatcaagaaaaaattacaagactcagatatggcagaaatgctggaattatcagaccaataattaaaaacagctataatattctgagggctctcatggagaaagcagagagcataaaatggagaaagtagacagcataaaagaacagatgggcaatacaagtggagcgctagaaatcctaagaaaaaaccgcatagaaaggctaaagataaaaagcactgtaccataaattaagaataanttaatggacttaatagctgactgggctcattgggttccgatg

SEQ ID NO: 701237 - DNA, 369 bp, Homo sapiens
  misc_feature (6)..(6): n is a, c, g, or t
  misc_feature (202)..(202): n is a, c, g, or t
  misc_feature (214)..(214): n is a, c, g, or t
  misc_feature (295)..(295): n is a, c, g, or t
  misc_feature (310)..(310): n is a, c, g, or t
  misc_feature (312)..(312): n is a, c, g, or t
  misc_feature (319)..(319): n is a, c, g, or t
aaaacnaatgctcgggcgggctttttgttggcgtcgacgattgcgtcgcggctcaaggcgttggcgcttgcgaacacgtagttcgtcattccgagcacgcgctggtaggtgccgagcgactggatgccgagctggtaatcgtcgtccgccgcaccgagcgccgtgaagaccggcagcagatgctcgtcggtcggatgcatcnaacccgcgtgcngctgccggcggtagtcgagcagtgcatcgacgtcgcgtgcgcgagtttcgcctcgaaccagtcggtgaattccgtgacacngggtccgcatcctcngngccggcncgaaatcggccgcgcgcaggttgtgcgtgatctgcccgagccgatcacca

SEQ ID NO: 701238 - DNA, 588 bp, Homo sapiens
tcgacccacgcgtcctggctacatctggaccagaatcccatggcaatatcccacggctttaaggtgcataatatctccgctgtgtggtacgattgtcaagtcaaaaacgggacatgttctatccagcaaacgctaccccaactactgacaaccacaacagctacttctatacgacttttttacatcgacttacctgactacttacctgatgaccctacacgagactttgtctactaggtacctactactcttgacataacctagctactttaccacaacatatgacgtccaccctggcttatctatctaacccgctcacgcaatcggacgctgcatgctgctgctgctcacactctctgaccacgtggcctacaagccatctcgtgcttagccatctgctaagcaactactgcctaacacacagcttagtagtacacagcaccccttgtgtcacactatctcccccacatgaatactaacccattcgacagcgactacctcaagcagttactacatccacgcgactcccctccctggaacgaagcattcgtcacccacaatattaaccttaaattggcctccactagg

SEQ ID NO: 701239 - DNA, 188 bp, Homo sapiens
aaacaacttaagtattaggacaagatgatggatatataaacatagatctaactattaaaaactatacaaatataccatcttacttactacaggtctcttgagcttcacgtaagcaactactcaaaaatactgagcacttgaaatcccttagtatacattatatactacttcatttgagagtacgggga

SEQ ID NO: 701240 - DNA, 645 bp, Homo sapiens
aatttcttctctaactattcttatattttatttttatatttcctttttttcctctctctttctccttttttatattttacttttatacaatgcggaaaataaaaccctcttaaaaaaaaacatcataatcaggcaaaataaaaaccctctcgctttccccaaaaaaaaaataaaaaatattttcacggtcccgcactcaacaaaaaaaacttttaaccacgaccccccaagtaataaaggcttttccccggaaccaaaaaaaatatacccccccaaaacaaaaaaaaatatacaaaataattgctgccaaaaaaaaaagaagcggcctctcaacaacctccttttctaacaaaaaaagattttcctttttatacccctttaaaaaaaaaccatactcacaaccttttcaaaaaaaaaaaatatcataccccctcttctgagcttttttttccttctacccacaaaacgtcttacaattaaacaattaaaaacatatttatcttctctcttacaaggacataacaccctactatattatatcacataaaacgcaacaaaaacttttataaaccacacctcctcaaatcatatcgatctccatcaaaacaatagagccgacgggacacaaacaatacaacacaaccg

SEQ ID NO: 701241 - DNA, 365 bp, Homo sapiens
cataacggttgtgcccttggcaatgaggtagtttctacactaagtaccagtggacagcgcatgggtcacaccggtgggaacaagttcactgtatatgtggatctcgccaattacagcctcagtgtaaggcatgtgtctcatatcgtgcatgcgtgggctcctgtgtctgccaatcacatcatcaatctcttcgtggactttatcttagacctgtgggtgctccaacagaatcagcagtccatatctcagagtggcgctcactactgaattcagagtggcgggtgcccttgacctgctccatttcgcacagaaagcaatctatagagtccggatgtttggtcccacacagtgaagctgggagatct

SEQ ID NO: 701242 - DNA, 1874 bp, Homo sapiens
atgtgttgttttcaatcaaggtgaattggatgctatggaataccatacaatgatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaacttttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgaggaatgcagatgtaaacgtgctccccattccagaccacaaattaattgtcagcgtgccctgtactcttcactcacataagccaccgcttgctgaggttttaaaagactacatcaagccagatggggaatatttggagttgtttgctcgaaatttacagccaggttggactagttggggcaatgaagttctcaaatttcagcatgtggattattttattgctctggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacatttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactaagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagt

SEQ ID NO: 701243 - DNA, 457 bp, Homo sapiens
  misc_feature (4)..(4): n is a, c, g, or t
  misc_feature (25)..(25): n is a, c, g, or t
cgtntgactgcattcagctggcagnttctgggaaggcgggcctcttccctcatccccagttgttgaaggcccctctgtctcccatgtgatatctccaaagggcccccttcagcaaagtaacccagcctcccctatgtggcccttaagcatctgagagggcaaaggcagagactccccaagccttctcaaggcattggcctgaaactggttcagcatctctgctgccacattttcaggactaaagcaagtcacagactcagccaggatccaaagggaagggactatgcaagggcatttataaacgttgacaaggttcattatagaacaccattgtaatggactatcccaagcatgtaccactgtgtctcatgcatggtaaaggtcccataaatgttattgctctcttgcagtatagtagtaatagtagtggtagctgttttaggagtaaaaacagcta

SEQ ID NO: 701244 - DNA, 2283 bp, Homo sapiens
atgtgttgttttcaatcaaggtgaattggatgctatggaataccatacaatgatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaacttttatccctcttggtctgtggaggtagttgctgagtggcactgggtaaaaaggttttaaaagactacatcaagccagatggggaatatttggagttgtttgctcgaaatttacagccaggttggactagttggggcaatgaagttctcaaatttcagcatgtggattattttattgctctggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacatttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactaagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcgaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatg

SEQ ID NO: 701245 - DNA, 1567 bp, Homo sapiens
  misc_feature (324)..(324): n is a, c, g, or t
acggggctgtccctagaggaccgtcactcgcattggccgatcggtggctcggtctccccctgtatgctatgctgcgatccatgcggactgagggagtgagtcgtcgcgttgccttgcaggtgctctgcgaggatgtgcttcccgcgactattgataggcaaaggacccggtgtctacagcggtgggacagaacaagaatagacacacacacacgagagaccgatcttcccctcgcagtcggtgggtgcgcaccctatgtgcaccagggggcggtgcacatgcgtgtgtgcagtggtgttcacgaatggacttccataatgatgngggcgaccgaaggacccaggagtcagagatgtaagagcagtccatcagcccgtgagaggtaccctcatatacgaagacactggcaatcgggcacacaaagcgttggggaccgaggagtggcacgcaaggagtcgtgggcgaaccatcatcactttcgtagcgagagtggaggcatgacagatggtggggctaccacgagggcagcaaccccgttgtcatgacgtgcaccagagggcgcaccctttgtaaaaccctcaagggccgtaattccgtcgtgagtgagagtactgaccacaggaagtccactgctgtctgagacaccgtttgcaaagcaacccccgaggcacaatggttgcggttggacgtaatcgcaggggacatggatgtcttaatctccctggtgagcgccattcttgggagaccagctaacccaagctttggggcattcagtggcattgggacctcccgggttgcaccagggggggatcaacacacaacaaacttgtatgcccccaaattactaacaggaaggggggatattagcccgcttaccccacgcattggccaaatcccttgacggatcttgaggaacacgtgggccgtgtgggcccggggaaccctcggaccttgaccttatcccttcaattgtacagaatccatacaacagaagctcgccgtgataccaaggcgttatccaacgcaacccaacggggccgggagcggggggaacattcggttgccggtgaaccttttaacgggaggaaagagctttgtggctaacggggtacagaacacacatggaaacattatccgacacgaccaaagaagaaatggggcccagacgggaggatagggatataccaaagacgacttccattacccccttggagaaggaaagaacggcataacagcagcagttggacactgggcaggggcccaggggcacatacacacccagttgggggacaacgaatacgagggaaccgcaagagccccaggagaagcaacaacctctcagaagcacgacaccttccacggagggaacatgttgatcaacccccatgtaggagaacatccaacagcagacaatacacatcacatacccaaaccaaaaaaccagggtgcagcaagagaacaaacgcacgacaaaacaccgacagacaccaacaaagagacgatatcaagaaggaacaaccaccaaaacaccagacataagctgcagcaacacgacagagagacacac

SEQ ID NO: 701246 - DNA, 135 bp, Homo sapiens
gctgccttccaggatgctggtggctatgcctacttcctgcgcgggcgcctctactggaagtttgaccctgtgagggtgaaggctctggaatgcttcccccgtctcgtgggtcctgacttctttggctgtgcccgg

SEQ ID NO: 701247 - DNA, 352 bp, Homo sapiens
gaccggcgtaggacgccacagaactgcccagcgcaaagcggcaggaaaatactcaagctggcgcccacgcgccagcaccaatgttcaagtgctcgcccatggcgccaaacgccggcaagtacatgtccatggcgagataaccgagcatgctcagccccgccagataccaggtaaaaccaaaagaatttttcatcgatgccttgtagatactgccatcaaactatttgctgactgtcgcccattatgaggctgacaatatctgtgtgaagcgataataattggacactcttatcaataattttgaaggcagtacctatgtggtcggaatattccctggatgcgtccgtagcgg

SEQ ID NO: 701248 - DNA, 314 bp, Homo sapiens
cgatcctctcacggatccccccggacccacactcaggcgcaaggccctgctctgtctcaaacttgcgtgcggaagtcactcagcagccagcacgggcattgtcaactctgtagcagtgatgttggcattgtccacggtggctgtgaggatcttgtcctgcagctcctcaattgtcctgtattactggctgtatctcacgggcgggccccggggcctgcctcttgtaccagtcactgatctgcacctccagctcagtgtttgcctcctccagggcacgcaccttgtccaagtccgagaccggctgtagaccggct

SEQ ID NO: 701249 - DNA, 788 bp, Homo sapiens
cgtaaatagagtccaatgtgggctgtgagagcctgtcccgcgcctgcccgctcatgtctctacagagcctgactgtcctgtgccgcctgttgcacagctgctgcgctggctgtgtggcagctgctctgtccccccgctgccccctgtgcccgtgacacttgtgctgtgtgtgccacgatggaccctgcagcagcactgtgctggtccccctgtgctgttcctgtggctgtgttctgtgcctgcctgtgctgctggacctctgtgctgtgtgatgttgtgtggctgtgtggtggtgctgtgctgtgctgtgtgtgtgtgctgtgacatgcctgtgtgtgttgctgcacattgtgtgccccccatgtgcccataggctgtgctgaatgtgttgtgagcctagatgcacacatcacacactgacttgtgcatggataggctgacagactccctttacttgacatgtgtgcccttgatggttgaccaagtgcatgctggtgacgtgacagcatatcagctatcttgcaagtgggaacctttttggtacaagggcttgacaggaaatgaattccgcggaacattgggaatgcggaggattgcgctgagaacggcggggttagcgcttggtgacacgtgttgtgacgtgatgccccaggtgttactaagaaatgggagcagaggcagggctccaattcgaggacgaaaatcttccccatgctcccggccaagcgaacaattcagccaaatgccttgtgaggttgtgacgcccattcggtccaaactgcccgcca

SEQ ID NO: 701250 - DNA, 189 bp, Homo sapiens
cattgtatttcaacgtggtacacggggaaagccacgtgtcgggaaccaccacgcttactggactgcctgcgacgattcaccagaccagagcacttggcgctggcagcgccaagaatcaatgtgcagcgtgttgccagtagctaccatggagtccacaaagtcagctcactatgatagaaactgcccact

SEQ ID NO: 701251 - DNA, 337 bp, Homo sapiens
tgctgaggaacagggactggagcctgggaaggtagggcaggctgagacctgccggtatggatgcaatgtgtatgaggtaatgccgtctgcgcgacggaatgaacgcgaacgaaatagccaagagctggcactgagagaacagcgctggcgggccctgctcgaggcttccctgcatccagggagtgtgacgatggcttgccctgcctcctgaggcatggaccgagccctagcccgcatctgagctccgctgtgctagctgtgtggagtctgaaaacgcaaaggtactgttagaaagttgctgtcagcaggcattgttccagctttccatggaaattct

SEQ ID NO: 701252 - DNA, 490 bp, Homo sapiens
tcttcggtcggtgacgcgaagacatcgccgcgtcgacggaaatcgtcgcggcgcgaagcggagccttatctaagctccccgccgccggatccggtcctcgcccagatctgcgcagaggagagcccgcccttcgaccgcggaggatccggcatcgcctttttccggaacgacccgaacggcggcaacgttttccggctgttcaacataacctggaggaaacccatgaaagtctcggcgattgcgctcctgaccgctttcggcttcgcgacggccgccatggccgcggaagaccggggcgcctcctcgaaggcgcccggccacgagatgcagcaggatcagggccggatgcagggctcgcccaacgcggccggcttcggcaagaaggacggtgcgggcgacaccacgggctcgaccggttccaccacctccggctcgtccggcagcggctccagcagcacgggcaccgccaagccgcactgatcgcggccgc

SEQ ID NO: 701253 - DNA, 128 bp, Homo sapiens
acccaagtttagggaggcataaaaacaaatgtcatcagcccatactacccttactgtggactgtgggtttggctgccgatagtatgaacactgcagcgcctgcccaaggtcatcggagaaccagagcc

SEQ ID NO: 701254 - DNA, 712 bp, Homo sapiens
gcacagcatggcttgtcttcaagactttctttgcctctcttcttccagaaggccccccagccatcgcaaactagatggtgttatgtgctagtagctgtaggaggcttcgacaggaatggactggatcacctgactccagctagattgcctctcctggacgtggcaatgatgagtttttaaaaaacagtgtggatgatgatatgctttcgtgagcaagcaaatagcagaaacgtgaagcctgtgatactaaattggtgaacataaaacattgcccataggtccttctcgatgtctttaattctgaacgcagctttaaatatatactctcatgtagtttaataagcactgtacgtagtaaggccgttatcgtgttgcatgtctatgcttgaggaatttttcttaaatgtgtgtgtatgcatgtgtgtttgtacatagaagtcatagatgcagaagtggttctgctggtcacgatttgattcctgttggaatgtttataattacatcataatgtgtactactttatataatcaattgaaattcgctagacatgtttagcaggactttttctaggaaagacttatgtatcacttcgtctttctaatacatgctgatgcttcatctcttaaatctaaggggaccttggcggaggtgaaaacctatgctgggtcttctgtgacaatcacagttttctcatgcatgacctgataaccga

SEQ ID NO: 701255 - DNA, 103 bp, Homo sapiens
agactcacatggctgcagaacactgtcaggtgacctgcaaatgtaacaagaagttggagaagaggctgttaaagaagcatgaggagactgagtgccctttgcg

SEQ ID NO: 701256 - DNA, 177 bp, Homo sapiens
tctcaataaagccaaaaatctttctctttctccccctcaggccacctcctgtccttcacttcctgttctgtgcttggcttttcttggaaccgccaggcgcccattgcttggcacctttcttctttgctcttgctctctgcccctatggccttgcgcttttcccctttaaccttccat

SEQ ID NO: 701257 - DNA, 344 bp, Homo sapiens
ccacccccccactcccacacacagacaccgaactgatacactgaagattgaaattctaactgtagaacctagaatgtaactgtatttggagatggggcctttaaaaaggtaatgaagataaaatgaagtcaaatggggggaactccaattccatatgagtggtttccattaagaagagattaggacacagacacacagaaaggtaagaccatgtgaagacactggaggaagatggccatctacaagccaaagagatctacaggctttagaagaaaccaacactgctgacaccttgatcttggacttctagaagtgtgagaaaataaatttctgttctttaaact

SEQ ID NO: 701258 - DNA, 222 bp, Homo sapiens
ccaatcggattgacttacagatgaatttctaaccctgcagaatgggtttaacctgtgcttaacagctttagtaaaatgagagataaacagattgtgaaaaataaaataagccaaatctcatgtgaggataaaaaaaagcgatgtcccaaataagtcaatgtgacactaaagatctaaacaatttttttaaacttttaagtattaaaaatcaaatatacagca

SEQ ID NO: 701259 - DNA, 171 bp, Homo sapiens
tattgtgcatgtgattatgccaggctgtttaattcacggcattttctcaatgcttcattacagccatacaaggtacacagttattattgccattttatatgttaaatagcattttcttttttccgaactattaattatgaattgtgcaaaattttataagtacggaacgca

SEQ ID NO: 701260 - DNA, 361 bp, Homo sapiens
tgtaaatactcgtcgtgactggtgcacaacctgcggttggtacatatgtatacatgtgccatgttgctgtgctgcacccattaactcatcatttactttaggtatatctcctaatgctatccctccccactctcccgactccactacaggcccgggtgtatgatgttccccttcgtgtgtccaggtgtgctcatggttcagatcccacctatgagtgagaacatgctgatcaccatacttttctagatcagggctcctatcggatttcctacacaagtattttctttgagaggtcttggggggccaaaatttatacatatttataaaccctaagttatcttcttacatggctggtaccgca

SEQ ID NO: 701261 - DNA, 164 bp, Homo sapiens
ggagaggatcggtcggtccgcaaggtctgtaagtctgccgagacaatgctaccaaaaatgtatgtagtcgtgaaagtgaagacccgtatgagagacaaggggaagggtaagcaggaggcctgctagtggggtctaggaggagcctcttggggtgtgtggaaggc

SEQ ID NO: 701262 - DNA, 134 bp, Homo sapiens
ctcaggatgttacctcaaaattactacgctcgaggctcatccctcgcctcaccctcccgatgtagacttgagaggtatcaggcacgtcttgaactctgggtctcgaagtcatccaccttgcctcgcgcctccca

SEQ ID NO: 701263 - DNA, 131 bp, Homo sapiens
cccccaacatttgctggaggaatagaacgaaaagattcaagagaagataatgacagaaattactgatagaggtgaggactagggcagaatcaaagctaatgtctaggttcttaagtgttgtcaagcggcac

SEQ ID NO: 701264 - DNA, 507 bp, Homo sapiens
  misc_feature (18)..(18): n is a, c, g, or t
  misc_feature (408)..(408): n is a, c, g, or t
  misc_feature (416)..(416): n is a, c, g, or t
  misc_feature (503)..(503): n is a, c, g, or t
aaaaaaaaaaaaaaaaanaaaagaaaataaagaagcacttactgtataaagagtgagcccttaatttctcagcccaactaggctccccagaggtaatcagctgcttagtgtgtggcgcatgttccatgaagtttcttttgtataaatgggatcctactgtaggcttcattttacagctcgcttttgttttgccatgtcattgtacattttggagacctttccatggcaacataattagatctatctcattgtgcaagcattccacagaatggatgtacagtttatatagccatcctcctcctggtgggcagtggctttcttgtccttataagtaatactgagacagcatatctttgtgcatttctatatttgtgtagtttagattccctaggggacaaaatgctccangtccaganctataaggagtattgggaaattttggatgggagactggcccaaattggccctcctaaaggagcccctcaccaacagggcccgagttnactg

SEQ ID NO: 701265 - DNA, 186 bp, Homo sapiens
cacgaaggacattctggatacatcgatcaagcacggagctgagcatggtgctctaatcaatgtgactctagaagatgcactttatgcgattggtatttaccacggaaactgttttcccttatctggaggatatctcagaccctcaggtgaaatggattccgtgtcaagatccccacatatttggtc

SEQ ID NO: 701266 - DNA, 177 bp, Homo sapiens
gatcacacgcgggagctgtactggtgcacgcactgatgaagcaggcacgaaactcatcgcaggactcattttccttaaaatttagacttgtacagtagggacttcaactgaccttcctcagaccaagaactgtttccagtatctacatcaagatcactgcagttatgactagagatt

SEQ ID NO: 701267 - DNA, 1715 bp, Homo sapiens
agcgggtcctctccgcgcaggctcccggttgcccgcggtccccggcccatgctccttgtgcctcctcctctgtcggtcctgccccatggataggtcatatgagcagcccagcatcagtccaggcctctgagtgcagcctgtcggactcagcccgaggctggccgcgtgcgcaacatagcgagagacagccgctctcgcggcgaaatcctcagcgatatacccttggatctcgcagacaaggagtccacgcagccacgaggaagaccccgagggacctgcgagacacctgtcgccagtcgccggaaccctccagcgccgcgagcactagcacaccaccgcaaacaggacgcacaacacagcgagaaaccacgcggcgcacctgcggcaccacagcaaccacacgcggaggacacaccccagaggacagacaaccccagccagagcgagcacccgccgaacgagagcgaccccaacaacaccagagccacccaactacatacacgatagtggacagcgaaaagcatacacaggacggaacgccactgaggcctcaacagccaccaacacgcccagccaccagtcgacgagaacatcggacaattccgaccagcaacgcccacccccacgcgcccctagcagcacaccaccaccataacaacacgggccaaccacacaccagcccgcaaaaccacatccaacgcaccacccaatcctcgccaaaccacgcccactaggcaattcgcaaacaccacaccacacactcagaaacggcatagagcaccacacccccagacacgcaccactcccaccgacacgcgcaaccatccacgcacaacaaccccaaactacacaaccacaccaccagcacacgcggacagccacgcaccccaccatcaaagcaccagccggcaaaaccacagcagagcacaccacatgctgcaaatcaatatgcacacacgcacccctgcgccactccacatcacgtcaaggcgcacgcgccaaccaccacggcaacacacaccactagatataggcaaacaccacacaagcaacaccgaccacgaccgccaacagacagaccgcacgcacacaacgccacagagaaacaaaacaaacagcacaccaaagaaggacaccatcagacgcaaacgagtaactacttaaagacgcgcacgacacgaggcgccagcgacacacaaacaacagatcagcgcccagatgcgaccaccagagtcgagcagcagaccacgacaacggacgagactgacgagacaccaatggggcactcgaacagacaccaacgacaacgacgcgtgcactagggcaagcgatacatcgcacgcgatgcaagaccacgcgacctacgtgagcgatgggtagaccctggacagcacatatcaaatacttgacaccagtacatgctaactagccacgacacacatctggtatcacctaatccataagtactaaggcacacaaaccactcataccacacacatctacctcacaactaagcttcactaaacaaccaatacaccatcatcacaatcacacaaaacaccacataacataacatcacacaatgcaatcaacacacccatacccctaaaccaccccacatcccccatccaacatctactcatgccagtccacatcgatcacaactaccccacccacaaacacaaaacgaaccataacacactcacaccactcac

SEQ ID NO: 701268 - DNA, 1139 bp, Homo sapiens
gcgtgatgtctcacagagagttctccgctccacagacatgggatccctcgggctgtcctgcctcgtgaagcgcatgtcagctaggcatcgctggggaaggtgaagcatgctgtcctcgtaaggcatgactccgtccgaatcctggtcgcactcttcacagtcacttccatggcgattactgaggcatggacgagtgacgtcgacagtctgtgcgcggaagtcgtacaggccgtggatccgaaggatgagagcgaatgagaggaggtggtaggaacggctgtgaccagttgtaagagacaccacccagtggtggtatgctgggcacttgtgcggctacgctggaagacgccctcgacggcctccaggaccgttcagacgaactgtctattgcatgtagcacagtcatgtggatgcacatgcaaggacggccgtttcctatacagagacttggcgatacacactctgtaagacatgaaggctctttacacaatgatacgtgcaagaacatggtcacggtactgaggcatggcgaacgtaagcgagcgtggacgagagggacttcatgcaggctctgacagaatgtagctgccaaagtctatcccgttgtctattgccgcagcactccaggatgctgccttagcttcgctctggcggccaggaatgaacgtgcctcacctggatggagtatccgagggtgaactaggaggcatctgtgcgccgagaagagctggactgtggcccagcgacgaggcgttgagcacgcgagggtacctgtgaaccaagctgttagggcaggatgagatggatcgaacgtcatcagtcgggtgaccacatgggccaagggctaccaaagggggaacaccagacgtatgggcacaccaagaaggctgccccggaagaacgcaccgaaggctgcgcccaggtggcctggagtggagcgcatggcagtcctgcaccgtgtaaggcgatcctctgttggcacggcgcctgggcccgcaaagggctaaccattcacccgaaactgagacatgaccagaacagcacttaataagcatagggccaaggctacacttaatccacgggaccgggcaaggtgattcatgaccaaggctccacttggctataacctatctggcaaa

SEQ ID NO: 701269 - DNA, 357 bp, Homo sapiens
gtttcccccctcccagatctataagaggtaaggaagccagtgtgcttgggccccctgggagttgcacttttgccaggccaaaccagggggctatgtgaaccccaaagcagagggtgtcccttggaaggggcggtggtgctgtcggggtgcaaaccacgttcgtattgaggcagttgatataaaggatgttccgcgaatgactttttcccactcatggcctatactatcaaaggggagaggtgtggggtttactgagccccttgtgctgcgtactgtaactcaatcctcagtaccactgcgacgaggtaaaaatgatgattcccattttacaaataaagaacctgtggccagtgcaaa

SEQ ID NO: 701270 - DNA, 257 bp, Homo sapiens
gctctagagatccacctcataatgtgtgcccaaagatatacacttggcgaaaacatcgaaagagagcgaagaaaggggccgcgaatgaccttctaggggtgaaacttgagctgatatgtagagaactaagcctgtaaatctgccttatcccccactttctctgctcccaatccttcctaaactgagaaaccctgacctaatgcaaccttagctgtcttcttctctgtaggctgctctgaaccacttgcaaaacattt

SEQ ID NO: 701271 - DNA, 162 bp, Homo sapiens
  misc_feature (20)..(20): n is a, c, g, or t
  misc_feature (99)..(99): n is a, c, g, or t
cccaacactaagctctcttnactctgccacacgaggcagatacggagggggtgcagaaagtatacaaacacatttagaaaaatgagaaggcaggcgcgncaaagtcagtagttaaaaatctaaaattattctaatattaagatgtagcctgggggcaagatc

SEQ ID NO: 701272 - DNA, 114 bp, Homo sapiens
cagacatttgggagggataggagtctatatcccttaaaggccctgtgtcagattaaaatcttgaagctaagtggcttcacaggttggcacacacttaacatttcgggccactct

SEQ ID NO: 701273 - DNA, 329 bp, Homo sapiens
gggaacgttcttgtccatgtgtgtgttgtcagcattattaaggcataatggacaacatttcatatttttacagtatagcaaagtaagtgatgtgatgtactgcgtatattatgaaatgattatcacaatcaggctgattaacacatccatcactccacataattaccgttctttcctttttcttattggtgccaatgcttagcacacttctagtatataatatggcatttttaattacagtcaccatgctgtacagtagatcctcagaatgtatataccttataactgaaagtgtgtattctttgaccagttctcccacttccagtgcc

SEQ ID NO: 701274 - DNA, 259 bp, Homo sapiens
gtggcgactgaccaacgctctaaatgggacgatttcggtcaaggggtcctccctaagcgctttatcttcggggtgaacacgatcattccctttctttccacataattcaacagctgaattatgtttccagtttacatcggtacctcaccgatgtcgcccatgtcgatatttactggtttattggtagtcggttggatgtcgcgccatccaagttgcctcgcctaaccaccccaattcaaggctccagtacagtcccttg

SEQ ID NO: 701275 - DNA, 133 bp, Homo sapiens
  misc_feature (6)..(6): n is a, c, g, or t
  misc_feature (46)..(46): n is a, c, g, or t
  misc_feature (101)..(101): n is a, c, g, or t
gcggantgaagctgcgggaggcccccagccccacggaaggcgtggncagcttcgacatcgccggccttctgaacaaccctgtcttcatgagcatggcttcnaacctaatgaacaatccccagattcagcagct

SEQ ID NO: 701276 - DNA, 260 bp, Homo sapiens
gcccgggggagcccttttgggtgggcctgccccctgggccttaaggtctccttccccttgggggttgggggccctgggggctatggcttccttttcccccccccccaggttttccccccgggccgtgtgtcgtgggtgggggttttcccccttttggggccccccctgggtccccccttctcccctttcccttttccccccttcctgtccccccctctggccccctcctgggggcccccttgggttttaggggacccgga

SEQ ID NO: 701277 - DNA, 242 bp, Homo sapiens
gggcaggcccaccttatgcatcatatctttcccctggtcatgttcagccggatcaggggtttacgtgtcaacgttccattttttcagctaggcgcgggggctcatgcctgtaatcccagcaactcgggaggctgaggcaagagaatcccttgaatccaggaggcggaagttggagtgagcccagatggtgccactgcactccagcctgggtgacagaatgagactctgtctcaaaacaaagg

SEQ ID NO: 701278 - DNA, 1743 bp, Homo sapiens
  misc_feature (1743)..(1743): n is a, c, g, or t
tgtgtgatgtgtaggttggtgttgtttgattgttgttgttaagtgagtgagttgtgtgtgggtaagttttattgtgtttgtgattttgttgtggggttgttgtttgttgtgtagggggggtggtagatagggtcgttattggttttgatgttttgttgagttgttgtaggtttgttgtggtgtgagtagtagtttgttgagggtagtttgtggtgtggtaggtttggtgagtgggggttttttgtgttgtggcgtgccttgtcgtagtattgcgctcgtcatgtttgatacatgcccttttgggtggtcgaagacgactaagagcggtttttgagtgggccaccgtgtttgtgagctccgcggggggttcccacacgaggttgtgggcacacaggtggcctcggcttggttttgttcgcgtcggcgccccgtttgtcgttgtgtgccgggtttctctttgaggtttatgctgacgtcctcctggggggtgtgccgaaatttctcggggcactccggagggggaggattcctctggggggtcgctgccaccaatgggtgctctcccccgcgtccccccgccccccgcttgtgggggttgatcccccgggtgtatgtgtgtgtgaagggggtccgaagtccgcggggttgccctgcctaaagtttgttccgccgtgtttcttggcgccggaagggtgtgtccccactgtgaatggccccagagagagtttctcccccagagtgtttggaacagctgggggggctcgtatattaagaggccgcgcaaatagattgggtaatggaggattttcccccgcgatttttggtggggccacacacacatgggggtgtccaacggagttgggatatatttgggtacacaagctgggtgctcgttgtgggagggccccctgtgagagggcctttgtcgccccgaaaatgttttgtgggcgccccacgaagaaagggacaccacatggaggtattatagaaaaggtgtggttggcccacaaaaggagatgggggcggtgtgccaacaaaaatactcccggggtggtacgcggggcatctccacacaccacccgtgtcccaacacgggtgaatggtcgtctcggaaggtctcagcacacaaagatagtggtgtgtgttctccttgttgcttgggggggcgttacacacagggggtcttcccacaacacagggcacattgtctgagagggtgtcccttttgtgaaaatggcgcccccccagagggcacacctggtgggccacagagagtgtctcacacatggggcgccacagatttatctcagagtctccatctccgcgcactccttagagttgccagagcaccaagaggagccatattggatttgagagcccttgcgcgcacaggggcctcaagattctcaagatttctcctgtgcgccgcccagaagatctccaccatttctcaaagaaagatggggcttctcacaccaagagttctaatgctggatgaatttgaagaacacatggtggctgtaataagcggcgctatccccagatggcctttggggtctaagtaccatctccccacgccgtggccctttggacaaatggcgggcccatgcactccatgagggcttcccatgtgctgcccccctcttaatactccacccaatataattttacgtcctgtcctagaaaaaagaaaaaatactcgagcattaagtcggccgagaagagtagagcgctcctggtctn

SEQ ID NO: 701279 - DNA, 179 bp, Homo sapiens
tgaggggccctgctagtcaggcattgcgagtccttgaccgttgacatcgagtagtactcccgattgaagcccccattcgtataataagttacatcacaagacgtcttgcacttcgtgagctgtccccacattaggcttaaaaacagatgcaattcccgagacgtctaaaccaataccac

SEQ ID NO: 701280 - DNA, 969 bp, Homo sapiens
tctagcatcaccactatcagaggcaccgtctgcccagtggcacatgttgaaagagccgggtaccctaagcgtgacacaggtagcataatcacgtagtgccttaaatagggacctgtatgcagtggctccagcgagtgttcagctgtctcttactttgaaccagtgagaattgacctggccgtgaagaggcgggcataacacgagcaagacgagaagaccctatggagctttaagttgattaatgcaaatgagtacctaacaaacccactggtcctaatactagcaaatcgtgctttaaaaatttcggtatggggcgacctcgtgagcgagaacccaaccgtccgagcagtcacatgcgtaagacttcacgcagtcgaaaagcgaactactatactcaatgatccaagtaacttgaccaaggaacgagttaccctagggataacagcgcgatcctattctagagtccatatcaacaataagggtttacagatctcgatgttggactcaggacatcccatgtggtgccagccgctattacaggtgcgattgtcaacgataagagtcctacgtgatctgagtcagagcggagtactccaggtcggatctatctacttcacattcctccctgtacgaaaggatgaagagaaatagggcctacttcacaaagcgcttccccgtgactgatttcgctgtcagcttagtattatacccaaaaccactccaagaaccgggttcgtaacacggtcgcagcaaagaaacgtcgcataacaaaaacaggggggcgggacgagagagcgccacggggccccacaggaagcgcacctcttttgcgaaaagggcacaagggggcgtaaaaagagaaggccactaaacgtccgggaccagcgcgcggatcgaggaactctgtgcgacagtggcccacagaacgccaccacaatacgtagacacacagcgggcgggaggggttat

SEQ ID NO: 701281 - DNA, 254 bp, Homo sapiens
atggctcatggcagcgtagggtggctcttcagtgtggcatcgttgtgtgctcttggggtggacccatggagggtcgcatggtgtggctcgttgcgtgcggcaaggaaacatgacagctgccctacaggcagatctgaagaacccccctatgagccacgcgaagagccaacctaggcgcccacagaggaggtggacagcaccagcaggcggtggcacagcccagaggcggtggaccgctggacagcacagcgggg

SEQ ID NO: 701282 - DNA, 251 bp, Homo sapiens
gcacctgtaatcccagctacccgggaggctgaggcaggagaatcacttgaacctgggaggcggatgttgcagtgagctgagatcatgccattgtactccaccctgggcaacagagcgagactccgtctcaaaaaaaaaaagacatgagaataaaacagtttactgcatataccaaggcatatcagatgtttaggaattgcatacaattttggaacacatatcaatacaactgtaactcaaagaaagctgaa

SEQ ID NO: 701283 - DNA, 146 bp, Homo sapiens
ttctcagtttcccgtttcgtttggtggactgttccactgcccctcctggtcaccctatcacccatggatcgtaatgtaaaatgggtgtaccatgtcaagaaattattaaaaatacaggtactttgagctctttgtaaaaaaaaaaa

SEQ ID NO: 701284 - DNA, 112 bp, Homo sapiens
accttttacacaggaaacaagtattacgtcgtgaacgggaaaaacctcgggagcctttttaaaagaaacaaagattataacctaaaagggaaaaacccgggggaacccttta

SEQ ID NO: 701285 - DNA, 1610 bp, Homo sapiens
  misc_feature (338)..(338): n is a, c, g, or t
ggtggagaacctagtctctgagtttcattctttttttttttcgcgtgttgggatgcttatattccagctggtgcgcggggaggaaatctgtccggtgggccaggagatctgtgcgtgaggagtgataggccgcctcctggcgggtaaccatagcggccgtcgagacatgggcttcgcccctcaaagtgccctagtatgcatgggaaaactcttggggtgccaggctcgctgcggaggcaatatccttagctcaccagcggtggtaagaggcatgtgtgtagggcggacaaccttgtgtgtctgggaagcgattgagaggccacccgcttcacctcagnggggcgcgaatttcacttccgcaatcgaagaggcccgctcgagaaacgcccctccatgttgactgtgagctatgggacttagtgcgctgatcgcacctcgatatgtcgctttgtgtgtctcccctctgtaacctctccgggaacgtgatatagagggttgcccaaagacacaccagtgtggatgcgtccctcagtgtgcgagtcagccacaggcgcgaaaggacctgtgtggggcggcaaaaatttctagcgagacacacgcccctgcgaaggcacacagccggtggtgtcccaacgtggtcgttcttgaacaccacaaccggtggcgcatattcgatcggataaccactggcccccatccgggcgtgtcgattcaatacgtgcacccacaacgtggcaaccgcggccataacatgaccccccagcgacaatatcacgtcgatcagacgcggtatagccctacgcctcccacaaggaaggtgcagcacacaactccaccgaggcatgcaccgccgctaagattagacagatagctacaaccgacctatccgccatagaggacggtacgcaattggagaaaacccacacacgggggagcaccgccccccactttattggccacaacacagaggggcccacacttctctattacacaccacgaggcgtcgaccatcgcacgccggcaagcatatacggagacggttgtactagtagcgcaccaaccctactacgatactctacatatgcaccgcagtaggtagcacacaaacagcgaggtgccgaggcaatacgcacccgaagagagtgtagctcaccccaggacatatagaggcacgacacacagtaacatgagtcggactcacttacaattatacaccaccccacaggtaccatgtgtgtgcaaaggacaacggacccttcctgacggacatcgtagtgtaagctccaaaccacgagcacacacattgacgtcacactgcgctcacaacctggggattctctcaccaccgtgaacatcttccacagtgtgcggcgtaatagctgacacaccacccattagccaacagcggcgcaccatctttgagtcggtgctcaggaaaacatattgtacgcatcccatcacgtactaacgactgcttgtagtaagaacagcccacgtcggccccgactatagtgcgagctaacgttgccgagcccacccagcgagcgcagagcccagctgatcgtaggccccccaccattttctgtagcgcggaatactaccataacgaa

SEQ ID NO: 701286 - DNA, 702 bp, Homo sapiens
tgaggcccggggatcccgttttgggccacggtttttatggtcccttgtgggcacttaaaataaattccggcttgaagcttgtggcctctaacgcggtagtttattgcggtgggaggaggtctcccagcagctcgttctatattaactggttttggcaggggcatttccctattccctattgccggggtcacagcaaaaaaggtttgaatttagaggatagagttagttttcttgcgaaatgttgaaaccatatcttaattcattggcgaaggcgttaaaagacacggagtcatagcactcccttgtctgcgggtcatgaggtatcctgttccttcttttggatatcactggagaggggtgcccgcatttcgtatcgcagcctctttaagagtgagggtcctaaacttgaaccgtttattaataaaaaccaggggtggcctggccccttaacagagacatctctatgcacccccaccaagccatcgtccattatgggagtgataaaatgagttctgcaatgtgcctacaagaaagaccagccaacgcgtatgttttgagggctcgtaacactcacgtccgaaatggttaaggcatgttgtacgcactgtgtggccgctcgcaccgtggaaaaccaccccttatgaagtccgaagggtaggattcacttgcgttgagtagcttaagccaagcaagggcgcctta

SEQ ID NO: 701287 - DNA, 347 bp, Homo sapiens
tactggaacttctggcatacctcgtttctgtggcagaccatttttcattttcaagaccgctcatggctgggcacggtggctcacacctgtaatcccagcactttgggaggccgaggcgggtgggtcatgaagtcaggagttcaagaccagcctggccaacatggtgaaaccctgtctctaaaaatacaaaaattagctgggtgtggtggcgcgttcctgtaatcccagctactctggaggctgggatgggagaatcactggaacctgggaggctgaggctccagtgagccgagattgcatcactgcactgcactccagcctgggtgacagagggagaccctgtctcc

SEQ ID NO: 701288 - DNA, 124 bp, Homo sapiens
ttgtaatggagaaagttacggcgtgtaggggagtgagactcaagtttatagtctggcgccatcagctcacaggtgtaggacttcgggcaggtatttatcactagaatttctgtgcccatttcaa

SEQ ID NO: 701289 - DNA, 311 bp, Homo sapiens
taatggacgttaactagcaatcagagtgtagtaaagaaactataaaatatacaaatagtataacaatgatcttcataacttgaaacacacaaggacacaccttcgcaactgcatacgttaacgttactgtactagggatagtagaaaaactgaactccacgaatgttgaaaagtaacaactacctaaatataacgaataacctagagtaccactaaccacaatcgacagggcaatctacctaatagtaatgcaaagaaaaagcaaaagacaaagctacaacagataaaagagctcaggaatagtacatcta

SEQ ID NO: 701290 - DNA, 754 bp, Homo sapiens
ttttttcgccgagtgagatcgtggcctgatgcaaatatatttcacgtcacatacagaacatatccacattctgcgagatgaggaaacatattttcctaggcgctatgacacgtatatgtcttgggcactgactctatattgtccttttcgagagaaccccacgctgggtgcacccataagagcttgtataatggaacaggagagaagagatagaaagaggctgttcacagagaatattgattgtcacaccacggtttcgcttctggcaaacccactacttctggagaccttcttcttcttccttcctcattttatacttcgaggcctgcccacaattaaccacgccccaccctgttttcacggctcacagagaatgcccttaaagactaaattaatgttgaggccaccgttggtacgcaaagaatgtgcacgcctatatttcctgagccctagtaccccacaattaagcccactccacttggttagcaccaactcacgcgactgtgagttcgtgaagaacaccgggagaaaatccacccactaataacaactgagcacttcacattttcaaactttagttatgttaaacaccagatttttttacttttttatttttttttattttgagacggggttttgctctgtcgcgcagagatcgtgccactgcaatccagcctgggcgaacagagcgagactctgtctccaaacaaaacaaaagtatctggttaccgtacacagcaaatctactacactc

SEQ ID NO: 701291 - DNA, 787 bp, Homo sapiens
taattatttttttcgagggggtaatctcgctcggtcacccaggtgggagtgcagtgacgcaatctgagctcacggcaacctccgcctccgtgggtttcaagcgattcttctgcctcagcctcccgagttagcctcggactacaagtgtgtgccaccagtgcccagttaattttggtattttatagataaacagtggggttattcaccaattattgtggccaggctgtggctcacgaaacttcttgtgaactctggtgtgactcagacccaccttgtgtgccctcttcaagagtgtgcctaggaattactaggcatgtgacgccacgcgcacccgcaccctctcctttaaaatctctttaatagtgaggtcacattgcggactcctgtgtgtccacctcccgcttctcactcgaaaacgcaactccaacacagagatatctccgctgtgtgcccctgtggagtaaataaaacacccaaaaacaccacttagtgtgtagggcgccacaacacatgaggggccacagtgtgagtgtgcaactcctaagggccccgctgtgacaacactaatctccacgcagaagacgctataaaactacctcccctcttccacaacttgtgaaaccatcgtgggggtactccacacaaccttatcaccacagaggtgtatgtcatctgtggagtctccactatttcaacacaatataaaaaaaaccacacggctacgtgggctccccccaacacccccgaggggggcccctatctgtgggcccactagtgactatctccc

SEQ ID NO: 701292 - DNA, 407 bp, Homo sapiens
gcccagtcaactactgatacgctctctgacacacacacacacagacacatacacacacaccttactctgtcatatactattatataaatggggtcatacaaactgtgagatcatactttcacttgcctcgggtaaatacctagaagtggaggctggctgcagtgggtcacgcctgaaatcctagcactttgggaggtcgaggtgggtggattgcctgagctcaggtgttcgagaccagcctgagcaacacggagaaaccctatctgtactatacagtgagctgtgtatggctatagtcccagctacttaggatgctgaagcaggagaattgctcgaacccaggatgcagaggatgcagagagccaagattgctccactgcaccccaacctgagcaacagagcgctgg

SEQ ID NO: 701293 - DNA, 163 bp, Homo sapiens
acagtggagtatatggttagtgtctatgctcagaatccaagcggagagagtcagcctctggttcagactgcagtaaccactattcctgcaccaactgacctgaagttcactcaggtcaccctgcactcgtatatccatgtgatgctgaacatttggtgtggtg

SEQ ID NO: 701294 - DNA, 347 bp, Homo sapiens
ccgcgtccgaagggtgacacaggcagccgcggggactgtggattgcaaggtccgaggggtcctcccggccccagagggcggcccgggcccccgggtcctctcagggggtcctatccaattgcaacaagatgatcttggggcagcttttcagacgtggatggacaccagtggagcacttaggccagagagttacagctattcagaccggctggtgctggaccagggaggagagatctttaccaaagagaaccccggccgggtctgcaaggacctcatggactgtgagcaggatggtggatggtacctactgggtggatccccttggctggtcctctgacaccattggg

SEQ ID NO: 701295 - DNA, 341 bp, Homo sapiens
agcccctaggtagcttcaagatgggggctggtcatcagagagacataggcaggattagagggttgggactttcatcccaccatcccacgtactgggagggaagggggctaaaggttaagctgttcgccaatggccagtgatttatccaatcatgcctacgtaatgaagcctacacaaaaacccacgaagaccgggttcagagaacttctggtagctgggcacatgcaggttcctggagggtgccaagccctggaagctctgtgctcccttccacatgccttgccctatgcccctcttcctttgtatccttcctaatatcctttctaatcccctcgtacatg

SEQ ID NO: 701296 - DNA, 598 bp, Homo sapiens
agcggagcggagcggcaacggcggcggcgccggacccgcacgcgcgcggcggcggctcctcccaaccgcgagagaaaacaccgaagaacgaaaaaaaaaaaaaaacacgcgacgcaacagggaagaaagaaacgaaaacagaaaacagacaagaggcacacaacgaacgatcacacagcaggaccaacacacacgacagaagacacacgacaacaggagaaaagaacaaagcaccgacaaagacaagagacacaagcgaacacacagcacgcgacaaacaagcaagaagacaccaaagagaaagcaagaggcagacaaagcgacaagggcgacgaacggagggagagaccacaggaagagagaagaaggcggaggcgagaacaggagagcagcgagacaggagagaggcgacaggaaacgaagggcgcggaagaaaaagaaaaagagggagaagaaataggagagaaaaacgcgaaacacaaaacgggacgaaagaagaagaaacagaaaagacaagacaaggcgaccgaaagagaaaaaaaggaggaaacaaaaaaaaagagagagaaaggaagaagagaaaaaagaaaagaagaca

SEQ ID NO: 701297 - DNA, 370 bp, Homo sapiens
cctcctggctcctcctcaggccaaggcaccatggtgagcctggcagcacctgacccagccatctgggcctccaccacttggagtaccgagctcaggacgcagatgtcagggcctgaccaccctgaccccagtgtccgagagcagcaaggtcgtcgtgtgaagaagtttcatttacaaactcagttcacatccccagctcacctctgtagcccatagcaccccctgtttcagccccaccgccacctccaaggggccctgcctttccctaacaatttttggggtctgccttggggaaggaggggagaaacacccatgagtgctcactaaaacaactttttccatttttaataaaacgccaaaaatatcaaaa

SEQ ID NO: 701298 - DNA, 840 bp, Homo sapiens
ctatccacaagtacaatgcttacagaaaagcagcatctgttatagcaaaatacccacacaaaataacagagtggagctgaagctaagaaattgcctggagtagggaaaaaaaaattggctggaagggttggagagagtttagagaaaatgtggaaaatcgtgtaaagtggaaaaagattcgagcaggatgatacgacgttcatccatcaatttcctgactcgagttagtggcattggtccatctgctgcaaggcaagtacgtagatgaaggaattcaaaacactagcaagatctcagaaaaaatgcagatcactggaaccatcatcagcgaattgggctgacatattaggggactttgacaaaagcaattcctcgtgacgcagatgtcacaaatgcacgcatatggtactaaatgacagttaaaaacgtggatcctgacatacatagctacagtctgtggcagtttcagaagaggtgcagagtccagtggtgcacatggatgtctcctgacccatcccagctatcaacttcagaactcaaaccacaaagccaaacactgtaaatcaggaagggaagcagcaacaaagggacacacatcaaagataccaggcacagggcgagccaacgccagcggggtcagccagctcccgtaaaacggagaaaagcaaatcaaaggaaaaatgaacacaggaggaaccaaagacacgaaacacaggcgggccacaataaactggaaaagcaatccaaaaaacatagaggccatgccctaaaaagagaccacacataacagaaaacgacagggacacacgaagagggaaccagacagaaacaaaagcaggt

SEQ ID NO: 701299 - DNA, 280 bp, Homo sapiens
aaccttcccttgaagacagaattttggtgttggtgcttgcaagcaagcattttcattaataatatgagaaatgatacctggagagagagattatgagcaaatgtattgcttcttttagaggaggaagcatacaacctcttttgtgtgaattctgtcattatggtcacagagtgcattcctaggttttcatttgagtacccactacacaaaggtgtccctttagggaattaagattagttttcatacatacatttccgtctgacatctgagtatatgacct

SEQ ID NO: 701300 - DNA, 221 bp, Homo sapiens
tctcctcaatctcctgagtagcgaggggcggggaccccaggcatgcaccaccacaccgggcggtttcattatttttttctagagatgagctctggcggtgtggcccagtcgggccttaaactccgggcctcaggagagcctcctggcctcagtttcccaaggtacggggattacaggtttcagccatggtgcccagccaattggttcacatcgtggagtcc

SEQ ID NO: 701301 - DNA, 181 bp, Homo sapiens
ggagtgagcagaagcgtgtgtgtagagaagagggaaagagacagagattgatgagtggctagtaatctgctaaaatccaagttgatttattctaagagacatatcatttgcgaagcgaaagtgcagccatagtacttctatgtaaagttatcgatttgaactacattaatccttgattgta

SEQ ID NO: 701302 - DNA, 507 bp, Homo sapiens
  misc_feature (501)..(501): n is a, c, g, or t
ggctttggagcaagcctctcatcccacttattttggttttctgcagccctttctccaaaagtttccaagctggtctccgtggggtgacgccccccacacacacacacatcaggaggtccaaggacatctttctcacacttgatctgctttctccctagaaacgcgtcgaacctctgtccctggtcctcctaaattgctctgtggcgcgtctcggtgtgttttgtgtgtatatcctgtttggctttccttggccctttccatttgaggccttgcagctgtttttgaggttggatgaaattcacataccataaaatgcaccatttcaaagtggcgtttaacacgcttccagaattgtacagcccccattactgctccccaaaaaaagaagccctgtgccttttagcagctgtgccctctttctctgccctagcttgtgcccacctccagcccaccgtctctgtaggtttgtctgttctggatgtttctgtgaggccgaaaaanaaaaaa

SEQ ID NO: 701303 - DNA, 1025 bp, Homo sapiens
  misc_feature (1025)..(1025): n is a, c, g, or t
ggagtgcgtttagatttatatcagcttgattgcgactgcttacttctagctggcgcatggatggatcacgtgtgcaaggttcagaagatattagagacctagtattaaccggcaatgcgtgagtagcagagttattctatacatatagcgcaatgtactatgtagtttatgtgcgttattggattaagtgattgctttacgatctctgcacgcgactactaacgactactatgatagtatcataactcaggcagaggatgcgagtgtaggtataagtctgatcagtcgtaagtcgttactcgagtcagctgtgatctatactgttgattatccacttactataaggatactgatctgtatcattgtagagagacaacatgtgtagtgtgttacgtcgacgtagaagtaatagaagagtgtagatacatatcagtctcatgcacagacacatggcacacgctcatccagactcgattcagtagacgtatacagagagcagtgtcgtatgcacgacaatcattcactggtctttagtcgccagctatcatatacttgctctcagtcgaccgtgatcaatcagacgagtatggagtgccatccgcacatctgtatgaccctagactgtctgactgagtcgatgctgtctagtacgtgtagcgtgtatctagagcacagtatgtagatcagtatagcgtttgcatgtcgttgttgtcatgcttgcgtgctaagctgtctgtaggtgctgatctctagtaatcgtagagtgaccattgccgtgcgtcgttcagtcgctcttgctcgtatgtcgctgtcatacggtacgtcgtttgtagcgtgctgtttgagcgtgtacatgctgtactgtgtgtgctcgctgatgtgcgatcgtcgtaacgatctatatgcttcgtagagttagagcttacatcgtacggtccgattgagtagtctgcgtcgatatgggtgtcgggtgtcttagtgtgtgagctgtgagactaggtatgagttgatactttcgagttgcn

SEQ ID NO: 701304 - DNA, 221 bp, Homo sapiens
  misc_feature (155)..(155): n is a, c, g, or t
  misc_feature (204)..(204): n is a, c, g, or t
aggcttgtgttagacatgagaaagcaagaatcaccttttcctctgctttttcctaacagctgcagagataactgacttctgctcagtcaagtcaactttggtgctgtttttggagtccttccttggcaggtttgagaaggtggctgtgttcaatnagaaaattaatggtactagtacagtgccctacacactgactggaagaangttgtcatgtacctgtt

SEQ ID NO: 701305 - DNA, 217 bp, Homo sapiens
ttccttcatagttatatgtcaggacatagtctggggcatgctggtgattttcatctggattacacagatacactttctttcatggtttaatttttaatcagagggtgtcctctaagggattcttcaccaagacggggctgagtaaaacggtgccactccgagtaagtgtatctgcagtggtccacctccgtgtgtcctccccggcagggaggatcag

SEQ ID NO: 701306 - DNA, 153 bp, Homo sapiens
catattgtctggttcggagcgtgccagctgctgcttgatgcatggctcgtccccggagttgggggtcccgttgcagcgccaggtacatgatgcaggcgaagcttgggatctggccacgttggactttgatcctttgggcagatgtcccattgc

SEQ ID NO: 701307 - DNA, 158 bp, Homo sapiens
gtttcaaaaggggtttgttttgttttgtttggttttggttttgtttggggggggggggtcattggggttttaaattatgttttttttggcacccaacagttatggattaactttttttggatgatgaagtttaaagggtccattaataggacccccca

SEQ ID NO: 701308 - DNA, 1326 bp, Homo sapiens
attgtgccgttcgttaacaccaggagtgaacgttatattattctccggtgcagtatttaacagtactcaggaccaaacttaaaaaagaaatacctccggtggtgaaaaagttacatttaaaaaggggaagtggagtgggggtgctgaaagggattagtaccttggccccaaggagctcacagcaatctctgatgggctccaaggaaatagaaaagattatggggaaaatgtacacaggagcgcaaggcaaaatgctgaatttcactgatgggagaaggtgcctcgaaagtgggcctcgaagggggaactggttggccggggagttgggctcatggggtggaggagaaaggcccccgaatggatagccaataggggtgggggtccgttggacgcgcccatggtgttattccaagtgggggggcatacaggtgagaggaggctccagcgcatataccagtgtgcggaggcaataaggaccggggatgacccagtggggaagactccgaatgtggaggcccctcggggggggacattgcccaatgggaggagaacggctccagagatgagcgcataccaaggtggtagacacggggcaggttggcattggcccccaaaagcactgggggctacacagcgtagggaatagccataaagccattgaggggccattggttgttgcaaggctgggaattatgaagagaatcccctggaattggggaatccacaaccgcggggtgggaaacagcggcagaacagagtttcaaaagtgttccatcgaacccagagaggacgtgaccccctgtggtgactacactgtacaacaatagtgggtgggccaactgtcactacgataaagccccacagaaggacaacacagcgtgatgagggacacaactgagaaggagggaataccaccaagcggggaaggggaggccccaccacaggaggtggacccacaggcatggtgggaacgatcacaccccgaatagaacaacaaacacacgctgtggagaagaagaccaaaccacacacggagtaaacccccaagagatggaaccacagctggccagagaagagcaaccaaaccacctgagtgggagaccaacaggacactacactatacacaaaaacacatgacaacacaaacgacatcaaaacacctcacataaaaacaaccacaacaatacaaaacacaataacgacgatcacaatacataaaaaacaaaaattcttcccacatatccaactgacaaacacaaaatataaacataaacctgcgattggataactcctttttctcttctcctcccttcctcgttaactttg

SEQ ID NO: 701309 - DNA, 663 bp, Homo sapiens
  misc_feature (1)..(1): n is a, c, g, or t
nggtagcataatcaactgtgtcctaattagggacctgtatgaatggctccacgagggttcaactgtctcttacttgttaacccagtggaattgacctgcccgtgaagaggcgggcatgacaccagccagacgagtaagaccctatggagctttaatttatgtaaagccaaccagtacctgaccaacccacaggtcctatactcccaacctgcattaaaatttcggttggggcgacctcggagcagaaccccacctccgagccagtacatgctaagacttcacccagtccaagcgaactactatactccatttgatcccgataacttgacccacgggaccagttaccctagggataacagcgccaatcctattctagagtcccatatcaaccatagggtttacgacctcgatgttggatcaggacatcccgatggtgccaacccgctattaaaggttcgtttgttctaacagattaaagtcctacagtgatctgagttcagacccggagtaatcccggtccggtttcttatctaccattccaattcctccctgttcgaaaggacacagagaaataaggcctacttcacacaagcgccttcccccgtaaatgatatcatttcaacttagtattataccccccacccaccccaggacagggtttta

SEQ ID NO: 701310 - DNA, 163 bp, Homo sapiens
ttagttgagccaactaatgacgtgaacgtccgtgggagtcctgtggctacaaagaatgtagagtctgtagatgccgtcggagatggtcgaagggagcactcgaagtactctgcaggcttgtaggagggtaaaatagagacccagtaaaattgtgataagcagt

SEQ ID NO: 701311 - DNA, 317 bp, Homo sapiens
cccacgcgtcgagagcctgggggcacaggtgcaaagccaggcactgtgcccagcatgtggctccctgcctgccacctcccctgccagtcatccaattacgagatcttgacatagctcgccagttcctaggtattcatactgcttcactatcggccccacgtcgttctacgacgctgggtacgacttaatctcgggcactctcatacgacattattctagatccgctgcgccgcttaaataaccacttctaaagccataaacaagaagcccgaagcaaccctaaattagtagcccccacacaaacatccaaagaccgc

SEQ ID NO: 701312 - DNA, 80 bp, Homo sapiens
ggatttgctggtgcagtacaactaggcttaatctcgaattcgactcgaattcgagctcgaattcgagcctcgaattcgag

SEQ ID NO: 701313 - DNA, 253 bp, Homo sapiens
gtgatctagaggatcccggaaaattagcgacgtagtataggtcacggatgcggctcgttctggtgtggccgtggtgtggtggaggctggcagtgaagctctgatttgaccccagcccaggaactcctgtatgctgcgggctggtgtggccataaaaacaaaacaaactaaacacttaaaaaaaaaaagtggaaacaaatgggtggataaggttgtgaaccttacgagggaagaagttgggattcggcgtcggc

SEQ ID NO: 701314 - DNA, 729 bp, Homo sapiens
tgtggaattaagcaggatacaactctcacctgagttcgagccagtttttagtctttttcgccttcaccaacaaacattcacttactgtgccacagtagaattatttggtcttgtgattggagtcctgacagcaagtatttcttcactgggagtccgagacgaaacaaggtggttgtctggggtagagtgtagactccactgcatgactgtatttagagcacaacattaggcccctgctcctcagtcctgggacgtgggctggggctgtgacagtctgtcagcgtctgccctgtgtctccaccacttctcaacgatacgtggttgcacgtagcgagttggcaggtgtgtgagcagatttgcttatatacctggcaagaagactgatccagttccatgacataatatgactggacccactgtgtagaaacaagtcaaagccaaagtcatacactggctagtcagaaaattatgctggaagaattgcagtggaaaaactgaacagaaggaagcagaaggtgctgagtggttacactttgcaagctgtggtgaaagatcacactgtgaaagatacacagagtccaatcaatgtgcactgtatgggcggaaaaaaaaaaaaactccgggggctcttttcgggggggcggcaacaaaaggttttccactggccctgtggcaagtttttcccggcccgctttttgttccaggggaaactccggggcccaatagggc

SEQ ID NO: 701315 - DNA, 270 bp, Homo sapiens
gaacaagcacagtgctgcgatgagctccaataacaactttcaaacttggagcagcaacgaatgcaacatgcgccaacacttcctgtgcaagtaccgaccatagaggaagaatcaagattctgctaactcctgcagcagccccgtccacttccttccagctagcctggctaaatcggcacattatttcagacgggaaacctagcaaactaagagtgaatagggccctactacactggctgttttaggctaagagacagaagactttagcat

SEQ ID NO: 701316 - DNA, 136 bp, Homo sapiens
gaggaacgtgtgtcacagttgtggggagcggtgaagtgtagaagggacagacgaggtcatgtactgggaactgccgagggtgggaggcatttcataacatttcttgttgatcaaaccaccgtgaacagcttctttg

SEQ ID NO: 701317 - DNA, 283 bp, Homo sapiens
cgacgtcatcgttgaagagtttttccatcgctcccgccgtggccaagtccgcctgcaatgccacagccttcgcgcctagcgcctcgattgcggcgacggttgcgttcgcgtcagcctggctggaagcgctgttgtagtgcacgaccacagccttggcgccatgcttggccagatcgcgggcgatcaacccgccgaggttcttcgcaccacccgtgatcagtgcaaccttgccgttgattgaatgattaggcatgacgacattcctttaattgggagaagtacg

SEQ ID NO: 701318 - DNA, 270 bp, Homo sapiens
tgctggcgctgcggactctgccagcacccagctgggtgcgaggctcgggccctcccgtcatgacccgcttgcaggacgcgcccgtggtgcggcctggcttcctgagcacggcagaggaggagacgctgagccgagaactggagcccgagttgctccacctccgagacgaatacgatcactgggacgtgaccatccacggcttccgagagacagagaagtcgcgctggtcagaagccagccggaccatcatgcagcgcgtgcaggcggccg

SEQ ID NO: 701319 - DNA, 101 bp, Homo sapiens
tactcaaaggtaagtcttttgttttttgttttgttttttggagacggagtctcgctttgttgcccaggctgccaagctggagttccgtggtgcgaccttgg

SEQ ID NO: 701320 - DNA, 645 bp, Homo sapiens
tagtggggtgatgaggaatagtgtaaggagtatgaaatattgggagggggggatcaatagagggggaaataaaatgatcagtactgcgggcgggtaggcctaggattgtgggggcaaatgaattgaagcgaacagattttcgtccatttgggtccctcagggattggttataatttttttattttatatgggcttgggtgagggaggtaggtggttagttggtgtctaatatttatagtggggtgatgaggaataggtgtaaggagtagtgggggtaattagtggggggctcataagtggtgttgtgtcgatgcaggtagaggcttactagaaagttgtgaacaacgtaggctgggattagggcgacagcgattcctaggaatagctcagatagaattagaaatggtgaagcatgaataacgggtacagggaccggtacacggggcagaaatggccagggggggggctccccaattagggtgccataaagtagaggtggcacctgcaagaaagtggtacgcggttaaggcgataacggccagagcaaattgggtcaaatagataaggcagagaggtccagacaaaaaccaagatgggggcaaacagggggaaagtagaccctgtgggacaaaaggggcaaggcaa

SEQ ID NO: 701321 - DNA, 857 bp, Homo sapiens
  misc_feature (204)..(204): n is a, c, g, or t
aggctttgggccaccacgcccggcttatttttatttttgagacagtctcactctgccgccaggtgagtgcagtggtgcgatctcggttaccgaatctctgcctcccaggtcaagcgatctcatgcctcctgtctcccaagtagctggggattacaggcgctgcaaaccatgcccggtaatttaacgcccagctaatttggtatncagtaggagatgggggttccacccattgtaaacccaggctggtctcggacttcctgacctcagttgatcccgcccgcctcggctccccaaaagtggctgggaattaccagggcgcgagccacatttgttgccctggcgctggattttaattccctttgcaggtcacagggcgctgggtggaataattaaccctttgttggttgttttttttacccaccttttgtctttggtctcaatccccaattgggtgtggtcgactgcgcccattgttgcggttgggtttcccacccttttgttgggcttagttgtgtggcgacattaaaggcgcttggtttatagttgaaacccccgtttggttggttacacagaccgaacatcaccaactgcgtgctaatcacatctaatacaacacaagaatcatctgttttctgtcgggcgcgcgttcttctgcgcccttagtaagaaaagacgcttttttttataagaacaccccatctcggttggtggggggcgcgcgcggcgggccccccccaatgtatgtgcgtttcatagctcacccaaccgttgttgtcccaacaggggcggtcttcaccacaaagaggaaagacatctcctggtggcacaacaggaacaacagcggggcgcgcggacac

SEQ ID NO: 701322 - DNA, 201 bp, Homo sapiens
gggcagggttgacaaagtgcccgcccttgggcctggcgtgtagtaaagagtgggtggtagggtaggcgcagtagtaattatggtaatcatagtagcttatatgtgtgtgacagcatgtggcaagaactgtgctaagcactttgtacagattatccacacaacagccccataaagtggctgctaatcagccaggtgggtagt

SEQ ID NO: 701323 - DNA, 1077 bp, Homo sapiens
gtactgcaatccgggccactgtctctgcatggtaaagtccctgataggaaggcagagcgacaagaacgaacgatactgatgcgcaaaccgatagctgtagcccgctcgctgcgtcagcgaccacatgtgtccagtcggtatgatactccctcctagtgatttggcgccatggtgggtttccgctgacgatggggacgagattgatatgcacaggctacatggtatcgtaggcagtgcacgaacaagacgcgtgttgttgtattccaatagaacgcacttaaagttatcggagcagagtgtgtcagggcgtacgcctggattgacattgcgagggcggtagatgggcgtagtgttgcacatcctcaatcgtgatacgcttggagaggcgagaatcaatcggaaatgcggtaggacatcataaatttgcgattgtgggtggaattgtaacgatgttgacagaggaagtccagtgcaagcagtggagacatagtgatcgagtcgcaagatgggcgggtagcaactgttgtcttgtcacgacgaagttgatgtagcaaagtttggtacgataaattgtagtagttatcgtggtggttgcttcccaaaatgttgaggtcatgttatttgtttgggagatctttaagggaaacgtggtagtatacttcgtaagatacgtccggatgaccttatcgaggaaaattaggcctcgcgttaagagcctttgcttgttaggcagtgcatgcctgtgccacaggggtggggaaagtccttgaaggatcaagtcccttgcggcaaacacctgggagcagtccaagatccatacctagaatggatagcaagataagacatgggcagaacggtgatataaatggagcgctctattccagtggatacccgtgggggattcgtgacaaggcactcggtggccgtggagttggctgaatgtacattgctcacggaggccctagcacatggtcggattggccattcacctagggaagtgacacgttgccaactcttgacatgcgtcaccctgtgaagtggtggtgcaaattcaaaaaatgccacacttgaaaggcc

SEQ ID NO: 701324 - DNA, 325 bp, Homo sapiens
tgaagagaatcttgctctgtcacctgggctggagtgcagtggcgcaatcatagctcactgcaccctggaactcatgggctcaagtgaacctcctgcctcagtctcctgagtagctgggactacaggcaggtgccactctgctcagctaatttttaaaattttttcaattccttttttttttttttttttgagacagggtcttactctgttgcccaggctgaaattaatttttttcatttttcatttttattatacagatggtgttttactatgttgcccaggctggtctcaaactcctgcttcaagtgattcttccattttggcc

SEQ ID NO: 701325 - DNA, 222 bp, Homo sapiens
cacaatgaggctcctcgagaggatgcaggaggctgggcacggagagctggcagggggcttggatctacgggtgcccagcgggttgtcaagctcctgtaactgatggactcaccctgcaatgattccggcaataaccgggacagctgcctgaaactagcaactggtgaggatgatgatgcctgtgatgaacagcacaggtgagaacaacagcccccgtttccg

SEQ ID NO: 701326 - DNA, 1753 bp, Homo sapiens
  misc_feature (298)..(298): n is a, c, g, or t
  misc_feature (402)..(402): n is a, c, g, or t
  misc_feature (864)..(864): n is a, c, g, or t
  misc_feature (1455)..(1455): n is a, c, g, or t
  misc_feature (1543)..(1543): n is a, c, g, or t
tggaaaaagcctcgggggggggggggggaaaatccttgtaaccccggggggggtggcggggacccaagaatacaccccaggtggcctccccagccctaaggacaaacagaagaatcttcgggtctcaaaaaaaaaaaaaaaaaagaaaaactccccgagagagaaaaccgggcgcgcctcagagttcggcgggggggagacgtggggctcgggggaaagcgcaccacccgcgcggtcaacccacccagagaggcgaaaagcacaccagcggtgggtaatatataaaagaagagagggnggaatcacaagaatattctcaccacgaaacagagagagggcccgcgcgcagagagggggccgcgtgcacaccacaccgcgggggtgtgtgtgcggagcgaaccncacgagagagagtgggcgcgcccgcgagagagagggcgcgcgcgcctctagaggcgcgcgtcgggcccccgcgaggttcatcccccccccctctcgtgggtggtggcccacacacatctctctctctctagaaagaagaagagagctctctctccagagagaatcacccgcggcgagagacccagaggaggggggcggccactctgagacgagaagagtggtcgcccccctgaggaacaaccacctctcgtgaggacgcctgtgtgacaccctctgagggggtggcggcgagcccatctgtgtggtagaatacagcgacaactatcaccgcgtgtgtgagaacaacacccccttgttaggagatgagacgacctcacacgagaacacacagcgagtggagaaaacatatgtgggagcagagtctctccccagaggagggcgggcagagagaagagcaacccnccacgaggggtggtgtagcggtccgccccccccggtggggtggtggtggcccccccccaagacgcacgcggggagcgccccccgctgagtgaccacacaactctgtggtgtggccgacaaacaggtgggagagaacaagcaaacaccaatgaatgtagaaataggcaccccccctatagtggacgtaataatccgcgtcagttcagtccccacccggcaaagaaaaagaaatgacgcgcaccacacaaggagtttatcacccccaagaggggtgggggagcggccaggacgacaaaacattgaactggtgggctcgtcgacagacaccacactctggttggtgtggtggcccccccccaaaagagaagaacatccacctcaaagagtcaggcgagtaagcacgaggtgaaacaaaaccccccccgtgtggtggttgtgtgcggtgagcaggcggacgatcaaaaaacgctacgcgacggggtgtggtctcccccccccagcagagactccttgtgtgagtgtacaatagagggcgggcacacaaacacacgactgcggcggaagaagaaacactccgcgcaggaagagaancacccacatcaacagcgggcgagggagagggcaggcgcatctcaacacaaacgaactaggtgcgttctgtgtggagccagcccgaccncagacagaaaacaccaaaacacagcacacgcggcgggaggtctacactataagtagttgcgggctggctgagcacagaacagacggtgatagtaaatagcgacgcgatgcgagcaaacgtgagtgctgccgccccgcacgattgtgtttacaagggagaaaaaacacggcgcggcccccaataaggagggcagcatccaccgactccgtc

SEQ ID NO: 701327 - DNA, 291 bp, Homo sapiens
aaacgtaaccgggagacgagattggtgagagaagctggtgattgagcgtagaggcaatatatgggggttgtagctgtatgactgaggatggagctgaaaaagaggttataggtggagctgaagtagaggctggaactgaagctgagactgaggctgaggctgaaactggagctaagggtgagtgctggaactggagctgaggttgaggccagaactggagctaaagttgaggctggaaccggagctgaggttgaggctgggactggagttaaggttgccgaagcttgatca

SEQ ID NO: 701328 - DNA, 800 bp, Homo sapiens
tcggcacgagggtagccctgccgttatcagtaccttgtggaaccggagctgggagcggattcaaacgaggcaccgaggcactcagaggaggctgccatgtcagaacctggctggggatgtcctgtcagaacccatgcggcagcaatggccatgcctgacgcctcttctgtgcccatgtgtgacatgctgatgcatgctgatgcctgctgacatgtgatgctgctaactgtgctgtggctgcaatccatgtgatggccctgtgaagcagactggacacttctgagcatattgtcaacccgacaggacacacaccttggacgtgtggttgcacatatcagcacattgggtgcaggacagtttgctttgcatgtgtgttgcactatatgtgacacatatgtcaccgcaatggactaccataaacaggtatacacacaacatgtggagggacaccgcgggagacggacaggggacccgggaggcactaagcagcttctggggtgcacgtgcaatggggccaacggtggcatgggacaccattgggctaacctcctattccacacgacctttggagcaattccttttgacataagaccacacgcgggggaagaacccaactagacaatgacatgtggaacaaaggacacgccaaatttggatatgagagaatcccgtatgggttactatcaatatggttacctttttgtgttaaccccaccgttataggttaaggtccacttacctgggacctatacccaacggggtggaggaaacagccaatgcgtgagccatttggaaaacag

SEQ ID NO: 701329 - DNA, 393 bp, Homo sapiens
gcggaacccccggaaagcacacccactttgcaaccgctcatagagcgactgcgcgattcggccaaactcgggctcaggattaaacccttcccagtaaatgttcgcgaacacggccgcagcggtattggcttcgtccgcactcgggctgaacgctacaccctgagcctgcccatactgggctgtgagttcgtcattgcggctcgcggagcagatgaaaagagtgtccttgccatccttcagcgatctgttcaacgcctcgttatgcgtacgccaagcaatatggcccgtcacttggagaccatcagtttggctggccagcctgagagctgcctgcaacaaagtaagtgacgacatctgttatctccttagcatttcaggcaagcaacgttgaac

SEQ ID NO: 701330 - DNA, 111 bp, Homo sapiens
gccactacatccccccagcacactgcaaagtaaaacctaattttccccttttactttttatgagagccagttaaacaaattggtggggattatactacacaacccaaggat

SEQ ID NO: 701331 - DNA, 1556 bp, Homo sapiens
  misc_feature (1181)..(1181): n is a, c, g, or t
tcaactgggttggagcacagggtacttaatggatgggtacatgacaaggtggggtctccctaggcccctccccttttcagaggggtgtcatacatgtggcaacgtggtaagggaggggagaattcaggtggtgggtgggggacgtgagtgtggtggcagggaacctccccagacaggtgagggttctctctctttcctcttgggtgctcttgtgggtggggcggtgggtggctcacaggggggttctttactctccttgtggagggccatgtgtgtgtggccatgtgagggcgtcacaacacaccctgtgtgtgtggcgtgatacgcacacaatatctgcggtggcgtcatatacccgagagagaacagtgagagacctgtgagaccacagagtgtgtggcgcgcgtgtgagagagtgaccatagtgcgcccacgcccccactagagcgtgtacacagagagtgtggagagagcaagagtcgggtgtgtgtgcgcgcgtgggcgggaaagagtctcatcagacgagagagagacaccacaccctgtgggtgttgctctcagagtgtgtgttacgccacagaggagagagtgcgccccttgtgcagagaggggggggccccctactctcgagagaagactcgctgtgacgatattccacaccaccaccctctctcttgtgtggagaataggcatcgcaatccacaaatcatattgtgtggggccacaaggagtctatactagtctcctcatcaagaccacgcgggggccgaggagtagtcattcccaaggggtcttcccaacaacacacaagctgtggcgcaacacagcggcgttgtagggaccacacgcagttgcgggagtagaccacacccaggaggaggacaagaggcggccgccaactattgtggcgacacaaatagagtgagaagagccgactcttcccccaccggggggtttatccaaactggctcttcccacagggcggggggattcttagagcaacacctctatttgtgggcaccacccaaatagaaacaggcccctctttgttgtgtggatcaaatcaggcgtacggcgaccccagattgttgtctcctcacgacagatgcggcgcacaaacagcgcgaggaccatcactcaacgacctctagatggctatcacatccaacttgagcggaacnaagacacacgcacgcccccccaccacgggacgagggaagaccaacacacacaacacacacaacagaggggaccgcaccccagacacaacgggagatgcacccccaccccccatgactgggaagagagacaggcaggcgaccaccaacaaaaatcagccacaaacaaaaggaagaccccatccaacaccgacgggcggacagggcacagatagcacaccgacaaggtgagtaaacaacgaatgtgatgacgccccttctgttatgcgtgacacacccccgtaggagggcaggcagacactcacaaccgtagctgagcagcatgcacacccatcatttagcacacagaacacaagaacaatgaaaatacgccacaaa

SEQ ID NO: 701332 - DNA, 819 bp, Homo sapiens
cgtagttttttcccccccgcgtccggggtccaacctccccccgcacaccgccctttggggggtcaacccccgccgccgctcgggattttcccccccggggttttttctggggggtgtacccgcccccaatactgtccccgcgccgtctgcatctcgttgtgtctcgcgacaggatactgtagtgggccaaattctgggggagtcgtttacagaggacagacaggtaggggactgtctacgtaggggcagtttctgtcgagacacacgacgagacactcccacacgaatgggggacataaattcgtctcgtggaaataggacaagagtcgaatccttcccgtgatggaggatcaatataccgcgctgttagaagcgagcgctctctcgtcgagatcagctgtgagcaataatcagtagcgggggtcgtatcaatctcagtccactcgagtgaagtctccttgttagtccaccgaaaaaggggcttttcacaggacaaaaaattatggtagattctatgagagggtgactttatggaattaatgttggctgtgttggttcgctgaggaccttgtcttccatctctatggtctctcccggtatcgcccgtgtatatcgtgccacgttcatattttgcttctcttcacgaggactctgtactagcacacttttttgtattgttctcactacttgagagacacctcgagcccttcggtatagctgcaccgtagaccggcctcggggtaaatcatcaactccggcgtggtgccccttggtgtatcatgaaaaaagtaaggggcagagcgccatcaatagtacgca

SEQ ID NO: 701333 - DNA, 239 bp, Homo sapiens
  misc_feature (175)..(176): n is a, c, g, or t
  misc_feature (212)..(212): n is a, c, g, or t
cacgaggggtcctgccggtcctgcgcgttgagcacgatcaggatggcgatgacgatggccagcgcacccaggacacccgcagcccacagcagcgcgcgctggccgggtgagaacgtccgccgcgccggcggggccgggcggtggctgccgctggcgggccggggccgcggggtgnncggtgccgggcgggccggctcgatggccgcgcgggnctgcgtgctcgacgggatcgccgccgg

SEQ ID NO: 701334 - DNA, 585 bp, Homo sapiens
tcccaggacacaaagggttaaatccaaacctctccacccgccacagttccacatcccagttcagcaggccatccggggacagtccctacgggggggtctgtctatgacagccccatcctgagtcccaagtccagtgtccggacggaggtggtgagtgtgctcactcgggttgctcaggaagactctctgtgcgtgcggtatgggtgtaggggtgccagcgccactccacgtctgcgtggtggcctccgtgctccagcgtgcccagagggatcatgtccagcttcagctcaaagcggggcccgacctcagtgagctccacgtggcgggtgggtctggtcttcttatacacttgggtgcctggggagggaacacgctggtgggtgtcaacgtgcaacgcagcacgaggtacacgggggggggatgcttaccgggggacatgtgcccgtggacccacgggagtcgatattgtagtcgtccgggttggcaaaggtgatgacccgggggtctgtaatcttggggcacgggaaataggtatcggaggatgccacagcgcggttgaccaggcgggaaggaaaagcagtgtga

SEQ ID NO: 701335 - DNA, 168 bp, Homo sapiens
  misc_feature (6)..(6): n is a, c, g, or t
  misc_feature (63)..(63): n is a, c, g, or t
  misc_feature (94)..(94): n is a, c, g, or t
cagganttcggcacgagctccgctgaccaggcaatctccttcaggtcacacagcaggccctgntccatccccactcagaacagagcatcccctnctcagcccagatctgagccctcaggactgggaggactcagagtcctgatgctcagtgagggatccagactggaa

SEQ ID NO: 701336 - DNA, 133 bp, Homo sapiens
tatataaatagtgctggggacaagggacttactgagaattttttttccaaatatttttgatccacagttagttgaattcaaaggcatggaacccagggccagagggctagccgtactttgaactcagtaggat

SEQ ID NO: 701337 - DNA, 620 bp, Homo sapiens
ggctcatatcagtcaaagaatacgacaaaaacctattatttgtgaaaacctgttttcaggaaatgcgacataagaattgagtgactccaggaagatattggagggaaagaccaaatcctcttaaaaataaagggccagttattaagtaccccttggaaaaagaagattggcttgaaaatatgaaacagtgaggaaagccatgaaaaaaggggaataaaaattaaataaggaccaaagcaaagagatcagagagaaaattattgatagaagacaggccattaccaatagaaaaaccactaagtattaaaaccacagactaggagaaatgtctgaaatttaaagaaaacttgaatctgcatctttaaagggtcctcagtatccctgggaaaataaacctggaatggtgaagtccaaggcatatactaggaaaatattgtaatttacagataaagaacaaatttgtctagatctccagggcaaagtatccaatcacttacatagggaagaaaatcggacttctcatctaaagtaaaagaataacgcaggcacatcttcaggaaactaaggaactgtggaataaggtttatgtagatagagctaaggttcaaggttctagcgaa

SEQ ID NO: 701338 - DNA, 148 bp, Homo sapiens
atccgttatctcaggtcagccctactgttcacaggacgtcatgagctgatatctgcaggtagatgtctgcggagtcatcccgttcttaaagatgatgccacgctgctgcgttgctgcctcctcgttgtgtacaattcacagtggggcc

SEQ ID NO: 701339 - DNA, 121 bp, Homo sapiens
tactgttggtcgtctcttacaggatcccggtaatctagtacatccaattttgatcctattaaaggtcagactccctatagttccatggtgatgtggtgtaatgtgcagttggtagacgtag

SEQ ID NO: 701340 - DNA, 101 bp, Homo sapiens
  misc_feature (46)..(46): n is a, c, g, or t
  misc_feature (94)..(94): n is a, c, g, or t
acagcaccttgccctgccacccaagctggagttcagtgagctgagntcacaccactgcactccagcctgggtgacagtagtgagctccgtctanatgaata

SEQ ID NO: 701341 - DNA, 282 bp, Homo sapiens
ctaagacaacttacgatcaaagcagaaggtagatctccagatctttgccacctcgtgcctacctggatcagacagttgtgcctatcttcttacaggaacttgctgtgcttgcaaaggaaagatgaggaaacagacttggagaggttccgtgacatgctcaagacaacactgctgacggggatttcaccgatgttgcccaggctggttgcgacctccatgagctcaggcaatctgtccgcctcgagcctcccaacgtgctaggattacaaggcgtgagccacc

SEQ ID NO: 701342 - DNA, 330 bp, Homo sapiens
  misc_feature (45)..(45): n is a, c, g, or t
  misc_feature (111)..(111): n is a, c, g, or t
  misc_feature (118)..(118): n is a, c, g, or t
  misc_feature (128)..(128): n is a, c, g, or t
  misc_feature (155)..(155): n is a, c, g, or t
  misc_feature (199)..(199): n is a, c, g, or t
  misc_feature (246)..(246): n is a, c, g, or t
  misc_feature (321)..(321): n is a, c, g, or t
ccattgatggagcactcacacactgtgccagcactattctaggtncttaacatacattaattacttcagcagccataacagcctaataaagtaagtaccaatattattctnattttanacattagganacagttacagacagattaagtaacttncccaaagtcacacagctggtaagatgggcagagcaactgtctanacaattacactgtatattgacagagtacagggtttaatattctattnttccttgggtttgtatatatactttgttttcaactgtaggggtaggtgcagggacctacagggcctccggggtgnaccggggtg

SEQ ID NO: 701343 - DNA, 371 bp, Homo sapiens
tgaacggtcctgccatcagggtgcaatatttgtagcactagatcagttgcaaagtgatcttccctgtgaatatctcattctatcattgggtactctgaagagcgaagtggccattggggtaagaagtttaggttcttgccatagcgtttgcctggacagggtaaggctcagggtgcaggacccttaaagaagactctaaggattttaaggagagtcgaaactctacattcatccatgcaaacatctactcttccatagatataatggatccactcatccgtgcaagacattcactctaacatccatccattcatccatctatcctccatcaatccatccatgtatctttcatacatccatttatcggggat

SEQ ID NO: 701344 - DNA, 133 bp, Homo sapiens
atgagattggtttctcctaacagcgcaaacaccatcacctgtcattgcgcttcccaacagcacacccctgttttttctgtcttcgatttggtagtagttagctagggcaatagcagagggggatagtcccata

SEQ ID NO: 701345 - DNA, 891 bp, Homo sapiens
ccttgggcgcgctttttttggtgggccccccattggtgagggaccaagcgtgtgggtgtgccaacagacaaccacgagggctgggggtcggccccgcgtctcgcgaggatttttttccgcgcgaggagattttgttttgtgggtccacccccgacgggctcgctcgcggagagacaccccccaacacacactaggggggccagcgctttttctgtcgccacacacacaccccgctcgctagagtagaagacgggcgccccccgcgcgtccgctctcatcactcatcaaacaagagatgagtcatcactcaccgcgcgcgccctcggtgggcgcaacgcagattttcctcccacgcgcagcacaccagcgcgcgctgtttgttgtcgcgagagagagagattcgagcgccgactcagtatatctcctccgcgcgcccagagagttcgtctcgctcgcacccacgatagatagatcggcgtggttggttggttcgccgccgctctctctgtttgtgagaggcgcgcgatatatcgacgagagagaggagcccccccgctctagagagggttatttttccctctcccaccgtcacaggagggagaggagaagaaaaacagagagagagaaacacaatcatatacattcttctgtgagggtgtttccacctccggtgatagcgacgaagaagattattattgaagaaaaagatacctctccccactacatgagaaaacacttcaacaactttgtctgattcggcgccactattggtgcaccaactcctgcggctccctccccccccacacggggggggattcctccacccccgcggggcccctttttattttttttttttgtttttttttttcaaaaaattgggggcccccccca

SEQ ID NO: 701346 - DNA, 138 bp, Homo sapiens
tgaaaaacatatgtcaaattaacatattgaagagctgctcagatttcattagtgatcagggatatgcaaaacatgattcaaaatgtggtactaatttaacttcctcctcgagtgggctaaattaggaagcctaaaaaa

SEQ ID NO: 701347 - DNA, 176 bp, Homo sapiens
atagacctgtacgccgaactctccgggaccacctctcacttcgacaccatcactgatccaccagtggtgctggtaactgccaagtgaagccctgcgcacactgcgtcagcagtgcactcgacctgctattcgcttttgacgaagcctgctggcaccgcagaggagcgggccgaaat

SEQ ID NO: 701348 - DNA, 336 bp, Homo sapiens
aggtgtttaagtgggggtcctgtatttttatgtgctaaatctggcaatacaggtctggcgtggtggctcacgcatgcaatcccagcactttgggagaccaaggccggcggattacttgagctcaggagttcgagatcagcctggccaacgtggtgaaaccccttctctaataaatatacaaaaattagccgggctcagtggcgggctctggggtaatcccagctaccctggaggctgcggcagaagaatctcttgagcgcgggaggtggaggctgcagtgagccaagatcgcgccattgcactccagcctgggggatagagtgagactccgtctca

SEQ ID NO: 701349 - DNA, 812 bp, Homo sapiens
  misc_feature (426)..(426): n is a, c, g, or t
taagcgccttttggtctcggggggccgcctccgggctcccccccgtctgtctgttgccgttgccgccctgaaattcatctgcctgcgacattccggccgcttctggttcccctataacttagttcgccgatatttgggagtttctttacaacatgtggcagacatttgacaacaaaaaacagcctcttgaactttgactcaagaattgtggattgcattgttgaaaaagttaaaaaaagaggaacacgttggttgaagaaacaaaacctcaaagcccggtcagcataacgtgtctcagattgtagtgacaaaactccactcgagaatttcttttggcgagccctttcaagaaagagcactttgagtggctctggttagaaaaccaccaaacgagtgagattaccttttgaaagccttgccttaggnggatagtttctaaaaagcacgagtgtgaattgctctctcaaaacaccttgcaagttttaatgtgtgcacagaatatgaaaagccaatttctagtgaggaaagtttcacagaatctttgaagaggaagtatgcttgttctcttataaagcctctattttggataagcgattatgaaaatttattaagtgcacttttattgaaccctacggaacaacaacatttgtgatgtggcacccagtagtgtaaacaacatgagattccggaggaattgaaaaaaaaggccagtatttgagctttaagaaaccggttgagaaaaagaaagccacacagaattccgaaatttggtcactgtttcacaatgtgctgctcgatttgtcagacccata

SEQ ID NO: 701350 - DNA, 140 bp, Homo sapiens
gacggtcaggctaagagcaggtggtggtctccagcatcagcacgaggaactgtctctgcgcaaacaggttgtgttggctgagaggacttggcactgcggatctacctccgttgcaaaagccggatgcgtcgcgtaaattt

SEQ ID NO: 701351 - DNA, 115 bp, Homo sapiens
ctgggttactagagttcctcgtaacaggcctccaccctaaaagatatcagctcaaatgtattagtgccaggttgagaaactctggattaagtaaatagggctatatttgattttg

SEQ ID NO: 701352 - DNA, 594 bp, Homo sapiens
  misc_feature (13)..(13): n is a, c, g, or t
tcacacatgatgnccaagcgggaggagcaggctcttcttcccgtatcatacaagacctttcacctttaatagataacccactcataaaaagacctcttatctactaactagtcctgtatacccttttactaacactcacagcacaaatacctaatactaacatcttatacttttaggagggaccaacaaactcaactatcctgcgcgccttcatactctgcctcataaaactcagatccctacgctttctcaacataacacacatggctaacaatccctcacttaccattaaaccatatttgctaccattgatactgagcctaccatttcactgtctaaggagatctaatcctcaacttctacatacttaccccattatcgcttagatccatgcaaccttcgactcattgacttatcactaatcacctttaacttcaaaaatgaacccccccttccataataattacatcacaagaaggttccctttcctcatattaccacacattttgaattcgttcaatacaacgcgcaagcctctcaattttgcgaatcaacaacactttaatgctacccgcctacaattatccccttaag

SEQ ID NO: 701353 - DNA, 401 bp, Homo sapiens
ccagaccccccccggggcccagggggccatttaggcagcccctcaggagcctgagcaaaaacggggcaggcaggccccaggcccagacaaaacaaaaaacagtggattaacagcggggcctcctgagggtggtggggaaaactttgccccctgttttgtggggcccggcaagtccctgtaaccttgacaacaggggcatcctcccaggcccccaacccagccatagggttttttttgtccgcaggggttttggggccaaatgggtgaatttttgcttttaacaatgggggatttcttttctttttttttttttttttagatcaaggataagttacttttgtaagcagaaaaatactttcaaacaagaataaaagaagctgttcgctagcccccaaaaaaaa

SEQ ID NO: 701354 - DNA, 835 bp, Homo sapiens
gggcaggttttcctcggccgcttctccatggaggaggcggtgcgaacggttcagccccgaatgctcgcattcccactggacggcgacgaattgcggtggccgtgcgagcgcagtgactgggcggctgtgtgggggtgtagagccgctggtgcccaaggctagcgccaggcgaggggaagcctgctgctggacagagcggaccgactagggttctgacagactgcttcattctgcctctagtaccagcggtatactcgtgttctagtgatcaatgtcgattcacaggaacctccttaagtaccacaacgaaattgagccagcgcgcgttgcgcaaaactatgaccttctagtatttgggtctgggacttgggctagtgagcgtccagaccatttcttcatttggcaggcaagtcttcatttttgaaacacaccgaattgggccttccttctgacgttggcccaggcaaatgggctctatgacagagccacgcggggaagcctggttgccgggtgggccagactatcgactgcggtataggcgctattgcggcccaggaccacttcttagttggagcttcccaagctaagagacggactctcagacggtagctaagtacaagttgcccacatccttatgtcctttccggtaccgttttccctcacagctgcacactgcacatttacagtcctttcacttgcggcagacaactttggggattgtcaagggcgacacggtactccctaagacgaactccattaacaggtgaagtgggtccagtgtccagatgacatcccaacagggcacggacgcgaagcattgaaggattgcgacaca

SEQ ID NO: 701355 - DNA, 343 bp, Homo sapiens
tagaggctagtgaggaaaaggaggcggtcccaagtcttagggacgacttaagaggggctggcggagggagtaaaacctcatcttccaggggccagagaaggctccgggggctttccattaaaaaatagaaaaataaaaaaattaaaatataaaaaaaccccagctctagcaggacactaaagctaagggctaagggcataggctcgggaagctccagcttcccaattctgtcttcccaggcggggcaacccggggcacttgattaaggcgtccaaggcctcaggttaatcccgtatgattgggtaatgacacaagtatggacctctgggacccttggtgattc

SEQ ID NO: 701356 - DNA, 409 bp, Homo sapiens
  misc_feature (229)..(229): n is a, c, g, or t
  misc_feature (365)..(365): n is a, c, g, or t
attttactgaaaataataaatgcttaaatcaaatgtttttgtcagaaaaatagaactttaacactttttggttcatgtgactatagtaatctttgggaaataaagacagttttaaagattattgataaaataaaaatgtgaaaatttagacatctggtctaaattaagcaggtcagatactgtgttcactaaactacttaaactgcttttttgacttttgatagttgtncgacttacctgctttggagccatttggttctaggtaaggcctggagaaatgtggagttagctatgcaccctggctatactgggaaatagttagaccttacctgtacttctgtctggcatcctggactccacatctnggtacatatttaaatcaccctcttaccagggttttcatcaaaat

SEQ ID NO: 701357 - DNA, 138 bp, Homo sapiens
gccccaattttttttggggaattaaaaaaagcaaacttttttcgggttttggttccaataaaaaaaatttaaaaaaaaggctgaaaaggtttgtttttgaatgttttttttaaaaaaaggggccccttttggccccca

SEQ ID NO: 701358 - DNA, 939 bp, Homo sapiens
  misc_feature (32)..(32): n is a, c, g, or t
  misc_feature (131)..(131): n is a, c, g, or t
  misc_feature (157)..(157): n is a, c, g, or t
  misc_feature (200)..(200): n is a, c, g, or t
  misc_feature (202)..(203): n is a, c, g, or t
  misc_feature (206)..(206): n is a, c, g, or t
  misc_feature (213)..(213): n is a, c, g, or t
  misc_feature (222)..(222): n is a, c, g, or t
  misc_feature (237)..(237): n is a, c, g, or t
  misc_feature (267)..(267): n is a, c, g, or t
  misc_feature (271)..(271): n is a, c, g, or t
  misc_feature (330)..(331): n is a, c, g, or t
  misc_feature (337)..(337): n is a, c, g, or t
  misc_feature (341)..(341): n is a, c, g, or t
  misc_feature (345)..(346): n is a, c, g, or t
  misc_feature (351)..(352): n is a, c, g, or t
  misc_feature (366)..(366): n is a, c, g, or t
  misc_feature (370)..(370): n is a, c, g, or t
  misc_feature (372)..(372): n is a, c, g, or t
  misc_feature (380)..(380): n is a, c, g, or t
  misc_feature (400)..(400): n is a, c, g, or t
  misc_feature (404)..(404): n is a, c, g, or t
  misc_feature (518)..(518): n is a, c, g, or t
  misc_feature (540)..(540): n is a, c, g, or t
  misc_feature (764)..(764): n is a, c, g, or t
  misc_feature (775)..(775): n is a, c, g, or t
  misc_feature (909)..(909): n is a, c, g, or t
tataatattataagcaccaaatttataatatntaagtcaatttattaggggaaagaaacaccatcaagatacttccctccagcaaaacaacgatagttcactcctccaaatatccaaattgaagatctacnaaaacaaaaacaaaaacaaaagcccncagagaaataaaaaggaacaaaaatcacattctaatggggggngnnagngcatttnggggtcttngctgtgctgtctaancatccttcagctgactttcaaaaaaaaaanaccntaagctcatcaaaatatacattttccatttgcttttttaaattaaaaataattattaannaaaggnaaantttnnggggnngggagtgggttggntggntnatttatgntgttatgtacgggatatggnaggngagggggggtatttgcggaacatgtgattggggggtactgatcttcagggtttagctttcttccaaacagtgtaaaatacccacaattccaagtatgaaggggcacagacgatntcctttgaaaattccacagganaatacaggcgccccagctgttcttcatagagcggcagtgcttctgtcagattgacacagttcccctgtgtaaaatatttcccatcctgtttcaacactttcattgagaggtcaagaatcagtctgagaaactcccatgtggaatcttcttctggagacgtggagattggaacagctgtcaaatcattaatcacataatcaaattctctcccttctttggcgtanctcttcagtancgggatacagtcttctattagaacctgatagcagtctccttttaagattgtctaagacatcgccacacgtttttcgcatgtatttcttacacccatcaatcaccatttggtcaatctctaccatagtgaccatntttggttttagtttgactatttcacacaat

SEQ ID NO: 701359 - DNA, 315 bp, Homo sapiens
ggtttcaggcgcggtgctgcggcttggccgggcggagctatgccgctgctggatatttcggcgctggagtgcctatggcgccgttaagcgattggccgtggcgacactgggcgcgccttcagccgcaggcgacggcgttgctgctcggcgaacagccgctgagctggctggcgttgcaaggccaggtggatgagctggcggcggattttcagcaccagggcgtggagccgggctgcggcgtggcgctgtgcggtaaaaacagctacccgctgctgttggcctatctggcgctgctgcaatgcggcgtgcgcctgt

SEQ ID NO: 701360 - DNA, 714 bp, Homo sapiens
tgacaactttatcatattgtgctgatcgaagaatagttgagtgattggaccaatgatggatggggcctgaagaaagctgctgatggggctgctgagccaggcgttgtggggctgatgatcgaggcagctgaagagcgcccgtggtgtgggtagtctagtattctaactgtagcccttcctgtgtatcctggtttatcctcgttctgctgttctggagaataaacagaccagtggtatggagtataagagaactgatgcacctcaaccggatgtgaaggaagaggaacaaagagacaggaagaggaacaaggacacagggagcatgaggcggaggacggagcaagagacacttgaagagcaaacagaaaagtgatgctgaacgaagatggtggcactgtctagtcaagatgcgaggaaggtcatgaaaacctaaagcgagaggtaggatgcaaattttgaaccagatcagcaatgaaagcagacaagccaggaacgagagtgaaacaatcttaagagcttgatctgtgatttcttctccctcctcccctgcaatgagtggtcctagtgcagaggacctggaacgacttaggtcagacattcagaaaaacttcaagaccataacatcagcaggctccagttgaacagctagtctgtgtaactttaaaacatctaggcagtaaatagttgcaagaatgtggataataaaatggaccc

SEQ ID NO: 701361 - DNA, 1231 bp, Homo sapiens
tccgcccacgcgtccgcaagagactggtgcgaacaggctgtcctggagtggcagaccaggttgccttgccgcagagaaaacaccaaagtctcctgtacgcatcataaagaagtctcttgggactggcgagagaatccagaccatcttggggcagccaggcccttgccttcactttttacacgaggctagcacaacgtgacttccatactacgaaaagccaccattacccacttcttctacacactgatcttcgtgcttcctaactggccatagactcaaagggcctcagaaaaccattcgctgtgctactccatcgtattgaaagcaactgaccaacgcaaccttcacctttccaccggctgggctctccaccgatcacatcactcaccttaactctgcctgctggaaacccctcctctctcgggaggaccgttaacacgcgccgctctccctctaccttcgctctcctccccacacgcacctgctcctgcactgctgctggtcaccggtacgcactctcccttcggaaccagctggcatggtaaactaccagcaccgggccaccctgccaactaagccctacttctacaacgcacccctcactgctgcctctgccctcgccgcactgctccccttacgctttcctcttcccctaccccctacaccgtgcccctcaccttcccactccctcctccctgctacaccgcttgcccccccccgctcctgccccccccctgcctctcccctcgaacggccaccgctccccccacactcacgcccacccccacccccaccaacacacccgcgccccggcccccgccccccccccccccccacccccccccccgcagcgaccccacccacacaacacccccccgaaacgccgaaccaccactccccccaccccccacaccgacccaccacacacaccgcccccccacacacgaccccacacacaccacgcccgctcctgcccccccctccccaccactcccccgccgctgacacaacccgaccaccccccccccccctaccactcccgccctcctacttccgccggacaaacacacacttccccccccccctccccaccctccccccccaccccccaccccccctccccccccccagttcccccaccccccccaccccccacccacccccccccccacatcctacacccactccctatcacaccaccacccacccctctccctcccctcccccaccc

SEQ ID NO: 701362 - DNA, 163 bp, Homo sapiens
tctttcaagagagaatcatggattgagcagataaacatgtatataaacggcgttaagtatacaaattaaaggccaggggccaggcgcacgggctcacacctgtaatcctagcactttgggaggccaaggtgggcgattggcctgagcccacaagttctcgacc

SEQ ID NO: 701363 - DNA, 117 bp, Homo sapiens
  misc_feature (25)..(25): n is a, c, g, or t
  misc_feature (27)..(27): n is a, c, g, or t
gacagcgagttcacagtgcagagcncnaccggccactgcgtccacatgagagggctgccctacaaagcaacggagaacgacatttacaacttcttctctccactcaaccctgtgaga

SEQ ID NO: 701364 - DNA, 861 bp, Homo sapiens
  misc_feature (172)..(172): n is a, c, g, or t
  misc_feature (221)..(221): n is a, c, g, or t
  misc_feature (232)..(232): n is a, c, g, or t
  misc_feature (244)..(244): n is a, c, g, or t
  misc_feature (273)..(273): n is a, c, g, or t
  misc_feature (281)..(281): n is a, c, g, or t
  misc_feature (296)..(296): n is a, c, g, or t
  misc_feature (323)..(323): n is a, c, g, or t
  misc_feature (326)..(326): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (364)..(364): n is a, c, g, or t
  misc_feature (375)..(376): n is a, c, g, or t
  misc_feature (407)..(407): n is a, c, g, or t
  misc_feature (415)..(415): n is a, c, g, or t
  misc_feature (417)..(417): n is a, c, g, or t
  misc_feature (420)..(421): n is a, c, g, or t
  misc_feature (445)..(446): n is a, c, g, or t
  misc_feature (452)..(452): n is a, c, g, or t
  misc_feature (456)..(456): n is a, c, g, or t
  misc_feature (459)..(459): n is a, c, g, or t
  misc_feature (482)..(482): n is a, c, g, or t
  misc_feature (615)..(615): n is a, c, g, or t
gagtgctcgcagtgcgcaggcgtggggctctctccttgtcagtcggcagccgcgtgcgggctggtggctctgtggcagcggcggcggaggactccggcactatgagcggcttcagcaccgaggagcgcgccgcgccttctccctggagtaccgagtcttcctcaaaaatganaaaggacaatatatatctccatttcatgatattccaatttatgcagatnaggatgtgttncacatggtagtngaagtaccacgctggtctaatgcaaaaantggagatngctacaaaggacccnttaaaccctattaaacaagatgtgacnacnggaananctncgctatgtgcgaatngntncccgtatanggatatatcgnnaactatggtgccatccctcagacttgggaanacccaggncncanntgataaacatactgctgttgtggnngacaantganccncattgatgtgtgtgacactcgangcaggtatgtgcaaggaggtgacatactgggcgtgaaacgttctaggcattatggggctatgattgacgaaggggaaaaccgactggaaaggtcatttgcccattaagtgtggatgatcctgatgcagacaanttattatgattttcatggtgtcaaccggttgaaacctggtacttagaagccactgtggcgggttagaagggttaggtccggtggaaaccgaaaagggttggttctgcggcataaacagggtgggctgtttttaaaggccgcctgggagccttggcccaccacgggaggacaggcggtaaattgtggccccgtttgtctgccccggtgttccccgttgccacacggggcgccacacatgccgtcact

SEQ ID NO: 701365 - DNA, 261 bp, Homo sapiens
  misc_feature (249)..(249): n is a, c, g, or t
cgacaccagcgtgatgtcgcccttcttcatgccttgcgcctgcagcaggtcgtcaatcacgtaggcctggccgtcgaacgaggcccagacgcccttgaactgcccctggttgcgcaggaacagcgcctgcatgccgttgcgcacgtcgtcgcgccagctttgcgtgcgcgccatgctgaacttggccaggtccttgacggcggtgttttccgacagcaccgcgtcgagcatcttgccgcggatgcgggngccggagttgcc

SEQ ID NO: 701366 - DNA, 189 bp, Homo sapiens
ttttttaagtacaatttcattttatttttctccagagaatagcctgtcttcagtctttaagaactcgagctccttcatgggtggggggacgtggggcagcacccgcagtcttaaatcgggtggggtgtcgcttcggcttcacgagatcgatcctgactacttggctgtgaattgcacaactcacacagt

SEQ ID NO: 701367 - DNA, 744 bp, Homo sapiens
  misc_feature (288)..(288): n is a, c, g, or t
tggctgcgggttgctgctgggacctggcggtcctgcaggtgtgccggtctctacctggtggcctgtgctgcggtgcgcagccgcgccctgtggcctggggctcgtgtcaccctgcgcagctgcgctgtcttcccatgtgctgcccctgtgcttctggtgcctgtgccctgagtgtggggctgcctgacatgcatgctgtgtgtgtctggtggcctgatgtgcctgatgcttccatgtgccaaaccccatttactacagaacctgcttacctgcgtgacaagaatccangcattgcattgctgccaggtgtcaagtgaacccaatgcataggcattatatggagagtcacctgctctttgtagatggaaaaactggcagggttggaaagtatatccggggagaatgcattgcacaagagtagtggtgcgcaatatccccaaggtggccaacaggggtttggagctcttttatacttcccaaagcaatttcgctgtgttggcgaagaccgagtagcacagtgaacccacggcaattgcaccatattgaggcgcgacacacaacccaagggattcgtttggatagaaaaacccacggaagggggacttttccaaccttaaaaccgcggaccccagataggaacattcattccaagggttttccaaatttccttattataaaacaatttttaggaagcgaagatttggggcttacaacaacacagtgaacacacaaaaacacctgtgg

SEQ ID NO: 701368 - DNA, 333 bp, Homo sapiens
atctgtttataaattgaataagattactataaaatgttaattattctggctgggcggggtggctcatgcctttaatcccagcactttgggaggcagaggcgggcggatcacctgaggtcgtgagtttgagaccagcctggccaacaaggagaaaccccgtctttactaaaaatacaaaaaaattagccgggtgtggtggtgcatgcctgtaatcccacctactcgggaggctgaggcatgagaatcacttgaacctgggaggcagaggctgcagtcagccaagatcgtgccattgcactccagcctgggcaacaagagtgaaactctgtctca

SEQ ID NO: 701369 - DNA, 1127 bp, Homo sapiens
  misc_feature (179)..(179): n is a, c, g, or t
  misc_feature (356)..(356): n is a, c, g, or t
  misc_feature (1127)..(1127): n is a, c, g, or t
agcggatgcggtcttaatctcgtgttgaaggctggaccgtgtgcatcaattccttgcatacaggtgtatactattgtcctcgtatcatgtggagtctactacgttggctctatagtagtgccctcgacatagatcacgcacagggaaggctgctgcgttcgaatctgctcactagcttngcaacgcgcagaaaatctatcaggacatggaccgcacggtatacaagatctaactggccatgctgacagcgaactggtgtggcttccttggatggggatgcacgcccagttccgggacaggtcgtccagaggcaactcgtgcttattctagcacaggagcgtgcactgaacgaagancatctatgaggtacgaaaaaagacgggaatgaggcaagcagaaactagttgggatctccccaaaggaacggcgtctgagaatgcaatacgcatgatttgaattagacgagccacagccattggaggcgaccaaggaaggatcttcctcgtgaggggacctttccacttgcaatgggcacgcgtgcaatttattgggccaagcgatagttccagattgagacttgggtggctccctctggattcgggagattccttgtccctagcgagtcgctattaagtgcccatactgagtgagaatcgccgtggtggacatagccatctagcggcgaatagattctcgctgcggggtgagaacaaatcgtttacgcttctccagcctgaatcaatttctttgatccctgcctatgtgcctatggtccaatttaggcaagtcctagtggtccgatacgccgcaggtcccaagtcgatctcttggagatagcgatggatgaggagagtttgctatgtacggggaaccttgaggtaggatttccgaaagacacacaccccttcggttggtaacacgtgagagaggccctttcacagttgtaaaaaccccaaacaagggcgacttaggatctgcgttaggaagaacgatcggaatttggttttaggaaagggtaaccttggttgggtttaaccgttaggagtattggagttctaacctcaaattttagggggaaaatatcgttgggctcaggagggtattttagagatgttacttcgtgggtn

SEQ ID NO: 701370 - DNA, 892 bp, Homo sapiens
  misc_feature (25)..(25): n is a, c, g, or t
  misc_feature (74)..(76): n is a, c, g, or t
  misc_feature (83)..(84): n is a, c, g, or t
  misc_feature (104)..(104): n is a, c, g, or t
  misc_feature (110)..(110): n is a, c, g, or t
  misc_feature (112)..(113): n is a, c, g, or t
  misc_feature (115)..(115): n is a, c, g, or t
  misc_feature (117)..(117): n is a, c, g, or t
  misc_feature (131)..(131): n is a, c, g, or t
  misc_feature (137)..(137): n is a, c, g, or t
  misc_feature (154)..(154): n is a, c, g, or t
  misc_feature (187)..(187): n is a, c, g, or t
  misc_feature (189)..(189): n is a, c, g, or t
  misc_feature (196)..(196): n is a, c, g, or t
  misc_feature (213)..(213): n is a, c, g, or t
  misc_feature (216)..(216): n is a, c, g, or t
  misc_feature (229)..(229): n is a, c, g, or t
  misc_feature (231)..(231): n is a, c, g, or t
  misc_feature (245)..(245): n is a, c, g, or t
  misc_feature (254)..(254): n is a, c, g, or t
  misc_feature (268)..(268): n is a, c, g, or t
  misc_feature (282)..(282): n is a, c, g, or t
  misc_feature (320)..(320): n is a, c, g, or t
  misc_feature (338)..(338): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (365)..(365): n is a, c, g, or t
  misc_feature (409)..(409): n is a, c, g, or t
  misc_feature (430)..(430): n is a, c, g, or t
  misc_feature (456)..(456): n is a, c, g, or t
  misc_feature (463)..(463): n is a, c, g, or t
  misc_feature (475)..(476): n is a, c, g, or t
  misc_feature (534)..(534): n is a, c, g, or t
  misc_feature (538)..(538): n is a, c, g, or t
  misc_feature (541)..(541): n is a, c, g, or t
  misc_feature (594)..(594): n is a, c, g, or t
  misc_feature (597)..(597): n is a, c, g, or t
  misc_feature (601)..(601): n is a, c, g, or t
  misc_feature (612)..(612): n is a, c, g, or t
  misc_feature (776)..(776): n is a, c, g, or t
  misc_feature (789)..(789): n is a, c, g, or t
  misc_feature (805)..(805): n is a, c, g, or t
  misc_feature (811)..(811): n is a, c, g, or t
  misc_feature (831)..(831): n is a, c, g, or t
  misc_feature (875)..(875): n is a, c, g, or t
tatgataatacagagaagagattangtggcagttgcccagaatctttgtggattacagatgcaaagtagttagnnntccttgnncccacacttcagttacagangggggngnnancngcataaatacaganaacatntgacactagacatttcncacctttctgcatttccattttaaatgtatgtntnttacaantttacatattaagttantantccacatattttntnacaatggctaaggntgcaatgtncccatccccctganataaacagactctngtctgcaacacagaacatttcagtgggataccaaacangcccttaacacgtaacanacaaaangntntttaaaaatcagattnttacaatgttcttcatgttatataagggagaagaaagggaagtnaaaaaaaaaaaaagagagacnttgggggggtttaaatgtatagtatnttggggncataaatgtttnnttcccttcctccaaaggggaaaaaaatgtttaactaatggaaaaagaaagcaacatcntaangcnctacaatgaggaagaccccatcctgacagtgcttagttgcttccttttattanatncggnaggtagcagancaaagtcacaaatattggcttggtttttatttctatgcttataaaaaaaatatgaagcttctttgtgtggactgaaggggtgttagcctgtggatgttggtcttcggtgcctgtaccccagtggctgtttacattccaggcccctgctaaataaagcaggctcnactgccagctgtntgtacactttttcttnggggangagttcttgtcttcagtttnctgcagtagggttcctggctctgttacatgctctgtgttccggnagaacatatgaaatatc

SEQ ID NO: 701371 - DNA, 597 bp, Homo sapiens
tggtggtgcacgcctatagttccagctacttgggaggctgagtcgagaggatccttccagcccaggagttcaagactgcagtgagctatgattgtgccaccgcactccagcctgggccacagagggagagatccagtttgtttttcttaataaaaggacacataataacagaccacaaagaatcatcagagacaatcatgaacaactatatggcaacaagttggaaaacccagaagaaatggataaactcttggagacataccacagattgaagccataataaaatgtctaccattgaagaaaagcccaggaccttatgggagagatccagtttgtttttcttaataaaaggacacataataacagaccacaaagaatcatcagagacaatcatgaacaactatatggcaacaagttggaaaacccagaagaaatggataaactcttggagacataccacagattgaagccataataaaatgtctaccattgaagaaaagcccaggaccttatggcttcactgctgaatcaaacatttaaagaagaactagtaccaattctactgaaactcttcacaaaaattgaagaggagggcca

SEQ ID NO: 701372 - DNA, 925 bp, Homo sapiens
  misc_feature (337)..(337): n is a, c, g, or t
gggtgtgtagcactccgccgagtcaagcaatctgtggcccacataaaatggtccggaaaacaatatttggtggacgcccgtggccaaagtgtttcggcgcgtgcccccgaacttttattaagcagcgcggttaataagtagcgggcccacttgccgccgcattcccagcacaccgcggttggggagcccttttttcaagcccgcggttttaaacaaagaccacctcccacgcggaagctccaaatccacccattgatgttgggtctatttcagaccgctgtccaagtagtaggaaaagattggggcgcaacctacccacaggaaagatggcctggtncacacaagagaggaggaaccccccggatagtgtgtgggcccccaaggcacccagttgtgtacaacccacgcacggggagcaccggtgtgagcctactaccacacgggtttatgataaaattgaggtcatgtcccacaattttatcagaaaaatagtatgtagaactaataggcttcttaggtcaacccttatttatatccctttgagtttctatgggacaaccccccgctctattcttgctctggtcaccccaagaagccctatggtatgaacccagggtgacccacgggtgtgacatgatgtagcagcactttaggaggacatccaagcccgacgcaaggggattatcgtcaggggcacatacaagcctgtagaagaatcctaagaaccaaacttacaaggggagatgttttctcttctgttaccaaaacagttgtgggtgtaataatactgctgccactcgtctttctaccaaagggatgatacttatgacatggagtattttctttgacaaacaaagaagttgtggacgcccccttctgtgttcccccaacaaaaaagacgaggttttatcccgcccacaaaaca

SEQ ID NO: 701373 - DNA, 1188 bp, Homo sapiens
ctggaaattgctctgggggataagcaagcgcgccctaagagaactggtctctgttccccaaatttccggggcggaacaagctcctcccgtgataaagtccaacgggtctcttggcccaagatctgtggaatttccgcctctctggggcaaccttgggcccaattccggcctggttgaagctaattagatccgtgaatatgccgttgaccgggtgatcggggcgaggaaattcggaaaggtgtctcaacgctgccgtccggtgaataatatcggtgcagaaaggcagagggaaactctacggactgaaaggccaatttgtaacgagagacgcgcctctaatgtctgtaattgcttacaaaggggccaccagaaagcagcgcaaggtcactccgtatacgaaataagcccaacgtcacagccatgtctatgtggaaacgaattacatgtgcgtgggggagacaacgtcgtgagacagttaggcacatttaactaaaaggagtatggctttatgaaagaaatgcaagcctgctgtgtccctaggctaagattgagtcgacttgtctcctggagcaagctagaccatgggggaaacgacacgctagcgcccttcgcgtgcgtcgaagcccgtatgctggacgtcaaggcaacgggcatgccctcagcgaatagtacctcagcttcgggctgcgagacggcaagcactcgggatagtcggtcatgccatgcgtccagttggggcccgcgacatacagtgtcaagactaggacgtcattacaaagtacagatgagttgtgaggacatgcatgaaaagaactcagttcctaactgtgggtctccaagtatgttgtgacgctgaagatagtcgtgctctatgtcaatctattgtctctcacgttgactaaagtagaaaattatctactagcatggaccaggggcgactggtggcttcacacgctgctaaatcgccacgcaactgttgaggaaggccaagtgctagggatggatcatgaaggtcaggagttacaatgaccagcgctagccaagatggtgaaaccccgtctctagtaaagataacaaaaaacttagtctgggcttgatcgcatgcagccttgtaatcccagctaactcgggaggattgaggcaggagaatcgcttaaacccagtaggacagagggtgcagtgagccaa

SEQ ID NO: 701374 - DNA, 1381 bp, Homo sapiens
  misc_feature (566)..(566): n is a, c, g, or t
gacgctggtgtgagaacaccgagactcagtcatgactgatagctcaatgcgcatgatgcaaagtagttgggaaaagtagcgtgccggggacggctttgcggtgactccagtttgcgtagagaagaactggttgggattacacaatgctcttgaggttagttgtgctcccactgtagagagaggacgataactgcgagagactagctggcagtgtctaaggatccatctcctctcgtcggtaggtgcttctgtgatgtgtcctgaggttgccactcggatccaggactgatcacagagggtcccggccgatgaagattttggccctcatctgtggccttcgtggtgcggcgtcgagatctcctcattacacggtacactagaaaagagtggtcgaggtacatctgcgccgaggacgatcatgaatgctgtactagtggagtcgtcaagagatctctgcatgacgtctgattctcaagcagatcctgcaaggtcctccgatcctaaatataaatgcgctagaggcatgagttcttctcgctatccccgtagttgactttctatcaaangaggaaaccacttttgagataggtcagaagtatgagaagtgaagcgtgaaatcttgacacctatatatcaaacttctgccctatttgggaaaggaacctgtgttcgtttaactaggttctagtggctttgttatgacttattgagttcactcgttgaatctgaattgcacgcgagaaccggagttagtttgccgggggatagatcttaaggctaatttctaatgccataggtggtttggctacaattacccattttcttgtggcggtgtggtgccatttccgtcctttcaaagggaataggtctatcgtcgggtcgatgatagactggttcccccgagcgtcccttctcatttttacatcataatcggtatgcaacgctaagtgggggcaaaagaaccccccttacgcgcgcactttagttacttcccagggagcgacgctgttgtggtggggcgtgaccttgtcccgtatgtttagcaccacgatttccgagatccaccccttggagtttccttcaaaaattaacccttccggccactttcatttggccacgaaattggcttaaggccggcgagtgtgcacattggttcgccgtttgtgcgcccttatgagaatttaccgttataaacacgggtttgagttcaacacggtggtgtgcccaacaatggggatccttaacccgaaggcatttgttcgtaggcaagcgcccttttaaggcgtaaacgcacattgcggaaccaccccttgtagtgacgtgaggaaacccatcaaagggggtatttagctttgcgcaagtttagtcccctgatacaagg

SEQ ID NO: 701375 - DNA, 558 bp, Homo sapiens
gactgtgctgtgtacacatacaatgaaattactcaacttcgctgtctcagtcttcctcatatacgaatagggggatagtgagaatatctacattatatgttgatgagactaaaataaaaggcattcacagcagggcctgccacagtaagcacacaataaatatcagcttctgtagtgtgaggtagtgtaactgtcacggcttagaagaacaggtctaattctatagatttattttacattcataagaagtgctaggatatgtagcagatgcaaccaaaccccaatctagagatacggtcagggactgtcctctcagggaatgggcattccctcaagcagtgtcacttccctcaatcggtctgtcttcagttgtgcaccggaaactatactccagaaaggtatctctcaggcctgtcaccacatttaaatgtcaatttcagttgcaggggaactcacatctatacatccagactatcagatgacagatataggcttggaaaacttaggctttggaatcctaacatgatcagctcagtcctgacctcacgccatgcgggt

SEQ ID NO: 701376 - DNA, 240 bp, Homo sapiens
ttattgaatcctgtatattgccaccactctgtgatagttccacaatgatagtggtcgtgtctctatggtcgctcgctccagtgcattctgcgccgcttccagctccagccgatcgtgagacacggtcttcactagaatggtgatcaggtccatggtcggatgtggcggtgtgtgtgactcctcctaagacgacggcccggcctttcgggctgcgtctcgaactggggatggtggttgggg

SEQ ID NO: 701377 - DNA, 172 bp, Homo sapiens
ggtgactctatagatctcgggtgcgtgttcacttatggttgttccttgcacaatctgggacatcagtgaataaccctcccatatggtccaatacagctccatattgatggcgatcatagtgtaagtcagctacaaccgttattacgtgtcgtgacttgcaaaatcctgtggt

SEQ ID NO: 701378 - DNA, 119 bp, Homo sapiens
aggggagcggagacgggggctcctgcctcccttcctggaaaggaacctggggttggaaaaggggtacccctctcagggaagacatgaaaagcagttcctgccaacacatttccatatgg

SEQ ID NO: 701379 - DNA, 892 bp, Homo sapiens
atagggaaccaaagcaaaagacaatgtagaaattttggctccgattacatgcgttccgtaatatttatccgtttaccacttctcgttgatgtggtcctgttttaagctgtggcctaaagaacctcttccccggggaaatatcgtggtgttgccactctgtgcatgtttttccccccgcccgcaaattttttgggcaggacagtaacacggttctgttaaggtacttctccgtccaagtgagtcataatcgttctgtcccccagggcttgttaccgtgttgtgtagcacagggggttcttccacccgccgggaaaggttagagagtgctatatccccccacttggcgacgggggatcccatttttcttattataggccccgtggccatccccccttattctgggccgcgctggcagcaattgtgaacagacaagtctgcgtggtaacccgtgcggattatttccaaagagtcgtggcacctatagctagtgagttctttcctaggccctgaaatataaatggaacacacatccggttggcaccaaacctagaaatttgtatatgcacaggcctggaaatcaggaaccaaatgaccactttatttgtttactgacagaaaaacatattccaccgtgttgtcactgatctataatggagtcaacgcctctgctagacaaactcaccatgctgaaaaccagacactcattgtgtgtgttcaagccatctcattctggcagacagctactcggtaattcgttcccacgtttgaacagataaatcactgttcctctactggtagagtgggacaaaattaagttcgatcaccttggcagggactgattgggccaccgacgtgacttcccaaaaacaggaaaaatttttcaacaaaaaca

SEQ ID NO: 701380 - DNA, 211 bp, Homo sapiens
acgaagggcgactccgggcggatgctattgctgcttttccagtggcacatggacagtcatgactgagactataccacacagccagctggaggccggcgtccctgcgcttggaagtgggttccctggccaccggggttgacctctctcgctagcagggcccacccagctcactccccgcgtcttccatcccctctaggagtccccttgtcgt

SEQ ID NO: 701381 - DNA, 135 bp, Homo sapiens
gacattctacgctgcactgtctgaacactgggcaggctgaggtgagaggaccttgacgccaggagtccacggctgtagtgagccatgatggcaccactgcaccccagcctgggtgacagagcaagaccgcaactc

SEQ ID NO: 701382 - DNA, 394 bp, Homo sapiens
  misc_feature (30)..(30): n is a, c, g, or t
  misc_feature (82)..(82): n is a, c, g, or t
gtgcagaaaaactagaatctgaagaagatngtgtccaggctttcccttgaggctgttgctcagtgaaaagcctcatgtaaanacctatttctctaagaccattcgcgatttagaagttgtggagggaagtgctgctagatttgactgcaagattgaaggatacccagaacccgaggttgtctggttcaaaagatgaccagtcaatcagggagtcccgccacttccagatagactacgatgaggacgggaactgctctttaattattagtgatgtttgcggggatgacgatgccaagtacaactgcaaggctgtcaacaagtcttggagaagccacctgcacagcagagctcattgtggaaacgatggaggaagggcgaagggggaggacgaaga

SEQ ID NO: 701383 - DNA, 741 bp, Homo sapiens
taagtgaaagataaagcccttaaggatcaatgattgaaaacggctgtggtgtctcagcgcctgacagtaattctccgtgtgctttggtggccagccagtacggatggtctggcaaccatgtgagcagtatatcatgaaagcacaagcgtaccaaacgggcaaggcacatctctacaacattactatgcgacgtcagccaagcaacaccatttgcaaaattaaatcccagacacccgctgcatcagagcacatgtcttcgacgaattaacggaagatgacgatgataaaacagtataggatcttgctgaggtaaaagtttgaaacagcaacgcttcggtccagggtatctattaccagacactaaagcatatggcgatagaatagacacagacatgcttcgcctcagtctgaacattgaccctgatgcaaaggtggaagaatgagcccgaagacgaccctgacagagccagcagaagacacaacagacagacacagagcaagcacgaagatgacgaccctgggatgttggggaaacaggacatgaacgaaagcacggaagacacaggaaaaacgagaaatcttagccagctggaacacacacgacttgcaacttgctcaaacttcactacctcatcacccattcagggcatcctagttgtcgcaacgacgccaattggtagacattttcaccattcatttaaataaagggccaacacatagtatcaggatgccgccaaaatc

SEQ ID NO: 701384 - DNA, 353 bp, Homo sapiens
gaaggatcacttgagccccagagattgaggttgcaggctgggcatggtggctcacgcctgtaatctcagcactttgggaggccaaggtgggcggatcacctgaggtcaggagttcgagaccagcttgggcaacatagcgagaccttacctccacaaaaaattaaaaaaattacccaggcatggtggtgcttgcctgtagtcccagctactcaggaggctgagttgggaggatcgcttgaacccaggagtccaaggctgcagtaaactatgatcacaccactgcactccagcctgggggacagtatgagacccggtctcaagaaaagaaaagaaagaaagaaattcaccattac

SEQ ID NO: 701385 - DNA, 122 bp, Homo sapiens
atacggacgatttctatcaaggaacttaattcgttcatataactgtaagattaccaggcatcttgcaggtcagcatagagatggtcactgcggatgccaccatatcggtcccgtatttcaca

SEQ ID NO: 701386 - DNA, 103 bp, Homo sapiens
tacgaatcgagctcggtccttaccagatgcactcctgctcccctaaaagagcacacacacacacacacacacacacacacacacacacacacacacggaacat

SEQ ID NO: 701387 - DNA, 153 bp, Homo sapiens
cttatgtactttctacgttagtgaaattgagattcggagctgctggagtgactggcccaaagtcacccagctagaagatagtagaaatggcttttgaactaggtctctctgactccaaaattatgccaataatcagctataatctgcctacca

SEQ ID NO: 701388 - DNA, 918 bp, Homo sapiens
ggtatgtgactgcccctctggcttcagtggactgaactaaggagtgcaatcttttattccaaataggccattcagtgtcccttctctcactgagatcggaaacaacggatggagagatctctctgagcgtagactctctcgagggggcggaaatgttccaactcatgtggaccagtgtgcattaccatctgccttaggaacggagctagtctctgtctctcaagtaagacacgaatgggggcacaccacaggagcaagaaacacaagcaagacagtaaaactaaaaaagctgagtgaagacgagttctggctaatgcagcctgaagaagtgttgatgtattagagaagcttggagaagggtctgaatggacacgtgtacttaagaggcatagtacagcaaggaatccggtcaagtttgtcgcaattaaacaagtaccctgttgaatcagatcttcagcgaaatacatcaggagaaactttccgtaatgcagcaagtgtgacatgccccaatactgtggtaaagtactatggccagtcatcttaaagaaatacagacctctggatgtatggacgtagctgtagtcgctggtctgtctctgacactaagttagctgacgaaaccaagacattatcagaagatgacattgcaccattcttaaatcttcgtttgaatggactagaatattgcctttatgagaaacatacccgagatattaaggtggaatatctctcatacagaggctgcaatggcgatttgagtggcggcgtacagtcatgcaacgcgatgtataggaccttggcggcctaggtccggaaaggttggtgtccaaaggctggtattctaaaggggaccctttaccgcgggttttcacacccacaacacgcgcttatgggacaacacacggtccaaatagtgac

SEQ ID NO: 701389 - DNA, 512 bp, Homo sapiens
tcctcttttgaaaacgaatcttgcatctgtcacccagggctaacagtgtggattgtgagtggcctcagactctcagcctcacataaaattctccaccctccgttgggctcaagttgcaagtgatctttcccaccttcagccctcccaaggaagctgagacagaccacaggccaccagtgtctggcataattttggtatttccagtagagacagggttctcggccagtgttgcccaggctgtctcttgaacctccgtggacttcaagcaatcctccgtgcctcggaccctccttgaagttgctgggatttacccggttgttcagccactgttgcctggcctaaaccagaaattcttttacccatgagatgacttggggacgttttcagtgcaaacgggcctcatttccctttggacacttacaactcttgatttggtgtgtcaggtggcttgtgttaaccctatttaactgggttactggctgtccctcttcacctgttctcttcaccctccc

SEQ ID NO: 701390 - DNA, 282 bp, Homo sapiens
  misc_feature (239)..(239): n is a, c, g, or t
agcaacattggactcgaagaggtggaccacagtggaaaggcccaaaccagcttttggacagcagcatcagcagcaacctaagtcacaagcagaacctccttcaggaaacaaagaaccattagcagacaccagtagtaaccagcagaggaattttaaacatgcaactcagctgcatttttccatgtgctggcagactgtaacaggatgtcacaggcgggctcagtacaaatagagaatcntaagctgactcctcaacagagagcctacctaaaagctgaagtc

SEQ ID NO: 701391 - DNA, 250 bp, Homo sapiens
gtaacaaagaaaagaaggaacaattgtcgtgccaaaaagggccgcggcacgttaagcctatttggtgcactaactgtgccccatgcgtgcccaaggacaaggcattaagaaattcgtaattcgaaacatagtgagggcgcagcagtaagggacatttcttaagcgagcgtcttcgatgctatgtgcttccaagctgtatgtaaagctacattactgtgtgagttgtgcaattaacagcaaagtagtagga

SEQ ID NO: 701392 - DNA, 119 bp, Homo sapiens
gacttcggcacgaggcgtacttcaaagcttcaggcttactcacggcatccagcagagacttgaaagtcaacgttcctgacttgctatgtgtcttgggctcatccatccgacattaaggt

SEQ ID NO: 701393 - DNA, 215 bp, Homo sapiens
cacagacctggtgtgggggtagagggaggctccaaagccaggagacggaacccaaacttaggtagtatcagccagctatattcggtggctggaagccatgtcctcggctgtcattctagcaaataagtctggaggaatattcccgacagatgacatttttgctcattgtaacttcgtggaactagggtctatggagaacttcgtaagaactaggg

SEQ ID NO: 701394 - DNA, 488 bp, Homo sapiens
taacttgccacacaagcgataacaccatgtccacagagacctgaaactggcaccgatgttgtaaccaccaactatagtgtgtgtgaccaacagcgcggaaaagtctggatcccaggctatgatgaggggagtcgacctaagccaaagtgaaccgtattctcggacactgaagcgttgatcagggctgagccttagaatcaaggtgctttgaagcctgcccccccatgcctggatgccaaacgtatgataggacgcagatatggtgatgctgcagaccagcctgatatgacacattctcccgacacaggggagaatgacgctgtgagctcccagggtccagtagaattcagggtcgagacctgcagctggtctccacatgaggtgttgaaaatggttctgacaacgatcatggaaatcgctcaagcctacgtttggaagactgctaccagtagtgtggtcaacacacctgcttactttggtgactatga

SEQ ID NO: 701395 - DNA, 189 bp, Homo sapiens
gcgcgtcctgctcactatgtctataataggagctgtattgccatcataggaggtcattcactgatttcccctattctcaggctacaccctagaccaaacctacgccgatgaatatgatagtgaaatggattttggcgtaaatctaactttgcttcccacaagcactttctcagaccatctctccggcgc

SEQ ID NO: 701396 - DNA, 397 bp, Homo sapiens
  misc_feature (16)..(16): n is a, c, g, or t
  misc_feature (347)..(347): n is a, c, g, or t
  misc_feature (382)..(382): n is a, c, g, or t
  misc_feature (384)..(385): n is a, c, g, or t
cccgtaaggtttaaantgtgttgaaaaacaccccgcccctctgacccaagcatttccaacccccgggcatacaggcaaaagaaatgcatcccacgtgttcatcaaaagatgtaacctgtgcccgggtgaggtggttcatgcctgtaatcccagcacatcgggaggccaaggagggaggattgcttgagcccagaagttcgagagcagcctgggcaacagggcaaaacctcgtctctactaaaaagtagccaggcatgatggtatatgcctgtggtcccagctactcaggaggccaaggcatgcagattgattgaacccggaaggtggaggctgcagtgaattgtganctcgccactgcactccagcctgggtgacagagcantnntttgtctcaatt

SEQ ID NO: 701397 - DNA, 315 bp, Homo sapiens
cagtttctggggcctggcctcatgctgtgctcagctgggttgagcagctggccaggcaagtgcagtgcagtggtgctttgatcatacacagcaaacaggaatgggcggttcagtgatcactccaagcactcaggcttgtacagcatgttgggtagactctgtgggctctctctcatccgctttatgctcaaaaacccctgctgtacagcacctcccccaacctgatgcggtcattgctcaatttttgcaggttcagctcggttgtgcacaatggcgggcagctcagcctgggcgagcaggtcctgccggtcataa

SEQ ID NO: 701398 - DNA, 963 bp, Homo sapiens
cattttcagaggcccatttcattagatcaggaaatggggcttctgtcgagggttttgaaatggttaacttcaaagaagagggctttgccttgatatctcttgctgctctcaaagcagagatatcgatgcaatggcgcttccacgaagaatgtgctaagagactgttgaatctgcgtaaacgattcagatgttgtgcgggcctgtatattctggaagaccgaatcgcttcaagagcagtgggaaacatcgcagctggccctttcgaattcgctcgtgtgagcgagccaggcctaactccttctggcagccctatattcaaaccctccccagtgaatatgacagctcctgctctactttgaaagaagatgaagtgcggtatcttcagtccatcactagagctatacatgatgtcttcagccagatatagaaataacgcagctacgacagcacgcctacttctataaagtcatccagacccatcctcatgccaacaaactaccctggaaggattcttctcacttacgaggactacaggtgggcagtctcttctgtcatgacgaggcaacacaaatacgcacagaggatggcttcccgcgtgaccctggctctgatacctttatgggatatgtgtaaccacagcaaggctgatcactactggttacacctggaagatgaccgctgtgacagtgtggctctgcggactgcgggctggagacgatcgacatatggatgggatcgatcaagccagaatcgcgaccccccggctcgcttgacaatactcagcgacagaggaataagccgcgggctaagcaagcacacccatacgccggctgacgcgcagatccaccagcctgctgattccacccacgcacgctgcaccaacggtacacagacgcggcccccacccgcccacccagacccccccaccacaaaaacgaccccccagagtcgctctagactcac

SEQ ID NO: 701399 - DNA, 257 bp, Homo sapiens
  misc_feature (231)..(231): n is a, c, g, or t
agggtgttgctgagggtgtctagaggatccctacgctggtcgcaagtccaggagagcacattggagcggctatctcaaccaagtcgtttgtctagatgacacaacagtgaagtttgagatctgggacacagctgggcaaggagcgatatcacaggcttagccccccatgtacctacagggagtgcccaaagctgcaaatcgtggtttacgaacattactaagtcaggaaancctttgcgccgagcaagagacactgg

SEQ ID NO: 701400 - DNA, 486 bp, Homo sapiens
atattatattatatatattatttgtatgaataatgaaaataaaacacacctcgtggcacataaaaaaaaaaaaaaaacaaaaaaaaaaaaaaaaaaaaaaaaaaaaaaaaaaaaaaaaaaaaataaaaaaacaaaaaatataaaagaaaaaaaaaaaaatttaacatttctcatcccccctcccctcggaaaaatcaaattttaaataccctaatctaactaccaacaaactttgttaaatttctaatattccctaatcttcacctaattcaaaattaaccacctctttctttaaaaaatttttaatatggaaaatccttcctcaacaaaacaaattcgcctacataaaaattctctttcctcaaatgtcaataatatatattaacaccccaaaaatataaattttaaaaaataccctatctttttatcaaaagaaattttaattccatattacttatcaaaaacacctttaaaatattctcaaaa

SEQ ID NO: 701401 - DNA, 1133 bp, Homo sapiens
  misc_feature (104)..(104): n is a, c, g, or t
  misc_feature (108)..(108): n is a, c, g, or t
  misc_feature (124)..(124): n is a, c, g, or t
  misc_feature (760)..(760): n is a, c, g, or t
  misc_feature (816)..(816): n is a, c, g, or t
  misc_feature (822)..(822): n is a, c, g, or t
  misc_feature (849)..(849): n is a, c, g, or t
  misc_feature (876)..(876): n is a, c, g, or t
  misc_feature (907)..(907): n is a, c, g, or t
  misc_feature (913)..(914): n is a, c, g, or t
  misc_feature (923)..(924): n is a, c, g, or t
  misc_feature (930)..(930): n is a, c, g, or t
  misc_feature (933)..(933): n is a, c, g, or t
  misc_feature (955)..(955): n is a, c, g, or t
  misc_feature (957)..(959): n is a, c, g, or t
  misc_feature (985)..(985): n is a, c, g, or t
  misc_feature (989)..(989): n is a, c, g, or t
agcccctcatacaataaatatatacgtagcattaaccatctcacttctaggaatactagtatatcgttgcacaacacttcagtgatctccctactatgctaganggantaatactatcgctgtncatgtatagctactctcataaccctacaacaccactccctcttagccaatattgtgcctattgccatactagtctttgccgcctgcgagacacggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaaatcaacaacaacctatttagctgttccccaaccttttcctccgaccccctaacaacccccctcctaatactaactacctgactcctacccctcacaatcatggcaagccaacgccacttatccagtgaaccaactatcatcgaaaataaactctacctctctataactaatctccctacaaatctccttaattataacattcacagccacagaactaatcatatttaatatcttcttcgaaaccacacttatccccagcacttggctaatcagtcacccgatgaggcaagcagtccagaacgcctgaacgcgaggcagcatacttcctattctanaccctagtaggctcccttcccctagtcatcgcactaatttagcactcacaaatacnctaggnctcacgtaaacgattctagctactcantctcactgcccaagaagctatcaagangtcctgagccaaagaacttagtatgactagnttacannaatagcttnnatagtnaangatacctctttacggactccantnnntgactccctaaagcccatgtcgaagncccnatcgctgggtcaatagtacttgccaagagtactcttgaaactaggcggttatggtataatagcgctcaaacgcattctcaaagcccttgagaaaacatagctaccccttgctgtactaacttatgaagcataatataaaagtcc

SEQ ID NO: 701402 - DNA, 1417 bp, Homo sapiens
  misc_feature (1417)..(1417): n is a, c, g, or t
tgagagtagctttgaggagcctcatgggggagctggggggtgcaagggacctgagctgagaggtactcatcgcttcaatgccccctcccttgctgaaggcaggacggagtgggcgcagaagtcgcctgataccgatctctgtgtcaataaccgcgattcttagtctgatgacaactagtcccggcagatcactcctcccaatacatacctcccattgaccttgtagaatgcatcccgagggaggtgtacgagggagggggctcccaggaagggcactcaggagacggtttacagaagacctccctccagcagggtctccttgctgagcgttccctttgtccactttacttacgtttcttatagggtcaccgtgctcataagtgccagctcgctactaccctaggggcttaccccacgtaggagttgtaccaaggctgtgcttacgaggccagttagactcccttggggcttcccaagggcatgtaggactaggggcgcaaaaccaaccacgaggttcgcttgtcccggaggagggctggaaaggagcaacgtggcaggttacgcaggactctggatatcacttgctgtctgctatggactctactgtaaccccgtttgctccttcaccagctgggtactttcgacagtatggagtttatggtaagctaattgtactgttcacccctatatttctcgctggttctcaatggagcctgcctcaatggtacgcaacaatggtaaaactccacttatgtggtctttctcatgttatatgttactcctcgagttagttccctctcatccatagtcccaacttcctagtacgccttattatacgtcgtgcttatttaaagccatttgcagtatatagagtaattaacttcaacatgggttcccggtttaagggttataccgggtttaacaaaacaaaaaagggggggggcgggcaatacgggagaaggtaccgcccctgcagggaggggtggcccccaacggtatggagggcgcggaaacacccacagatgctgttgtgcaacagaagtggtggggtcccccaaacaagggagagaggccccgatatataaaataaacgcccaagggagctaatgaggcccaggagcggaaatatacaccacggcctgtggaaacctggggaacaaaagtgcagatgggacaaggaggacgcacgtggggagggaaaggcaaccctgttagaaatcagtagagccgtggtgtagcacaatagagtggggggcacacatatcttgcaggaaaatttatcaagcgtctaatgtggaaagcatttaaaggttataaagagaggaaataaggggggagaaaaagggtgaaaagacagggggatagaaaaattgggttacaggggatggttttgggaaagtttatcaagcagagaagn

SEQ ID NO: 701403 - DNA, 741 bp, Homo sapiens
ggctacatggcctcctgtgccgtcctgtgccccgattcccccagttccttctgtgccaccatgagcccactgccactccatgtcgggcatgccgaccttgaatccgccacctgtggcacctctacgtgcgtggcaatgaatggctctggagcacactatgaattcgaaacgataaatctgaatcctatgtgtcttgggtccgttgaaatcctgttaatcgcacgtagtccagatgaacgtctcagagcagtggtgaagccactccccatcaaccctgatgatctgtgatgtcagggtgcatggaatgcccttttgctgcaatggaataatgatgtgcagagattaggtttcatgggctccgcgtggatgcgagtgcgatttgtggaaagatcatgtaggtcgaaataatggagaatggaataggcagccggtctcctcaggcccgaacaacataagacgggaaggcacctgtaacgcaggcacagagtgctagccgggatccacggcgcccactgctggacagcttcggaccccgtgacgccacactgaccaccgaaccacgtcgccgtgaagctaagctccgagcggccaatagtacaagtccagcaaacgccaaacaaaaggggcgagaacgcatctcgggacggaaagctcgctcccccacactgcccatcgacgcacactaaacccacaaggtccaaaagatccggccgccagcggggagcacacacaaaagaatcg

SEQ ID NO: 701404 - DNA, 165 bp, Homo sapiens
aagcccagcgacacaaaagggggtggggcgggtttatggggaaaaagggagcaaggtcaaaggagggcatgggttggcagggtgggcgtttggggccctttatgctggcttttccccccaaaggacacaggcagcttccaaaaaatatttatttttttcccggga

SEQ ID NO: 701405 - DNA, 981 bp, Homo sapiens
  misc_feature (608)..(608): n is a, c, g, or t
  misc_feature (664)..(664): n is a, c, g, or t
  misc_feature (670)..(670): n is a, c, g, or t
  misc_feature (697)..(697): n is a, c, g, or t
  misc_feature (724)..(724): n is a, c, g, or t
  misc_feature (755)..(755): n is a, c, g, or t
  misc_feature (761)..(762): n is a, c, g, or t
  misc_feature (771)..(772): n is a, c, g, or t
  misc_feature (778)..(778): n is a, c, g, or t
  misc_feature (781)..(781): n is a, c, g, or t
  misc_feature (803)..(803): n is a, c, g, or t
  misc_feature (805)..(807): n is a, c, g, or t
  misc_feature (833)..(833): n is a, c, g, or t
  misc_feature (837)..(837): n is a, c, g, or t
atggccggtccactgttgagcagtattgtgctattgcatactagtctttgccgcctgcgagacacggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaaatcaacaacaacctatttagctgttccccaaccttttcctccgaccccctaacaacccccctcctaatactaactacctgactcctacccctcacaatcatggcaagccaacgccacttatccagtgaaccaactatcatcgaaaataaactctacctctctataactaatctccctacaaatctccttaattataacattcacagccacagaactaatcatatttaatatcttcttcgaaaccacacttatccccagcacttggctaatcagtcacccgatgaggcaagcagtccagaacgcctgaacgcgaggcagcatacttcctattctanaccctagtaggctcccttcccctagtcatcgcactaatttagcactcacaaatacnctaggnctcacgtaaacgattctagctactcantctcactgcccaagaagctatcaagangtcctgagccaaagaacttagtatgactagnttacannaatagcttnnatagtnaangatacctctttacggactccantnnntgactccctaaagcccatgtcgaagncccnatcgctgggtcaatagtacttgccaagagtactcttgaaactaggcggttatggtataatagcgctcaaacgcattctcaaagcccttgagaaaacatagctaccccttgctgtactaacttatgaagcataatataaaagtcc

SEQ ID NO: 701406 - DNA, 471 bp, Homo sapiens
tctgccggatgaggccggagctgccccgccaaagctgaccgacctgcggctcctctacatacggcttctatgggctactagctccggcctgattagataacctgatccgtcggaggccgatcgcgacggtggtttgcatcgccagcttctatatataacgggctttatttttggctggatataatcttgtaaaaggtgaagactacctgtatgctgtgagggaccgtgaaatgttggcgcatatgaaattacatccagagaattttcctgaggaagataagaaaacatatggtgaaatttttgaaaaattccatccaataacgttgaagtcttcaaaatgcttgctccagtttcactgatacctgcggtttctgaatttgatggaacatgtttcttatgacagttgaagcttatgctacactgtattgttgaccccttgtaattaaaatacgcacgttacgccgaatgcgg

SEQ ID NO: 701407 - DNA, 944 bp, Homo sapiens
  misc_feature (571)..(571): n is a, c, g, or t
  misc_feature (627)..(627): n is a, c, g, or t
  misc_feature (633)..(633): n is a, c, g, or t
  misc_feature (660)..(660): n is a, c, g, or t
  misc_feature (687)..(687): n is a, c, g, or t
  misc_feature (718)..(718): n is a, c, g, or t
  misc_feature (724)..(725): n is a, c, g, or t
  misc_feature (734)..(735): n is a, c, g, or t
  misc_feature (741)..(741): n is a, c, g, or t
  misc_feature (744)..(744): n is a, c, g, or t
  misc_feature (766)..(766): n is a, c, g, or t
  misc_feature (768)..(770): n is a, c, g, or t
  misc_feature (796)..(796): n is a, c, g, or t
  misc_feature (800)..(800): n is a, c, g, or t
cagaaggtgcattttaccttttgacaaggagtagcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaaatcaacaacaacctatttagctgttccccaaccttttcctccgaccccctaacaacccccctcctaatactaactacctgactcctacccctcacaatcatggcaagccaacgccacttatccagtgaaccaactatcatcgaaaataaactctacctctctataactaatctccctacaaatctccttaattataacattcacagccacagaactaatcatatttaatatcttcttcgaaaccacacttatccccagcacttggctaatcagtcacccgatgaggcaagcagtccagaacgcctgaacgcgaggcagcatacttcctattctanaccctagtaggctcccttcccctagtcatcgcactaatttagcactcacaaatacnctaggnctcacgtaaacgattctagctactcantctcactgcccaagaagctatcaagangtcctgagccaaagaacttagtatgactagnttacannaatagcttnnatagtnaangatacctctttacggactccantnnntgactccctaaagcccatgtcgaagncccnatcgctgggtcaatagtacttgccaagagtactcttgaaactaggcggttatggtataatagcgctcaaacgcattctcaaagcccttgagaaaacatagctaccccttgctgtactaacttatgaagcataatataaaagtcc

SEQ ID NO: 701408 - DNA, 446 bp, Homo sapiens
  misc_feature (104)..(104): n is a, c, g, or t
  misc_feature (108)..(108): n is a, c, g, or t
  misc_feature (124)..(124): n is a, c, g, or t
  misc_feature (412)..(412): n is a, c, g, or t
agcccctcatacaataaatatatacgtagcattaaccatctcacttctaggaatactagtatatcgttgcacaacacttcagtgatctccctactatgctaganggantaatactatcgctgtncatgtatagctactctcataaccctacaacaccactccctcttagccaatattgtgcctattgccatactagtctttgccgcctgcgagacacggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccactcctcacacgctgtcagtccaaatataccncccattggctccatgctaatttatgcgacacttc

SEQ ID NO: 701409 - DNA, 317 bp, Homo sapiens
tgatcaatggggggagggcagctgtgcctaatttaggattgatttattctaacctctcttactaaataaatgcttgtattcagagtctgtttggaatttaacccaatgcttagaactccttaaatatacagaaatatattttaggggtaattgattcatggaactctcctactttggagcacaattgtattataattgtccggaaactggccagataatgtaggaacgcacaagttgttgaggaagcccttttgtttcctgatagttacatgtaattccagcagtatttgggaaataatttgctaaggtgttaggat

SEQ ID NO: 701410 - DNA, 266 bp, Homo sapiens
agtgaattgaggtgactagagatatcatgctaccttgtggcagccatgtgggcacatcaccacgtcttagtctgcaggacactgaggcagaaagcaccgtcccattcacaccttggtaactgaactctaacatctcagcctgagaatcctggattttttgcttatttgtttttaaactaacttttcttttcctttcctttcctttccttttcctttcctttcctttcctttccttttcctttccttttccttttccttttcctttt

SEQ ID NO: 701411 - DNA, 650 bp, Homo sapiens
  misc_feature (90)..(90): n is a, c, g, or t
  misc_feature (96)..(96): n is a, c, g, or t
taagttggggtgatgaggaatagtgtaaggagtatgggggtaattatggggggccataaaaatgattaaggatcactagttataagaaantcaggnttcgctccttataagtggtgggtgtagtgggttatatattgtggtttggagggtatagttgtgattagctcatgtggtgggggtgggtgactatagctcggctgtgttagatgagaatattgggagggtggggactcacataggagggggaaattagaagtgactcagtacgtggcgggcgggtataggccataggattgtggctgggggcaagtgaatgtgaaggcgaacagaattttctgcgtctacacttgtggggtctcctcagggggttgggttatacatttttatattcttaatggggccttgggatgagggaggctagggtggatacgttcggtggttcacatatttttacagtagggggtgatagaggaatacgtgtaaggagtatgggggaccccgagaggcgctgttgacaccgccgccacaaccgccgccacaccgccgatgccctcagtcatgccgaagcacgagttctctgtggacatgacctgtggaggctggctgaagctgtctccccggggccccaaaaagcttggaggagtaagtag

SEQ ID NO: 701412 - DNA, 475 bp, Homo sapiens
  misc_feature (21)..(21): n is a, c, g, or t
acatcacttcaacacctttantggttgaactcatagggctatggggatcacggcatgtctaataccaaaagaactttgagaggcagtcccttgatggcaaggtacttccttagggaacaaagcattgatggaaccaatcaagataaagggttctcgattgtccagactttcttttgtaaaatgaaaagactggcagctggtgtttatcttttccttccaaggctcaggggttagcagctttatagataagggcagtcctaatcataaacccaaactgcatttgcacacaatggtacaattctatccttctatcccttcttgccttaaatcctggggcttgcttcattactaattaatgttccttgtggcattttttccagaataaggcccttttgtccacattaaaaacctattcagggccaggcgcggtggctcacacctgtaatccccagcactttgggaggtccagacgggc

SEQ ID NO: 701413 - DNA, 764 bp, Homo sapiens
ctgccccaaccctctcccccagctacactgacctcttctgagtgggtggaaggggggtaggaggaggaagaaaaacaacaacaaaaaatcgatcttagatatgaaattatgggcatgggatggtggtagaggcaagagtgatgatgaagattgggagatgacgtggcaccctacgttgctactaggacttccttctccatactaggacatagggggcaggagggagctaaacctaggaccaggatatctccctacctgtaatatacccaacctacatacatagagcctgttaagccctaccagcaccctggacgaggttggagtaggggggtagaggtagagggctataccctgagtaggcatgccacatacctagtgaggcagggtgtagagaccgagagactacccaatataaacctacagtacaacaaaactaggttgataggtactgagtgggaaggaggtggtagatagtagaggggtagggaggagctatagtagtacagcagcagagaggagaggagagaggaggtaataaaaatctatatatacaatgggaatatgtagcaataagtctaagtagggagcatagggggagccgggttggaggtgaggaaaccataacctactacagagaaaacaagaagaagagaaatgtaaaagatacaaataagagactacatatatctataatcaatattacacaaacaaaaaccaaaccagtaaacaaaggaagagaaaagaaacggacacagaaacacaag

SEQ ID NO: 701414 - DNA, 452 bp, Homo sapiens
cgacacgtactggctgcagttacgtattctctttttctttttcttttacttttgagacggggtctcactgtgtcgcccaggctggagtacagtgtcgtgaactgggttgaacctcccaggtgccagctgttctccagcctcagcctcctgagaagctggaactacaggtgcgtgccaccatgcccggctaattttggtattttttagtagagacagggcttcaccgtattggccaggctggtctcgaactcctgatctgcccttcctgaccttgtgatctgcctgcctcggcctcctgagttcaagccgattctcctgcctcagcctcccaagtagctgggattataggcgcatgccacacgcctggctgattttggtatttgtagtagagatggggtttcaccgtgtaggccaggctcgtctcgaactcctgacctcaggtgatccaccca

SEQ ID NO: 701415 - DNA, 786 bp, Homo sapiens
accggcttagaggaccgggcaatgggtaattggaggctggatgccgctggcactgttggttcggctcgactgtcaactggatggtgaccaggagccgagatgggagtgcggcgggagcggcaccaaccccttcctcaggtcgttgcaccactgcgtgaactccatagcagacaaagtcctgtgaaaagcactcggttaccatcacttgtctctaacacctgtgtgccagagtgattccttacaaggaccttgccgtctcgaggtgcttagcgcatggactgtgagggatgggccgcagcactcagtcaggggcgcagagggacgcatgccgtcccttgtctagtactacttcgtagagtgttgggatcctatgagagagcctggagttaggacgtcggtctagctggtgtccctcgcgactccgagtagagagactgggccttgcgtgttccttggtcatggatgctttgtatagcttcgctccgggtcctgggctgtactcgtttcgtgacacacttgtcccaattcgatagggctggttcatcccacagcttcctggcatagttctgcatcctctgaacgacaggaaggaggctgagattagtgccaaagaagtgggggctgatgggccgtgggaagactgtgtggtggatgaggggtgggcaggtaagaggtggacaacctcgacgactcgatgatgtgatcgatggttgtgcatatggtggaagggggtggtgtgggcatggcagaggatcgagaaggctccgaggaggaggggagctggtg

SEQ ID NO: 701416 - DNA, 150 bp, Homo sapiens
tagaggatccccagtcacaggatagtttatcataagaatgtgagctctaacccatgtcataaggcagttgggattaaaaaggtcagcagctagttttttttttatataaagttttatctagtagacgctggagtctcactattgttgcca

SEQ ID NO: 701417 - DNA, 926 bp, Homo sapiens
gctcgcttgcaacatatcaccatatgattcggctgttcgatcgacctggcagagcctgtaaagagatcagtccgttcatcatttatgatataatgaagtgaattagtgggaaagagattttctccagaaggaccctggatgatgatatgttgtggtcatgtcagccatgagcatatggtcatctctcagagatctagaactgtgcctaccaagtacgtgggcttttaaaagaccggagacgactggaaattcattgggacctgatcaagcatcgtaatatctattgattccaagttcttcgagtttcgactttcgtctaatggatacacatacttgatgtgaccttgaatgtggtatgaggaccggataccgttcagcctactttccccgctcccaaacaatgattgcatcgttctgccaagcttgggatgtgggctatcggctagaagtgagttcctaaaatgtggcaagatcagcaaggaatatggtcatactttccgcagtgagctgagagaagagatctgatgctcatggccaaggacaagcaccctacagaaggctcacggggctcttctgctggacggtggctgctgatgtcacaatctgcgtattagaagccacccatcgcacagaatggtcgggatgggccggcccactcctcaacgttagatctctttaaggaggggaacctcgaccggaacttgcggctccagccgcacatgacaaaccgaggagaaagcacatgctagtcacgtatataccccgacagagtaagcaagcacactatgctcacagatgctacacgagttctgttgccgctgctgagcatctcttttcgtgctgcccgcaacactacgaaaagataacaacaacataacaggcaccaacaagaaaagatcacaaagtaagcacaagcacaaaaacaa

SEQ ID NO: 701418 - DNA, 360 bp, Homo sapiens
aggtccattctcgtggaaggcgcagtgaggatttccatatcagaatcacgatgtaccaggaatcatgtattgtcttcagtcatagagtctctcaacttcatagacctgaatggtaccagttggttgaatataggaagctgctaaaaacacgatctgagacttcttggtaggcaccactgtattcctgggattcagtttggtcattacatctcccatagtttcaataccaagtgttcggggacatacatcaagcattaccgggtcccctgtatcttcctcaccagcaaagcagtcgcagtgctggaacaaggtatgcatacgctatcggctttctctgggtttatgcccggatgatctcct

SEQ ID NO: 701419 - DNA, 172 bp, Homo sapiens
gtcgactatacatgcatacacatctctctctatctctctctctctctctctctctctctcacacacacacacacacacacacacaccatgcaccacagacatacacatgctcacacacgctacatacatatgcctgtccatcacacacgcccacacacacacacacacacac

SEQ ID NO: 701420 - DNA, 817 bp, Homo sapiens
  misc_feature (817)..(817): n is a, c, g, or t
aaggctagtacgaggctggctggtagtcggccgagggagagcagagagagaactagtctcgagttttttttctttttctttttaagtagagagggggtttcaccatgtcagccaggagggtctcgatcttctgacctgtgggaatcgggccacctcagccccccaaaaggcggggataacgggggtgagccaccacacccactcctcgccccagtttattaaataccttctccctcttacaagctcctaaccgttgcgaggctaatcccctcccgtggagagaaagaggatcccaagtgctccgatgagcataaaaaatccgggctccttgaaatgcacgtggacccattctccagctctcgtggggtggtagaggccgtgaggccataattattatctcagcacctctccatctccttctcagtctcaaaacagattgagggacaatatacaggcagcttggtgccctcaggctgccaggagcaaaggggccattcaccagcgtgggccacagcctggggggagccatccaaggggggctccggctaaagccctagggggggctcctcccgcagtcggggagaacagatccgggcctcccacccagtctcgcgggctgccagttggagaacctcaacaaattacagagtggtttttggcaactacaacagatcgcggctctctgggagcagggtggtaacagactttctaaatccggagagtggaaaatcccctctagcatggggtcgcggctggggaacacgggcgtcacaacgggcccaaaccgcccctcccgaattgtggggcaagggggggn

SEQ ID NO: 701421 - DNA, 394 bp, Homo sapiens
  misc_feature (9)..(9): n is a, c, g, or t
  misc_feature (70)..(70): n is a, c, g, or t
  misc_feature (89)..(89): n is a, c, g, or t
  misc_feature (126)..(127): n is a, c, g, or t
  misc_feature (146)..(146): n is a, c, g, or t
  misc_feature (185)..(185): n is a, c, g, or t
  misc_feature (187)..(187): n is a, c, g, or t
  misc_feature (284)..(284): n is a, c, g, or t
  misc_feature (383)..(384): n is a, c, g, or t
cccaagctnggagcacatcttgttcacctgctgccacaatcggcaccctggtcctgcccccgacaagganacggctgctctccctggantgacaactggagggagatcttagatagcaaagcgcgnnactgcgcagcgggaatgancggggatccgcgggcagcagctggagctaaaggaagggncnagccacaggggccaccgcagagccgagtcggggcggcatcgtgcatggcctctggccccgtggagtggagcaggcagataccgttaagcgctgtgcntaacggcccagcccagccacccggtacctcccgagaggctgtccctggaccctggctggcatggaaatacagtgggaaaaccagtcgggacctttaatnncagaccttgg

SEQ ID NO: 701422 - DNA, 913 bp, Homo sapiens
  misc_feature (316)..(316): n is a, c, g, or t
aaggctggtactggtctcggaatgtaatggatgggtgcggcagcactgccaggtgaagaggtgtgatcctgacccggggaaggtctgctgggcagggcagagttgggaaagctgcatgccccctgcaggcccacgcagacccattctcctcctttctcccacgtcctatctgcctctcgctggagtgccaggcctgtgcagcaatcagaagacaggaggaactaggagcctcatttggcctggccctggaggcgccggcctcgggcttaaataggagctccgggctctggctgggaccctgaccgctgccggccgngctcccgctgctcctgccgggtgatggaaaaccccagccctggcctgccgcctgggcaaggccctctgctgctctcctcctggccactctcggcgccgccggccagcctcttgggggagaatccatctgttccgccagagccccggccaaatacagcatcaccttcacggtgcaagtggagccagacggccttccccaagcagtaccccctgttcctgcccccctgctgcagtggtcttctgctagctgggggccgccgcatagctcctgactacagcatgtggatggaagaaccaggtacgtcagtaacgtggctgcgcgactttgcgtgatgtgctgtgccgatggcctgggcggctgatgaagtgagatcgaggcggcgggggatggcgcttgcagagctgtgcacgctgggtgttttcgggctgccctgcctgtccccagctgtgcaccggggcagacgtctggctggacgctggaggtgcagcgcaggcactctgctggtctccgtttgtggttgcgcatcgttgcccagcccccggacttggttctgtgggcggttggacaggcctggacccttgtgcgaccgggggaccg

SEQ ID NO: 701423 - DNA, 362 bp, Homo sapiens
ccgtctcaaaaaaaaaaaaaaaaaaaaaaaaaaaaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaagggtatatggcatagggctgagagttgctccagatgagtcagtgagtggtgaatgatgtgggcc

SEQ ID NO: 701424 - DNA, 729 bp, Homo sapiens
ctcgcctctccattgtgccactgaagtgagtaatcaatagctgcctactctgtatgtccagcacggagaatgactgacaagtgcctcctaaagatagcagacatgagatatgaccatcgtagactgtaagattgcgtgaatgactgagagccacacctgctttgtatgtagtttcactgtttctaatagaggggcatcgtgagagtctgccagaccatgcaaatttagatgcttatgtctgtgaaacatgagatcctgatgcactggtggaagactcaaggcaatgactgctcacgatgtgtagagacggatgatgctctgcagcttctgtagagactatatctgcacctgcacaatgattattcctcaaacctccgaagtctggtgcatacataggctagagatggcgctcacagattcctttgccactgtagagagattgttgcattgtactgatgctaaacataagtcatacctgctatatgccatagccgcttattccgatcgctagtgccaatgtgttcacatggatatacaatgtgttgacaatcagtacgtatgtgtaaacacctaatgacgaatctccatacagttgctgatgaagaacatattgtgtcaagaacatgaccactcttgtgtaccatgcgatcttgttctgacatagctttgacgaattggcgtataggctgctgggccactgcattcactagctgatgctgtggatgcact

SEQ ID NO: 701425 - DNA, 409 bp, Homo sapiens
atgcaacgtatgctgtactcgagataaactcctgactgcactattgagacgcactgaagcatctctcttccaatcaccttcatagttcattgcttcccatgaaagtgtcttggcctcagatggatggatgtgtttggacgagtgtctttaaggagtagtcctgaacaggtagttattgggtgtcccatgtaacattttttgaagataaaaccactaatagctagtcataatttactgttgactgcattctcattaaaatgaaggtaaaggctcaggaatcatattgatgttctgattttcaaattggagtccaagtctatgtttatcattttactatgttcctgatgttctttgttatttaattaatgggagcgaataaaaccagaagagcttgggaagattgctcagt

SEQ ID NO: 701426 - DNA, 194 bp, Homo sapiens
  misc_feature (79)..(81): n is a, c, g, or t
gcacaagctccaaagttcaagacaaggtagcccttagagaggaaaaccatgacaggcaaatgcatttctctggagttgnnngagttttcgtttaggattagttgagttccagctgggtgaaggagtattaaccaagtttgggatgatagggcgagaccctcacagttgagtattagagagcttgtcttcacagg

SEQ ID NO: 701427 - DNA, 1397 bp, Homo sapiens
ccggtgtggtgggaaggtcgagggatggggagcaaatagatgtgtggtgtaaataagaaggagttctagatggtgttggtattacagcgttgtgttgtgtttttagtttggatgacgagaggtaggcgtttgtgtagaaagtggtttctctgtgggggtggttaaattaaagagatgtgctcagcggggggggggagtgtggttctcatagcgagtactgttcgcaggagtgtagatacatcattggggcgggttgatcatctactggattgtatgtattttgggcaacctagagttagtcatacgtttgtactgcgaatagtatagggttgattttgtctgtgggaggtatcctcaactggggggggtgagctctctgtcctgcagctaagtagatcgtcctgcttctaccttgcacacaaggacttgggtggggggcccccaccgagagtattccgacagagttgtctgcaccaaaaaaggcagctcactgtctggtaggtagaatagtaagagccacatgttgtgcgccgaatttctagcacgaacgccccaactgtgggacgtcaactactcagtgagggaggaagcacatccggcggccgggtgagaaagagttgttttgctccggggagatgtttttgcgggcgcacaaggtgtgcactacagtgggagcgtaacacgagggtcacaagtgtgtttagatagcacagcgcccgcgtgggacggacacacgccggaataccgcttggggaccttggtgacagagaccgaccgctggtgaaacacacaggagtacacagagagggtgtctcacaaaagatgtccacggtgcgatcgctaggaaggaaacccttgggggggacacagccccccacgggctccacacacgaagggagaggagacatgacagcgcagcgagatgaccgaatgttccctaggcgatccatttcacaggggcccaccgacaacgtggtgagctgggtgagcagaacaggggaaccgggcacaaccgacccgggagagcaacaatatagccggcacggggagagcacctgggtgcaacaacacaaggcatggcatggctttggtctcagtgttattctaccgcagcgccacacacagcgcctcctacagtccaacgcggcgagcggtctcaggtgtccggggcacaggggacactcaccacaaccccacctgggcgcggcgccaccagtttggagcaccagcgacagtctctgttctataaaacaagaaatctggggactagccatgaaagtggttttggaacacgagacctctatcaaattgatgagggcgacccatcacaggacattttctccctcccctcctttgaattgtaaatggcacattaagaccttgtcccggcatttcca

SEQ ID NO: 701428 - DNA, 291 bp, Homo sapiens
ctgtaggatcccgaatcattcgtgtctttcgtacagtgcagaaatttgatgtacatggtacgaccgacctggtattactccgtgtctgaactctagatcacgtacgacttttatcgttgaacaaacaaacctttaatagcggctgcaccatcgggatgtcctgatccaacatcgaggtcgtgactcgtatagacccttgcggactctagaataggattgcgctgttatccctagggtaacttgttccgttggtcaagttattggatcaattgagtaggacacgaatgttca

SEQ ID NO: 701429 - DNA, 541 bp, Homo sapiens
gcgacttttctctttgtatggtggagtataatcttaaatcatttggaatcagttgagttgaccatgatgaaatttttccgaatgtgaatatgtaggttgatgagttacagaaaaatatatctgtgtgtaacaaacttatcaatgactttgacgtttgtaagtttggtttctatcatgaatttagtcattaaactttagttctatcatttggtactatcattaatgttttatatacactgatacttaaaagcttgtgtggacaaaaattaatctgtataattttgtatcatctctccctggatatgtgttctgtatctaagcgacttttgtgagagattactcgtgcaatgagatcgaccaaataaatcttaattaaatctttgcagatacatacttatgtgaactttgaacaaatgagtgaaactctgtgttctaagtaggctgttataatcatttccggatcacttgcagaggacttgctatttgccaggtgcgttatgtatcattaaattttactcatagttcatatgaatgtgccaag

SEQ ID NO: 701430 - DNA, 573 bp, Homo sapiens
gcgcagacacatctgccgtctgcctgactcctgcaggtgcccagtaccggggcacgcacaacaggtcacatacagcaacaaggacttccaagaggaaatggatatagaaaccaaggagagtggtagccccatatatgataaatctacgatacaaagtaatagacaagctagtacaaaactctttaaacatgcaacactttactaaacaacaatccatactactagaatatgtatcagagcaggttaccgacctacactgctaacatacccgcaggtctgttccctggaactggcgtgagggtggagggctggcacatgatgtgagagacatggcttctgccagagaagccccggacagctgcgagcgctggctagaaaacgtacgcttaggaggccagtctttccgggatcaccagacagcattagctagatgtcaataggctgataaacatcaccctacaatacaaccaccaaaaggaacccaatacgggtcaaaagcggagagggggagggggaataaacggagcaaggagataggaaatcacttatatgattaatgtgacatggttgaaa

SEQ ID NO: 701431 - DNA, 267 bp, Homo sapiens
  misc_feature (42)..(42): n is a, c, g, or t
  misc_feature (50)..(50): n is a, c, g, or t
  misc_feature (248)..(248): n is a, c, g, or t
cccgctgcatgcacgcaagctggcggataccgggcgctatgngcggatcngtggcgtcgggctttgtcgtcgatggcggcatctaccgcacgagtttgtcgcggacgccgtcatcagcggcctgatgcgcgtgcagctcgatacgcaggtgcccgtgctttccgccgtgctgacgccgaaaagcttccacgatcacgaagaccaccgcaaattcttcagcgagcacttcgtcgtgaagggccgcgaangcaagggcctgcatcaaga

SEQ ID NO: 701432 - DNA, 539 bp, Homo sapiens
caggagttgattttcactgtaattattactaagccattgattttatagagttgtgaggccattaccttgagacaaattttaaataaaaaataaaaaaaggaaagtccaggaaggaattcaggcatgaggacatttaagaactttgaattttagctttgttgcttgtagtttcccaattttaaaaatctttaacatcttccataccaggagataagcagtaaatgagagaacacatttggaagctcttggtagactgaaaataactaagggaggttcccttctttcctcttacagataaaacttggttttcaatagtataaactcaatctttgaaaaacccacctcttttcctagactcacaagggtgcttccatgacatcttggatataaaaggaatacttagtgtacatgtgaataattaagtcattttttaaaatgccctatgtgaaataagaaattacctctgtgtaattcaactagtcttgcaatgagaccctttctccaacaataaagtgcaataaataatttactcacaaaaa

SEQ ID NO: 701433 - DNA, 853 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701434 - DNA, 463 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatagctttgtaagtaaccactgctcctccttcatctcccaaggttacttacaaagctccagttccaacaggggaagtata

SEQ ID NO: 701435 - DNA, 508 bp, Homo sapiens
  misc_feature (106)..(106): n is a, c, g, or t
  misc_feature (373)..(373): n is a, c, g, or t
caaaaatggcccctggaggccgtggccccccagatggatgacatggccatggtcttagccagggaatttttccaggccttgaaggagctcaaggtgttagtggctnccaaggcccttttggacccgcccaaaagcctggggtgcactgctttccggggaaaggtgggggtttttttttaaatggaagccaacttcaaaaacctgtcccggggggtggtgaaagtggcccccaagttgccccccaataaaaatgtcaaaaacctgtttgtggcccttggggaaaagtttggggaacccccccgctccgccccctggcccctcaaggagggggggtttttcctgaatcaagatttaagggtttgtcccctccctngaggggttccgaccccaggccctttggggccgctacatgggccccccccgggggggcctccggggcctgttttatgattggggggcctccccacgccccgcccccgctgccaataaagttgttttgggtttggga

SEQ ID NO: 701436 - DNA, 1591 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701437 - DNA, 1143 bp, Homo sapiens
  misc_feature (338)..(338): n is a, c, g, or t
  misc_feature (624)..(624): n is a, c, g, or t
agcggagatgaccgcttgccgaaaccccctggagatagcaaatggttatgtggagcactgtgttccgataccagtgtaacgaacctactacagactgcgctcagaaggcagactggagatagtacaccgtctagaagtgataagaagcattgcgagtataataagggctggctggacgattaacatcttctctgagattgtgaatgcaagctagtgtggagagagccacgagagaatgccggcagaaccacacgctgtgagcaggagtccctgggttggacacctgggtatgcccaaagggctggtccttgtcccgtggccagggctatatgactggnttatcccgacgcgatatagtctctacctcaccagcggtcgtccacagcttgcattcaagtggagaacaaactgggacatgcatgaaccgagcgggggtacacaaaagtgcgtgcttccctgggaaacccatgtccaggaatacatgctgatcagttgcacataggacattggtccccattaactagtggatacactactaaatgctgagggaatagaaaaggtcgacgcttgctagagcagagattggagaaagcgtgggctctccttaccaaccccttgaacatnatcatgccatgcggtatgattaccttcgggggatcattcacagacttcactaaccaggaaggctgacgtagagagagtgagtagcagttgcactgccccattcctcgtctctatcccctgcaatagcacacttatgccaagaaaagctgagggtgggctgtgcgcgtttaacggtggtgtgggggctggggtcgtagcaaagaaagttgagcatatctttcaaaaaatcttcatcgtagatcccaattcttgaaaagctatggctcacttgcgtagtcccttgtagggtctgtacccaacagggaccgaatttgccatttagcttgcactttatggaagggggcaaaggaccactgtccccgcaggaaatgggcgcaggggagacccccgaacattaagccgcttggaagggggaaattgggaagtcctaagtaacgtgggaaatcggaatcgaagacccggtggctcggtggtaccgagacagtaggccttaaaggtgaacccatggggaaaggaccc

SEQ ID NO: 701438 - DNA, 1261 bp, Homo sapiens
  misc_feature (1254)..(1254): n is a, c, g, or t
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagaggggtgggtcagagcagtggaggggagacatcgcccatgtgcttctgctactggtccttgggctggntgttggc

SEQ ID NO: 701439 - DNA, 184 bp, Homo sapiens
ggcaaaaaaacaaaaacgaaaacgaaaacaaacaaaccaagaattcagtgggatacattaactatgtcaaaaggaaaaaaaagggcggggcgtgaactaaacaaggaatgcgggcggggtgcgggggctcatgccggtaatcccagcactttgggaggcaaggccggtgggatcacctgaggtc

SEQ ID NO: 701440 - DNA, 257 bp, Homo sapiens
atcctttcacgagaccctcttataggaaaatactgaatgaactgtcctctgatgtgcctcgtgttccaagattgaagaagagagatcagaggaagagggaacaccacctagtattgctaccatggcagtcccacctagcatatatcagactagcacggggcaatacagtatgtattcctgcaattcgatatgataaagtcctagcctttaaggcctcctctaggtaatatgagcacctaggtttggcataagatgcc

SEQ ID NO: 701441 - DNA, 331 bp, Homo sapiens
gtgtcaccagcagaggctgcagaatagcaaatattgctgcctgatccttcctctggaagctttgtcccagcgggcacccacttgtatgaggtgtctgtcggcccctactgggaggtgtctcccagttaggctacacggtgtcagagacccacttgaggaggctgtctgtccattatcagagctcaaatgccatgctgggagaactactgctgcctttagggctgtcaggcagggacatttaagtctgcagaagctgtctgctgcctgttattcagatatgtctgcccccagaggtggaatctagaggcagcaggccttgctgagctgcagt

SEQ ID NO: 701442 - DNA, 348 bp, Homo sapiens
cgtaaaagacattggtgcttcagctttgctctcgcggctgtctgactctgggggaagccagccaccacgtcatgaggacacccaaacagcctacggagaggcccacgtagggaggagctgaggccccctgccagcaagcagccctagcccgccagctgtgtgagtgagcgagcctttttggaagtgcatcctcccgtcccagtccagccctcagatggctgcagccctgctagcatcttgactgccgcctcatgagggacctcaagccagaaccaacagccacgtggtgccagaattcctcatctgcagcagccgtgtgagatcataactgtttattgcctttttaaa

SEQ ID NO: 701443 - DNA, 319 bp, Homo sapiens
atgaaccacatgacctcaggatactcctcaatagtttatgctccagcatacagtatacacgtctgcgaagggccagagaaagccagaaccaagtaagaaaacatagcctcatttactttcaaataaggcaaaaattccatttaaaatgtggggatagggcacccactcagttctttcagatggtatacttcagaatacagaaggagcttccagttgaattcgaccagtggacaaactgcaggacaccaggtgaacaagctctttctgtatttacatacaaagtcagatcagttatgggacaatcagtcacatgcagaga

SEQ ID NO: 701444 - DNA, 1558 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701445 - DNA, 567 bp, Homo sapiens
  misc_feature (169)..(169): n is a, c, g, or t
  misc_feature (176)..(176): n is a, c, g, or t
  misc_feature (248)..(248): n is a, c, g, or t
  misc_feature (298)..(298): n is a, c, g, or t
  misc_feature (309)..(309): n is a, c, g, or t
  misc_feature (359)..(359): n is a, c, g, or t
  misc_feature (369)..(369): n is a, c, g, or t
  misc_feature (393)..(393): n is a, c, g, or t
  misc_feature (396)..(396): n is a, c, g, or t
  misc_feature (407)..(407): n is a, c, g, or t
  misc_feature (431)..(431): n is a, c, g, or t
  misc_feature (435)..(435): n is a, c, g, or t
  misc_feature (462)..(462): n is a, c, g, or t
  misc_feature (464)..(465): n is a, c, g, or t
  misc_feature (475)..(476): n is a, c, g, or t
  misc_feature (489)..(489): n is a, c, g, or t
  misc_feature (497)..(497): n is a, c, g, or t
  misc_feature (515)..(515): n is a, c, g, or t
  misc_feature (557)..(557): n is a, c, g, or t
ccggttcccccttttaaaaggtaatgaccatgccccccccccttttgggcagggtttagtccagccctttgtccctctcccagatccccaatttttagtaaaggaccgggtcataagaaataaggctgccaaagaatcacaccagcttcgggcttagtaaattacctgnatacacnccttttcctaaaggaaatcccacatcttcgtaggagatctggtgtaatgctcttgggccctctctctaaagnatgagctagtatccctgggtcctagtaagtttcagcaaatataatagagncagacctgtcntctttttcagaaaagaaccagagaaaattgtttaaccaatggttttgtgnccttaaagtntgtgttagtcccttagcacccccnctnaaattttgctnaaagggacgttttgtgtgttgggnttcnctaaggaagcccctgaaagtgttcaanannagggaaaatnngaaactgttccanctgaaaanacgggcaagggggaatcnttgaaaaagccagaatattgaagtgttcaaatgaataaagangctaaaaact

SEQ ID NO: 701446 - DNA, 1538 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701447 - DNA, 1668 bp, Homo sapiens
cacgaggccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtgctgcacacctgtcatcccacctacttgggaggctgagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701448 - DNA, 192 bp, Homo sapiens
caggttactggatccctggtgatgcagtcactgggttctgacttgcaccttcatgtgtcctgcagtgtagtttgtgagaccacctcgtcaagagggtcctttagttattggcccactgcacgctgtgcgtcatagggaggctctgaccattcatccaccacaggtcgcttgcgtccggagatctcaggatca

SEQ ID NO: 701449 - DNA, 792 bp, Homo sapiens
gctcacgcctgtaatcccagcacttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcaggaggctgaggcagaatcgcttgaacctgggaggcggaggtgcagggagctgagatggcgccactgcactccagcctgagcgacagagtgagactccgtctcaaaaaaaaaaaaaaaaggcaaaaattagccaggggtcggggcgcatgtcggtaatcccagctcctcgagaggctgaggggggaggatcacttgagcccaggaggcagaggtggcaaggacctggcgatcatggccattggcactccagcctggggcaacagagactctggtttcaaaaagaaaaaaaaattccccacattttatttaatttcagtccatacagttctatcctggctagggctggtaactccagttgagggcaccacagtggtccacccagggagtttctggtgggccatgggatggtgttggctttcatggtacgtggagaccaccaggtgaaatccctggcaggtgtgccctcaagagccaagttcatcctgtgggttcttcctagacaaggatgtgttttgctgctgtgcatgacctctgtcggcacccacatgtgcggcctggtagcattgggtagggggtctctgtccagtgctgtgtcccttggtttgtttgttctgccagtcccatggtctc

SEQ ID NO: 701450 - DNA, 1537 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701451 - DNA, 2188 bp, Homo sapiens
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtaagtgaaatgcttgttggataaaagctttctgcaaagggtaatcttagaagacattatgtaacttttactctatgttaaaaaattatgagattatataagtggtggtagggatttttgggtgaatttaaacaccttgtaattaatagtttttcctggctaatgcattattttgaaagaaactggttacttattttcctgactctaaataacttgtagattttgcagaacaaatttaccggaaatctgcattaatagtttttgtaattaattaattacaaaactagtaattaatagtttttcctgcctaatgcattattttgaaagaaactggttactcattttcctgactctaaataacttgtagattttgcagaacaaatttactggaaatctgcattaatgttcaatttaattttatttatttttgtggcatttgataactattcaaaaacaatagaagatggaatcctttgtaagggtaaacatttgacctatgataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctactggttcggagactggtggtccatgaacctctgacatttcttttgacaactttatcatttgtgctgaatcgaaagaataatcgatgatgggccaatgatggattggggcctgagcaaagttcttgattcggctgctgatccaaggcgtgt

SEQ ID NO: 701452 - DNA, 215 bp, Homo sapiens
aatcgcagcaatactcgtcggcgctggtgaagtcttgtccaacctcgaaggtgtgacggtagcacccggtggattctcattgggaacgacgatgtcttcgtctgatgcgggaaccggtatggggtaattaatgttgaggtaagccggacggccaaatgggtgcgtttcctggcttgtgtcgaccgatctgccagtgactgatggcactgacgagg

SEQ ID NO: 701453 - DNA, 1192 bp, Homo sapiens
  misc_feature (1137)..(1137): n is a, c, g, or t
  misc_feature (1141)..(1141): n is a, c, g, or t
agcggagggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaagtaagaaaaagcattagtttgggggcttatggtattacatatatatcatccatttaatttaaagattgtatatctggccgggcactgtggctcacgcctgtaatcccagcactttgggaggccgagatgggcagatcacctgagatcaggaattcgagaacagtctggccaaaatgttgaaacttcacctctactaaaaatacaaatattagctaggcatggtggtgcacgcctgtaaccgaagctagttgggaggctgaggcaggagaattgcttgaacctgggagggagcncaangatcattgtgccacagcattccagcctgggcgaaagtgagactcaatctca

SEQ ID NO: 701454 - DNA, 500 bp, Homo sapiens
  misc_feature (500)..(500): n is a, c, g, or t
agcagcaatttgctgttggccaaggtgggagggggtcaggggtcctcccactgacaggctcagcagcacgctactgggggccacaggcccagctgtacagaatgtgactcccaagaacacgaggcctgctgaggggcagagatgagcagtcactgctaaccctggcaggaactaactgcagggaaaggggcctctcctttaaatgactgtaattgggaactcctgagtaaaggcacagacttccacacggccagcatcctgcaaagcctgagctgcgcactgcctggatgtactttcagcccccaaccaatggcgcctctcccctgaagtattcataacgaggttgagagttgctgactgtgacaccagggacttgagggctccttgcctccagctccaaccatggtgcttggccctggacgcaggcctggcttcctcctaaccacgagccacctctctgatgctgctttgatttttaatggcttaattttaattgattn

SEQ ID NO: 701455 - DNA, 377 bp, Homo sapiens
  misc_feature (169)..(169): n is a, c, g, or t
  misc_feature (211)..(211): n is a, c, g, or t
  misc_feature (255)..(255): n is a, c, g, or t
  misc_feature (311)..(311): n is a, c, g, or t
  misc_feature (325)..(326): n is a, c, g, or t
cctgcgcgccaacccccttgcacagcaagcccgggccgcgtgcgcaagctggtcatcgacgtggtgccccccaagttcctgggcgacttgctgctgctgcttcaactgcctgtgcggagcttctccaaggaggacgcaagcccctcttcgcctggtgaagccgccccgngcccgccgccttgcctgcagtaaacgcgtttgttccaacccnggggccgcggtgcctcctgcgcgttccccggaggggaaagggcncgtcccccgcgccgaggccagagaagccccgctcccaccggtgctgggccccgacnccagcccgccgctnnccgcactgcggagtgcttctcacccctcattaaaatcatccgtttgcttga

SEQ ID NO: 701456 - DNA, 900 bp, Homo sapiens
  misc_feature (52)..(52): n is a, c, g, or t
  misc_feature (176)..(176): n is a, c, g, or t
  misc_feature (242)..(242): n is a, c, g, or t
  misc_feature (317)..(317): n is a, c, g, or t
  misc_feature (350)..(350): n is a, c, g, or t
  misc_feature (384)..(385): n is a, c, g, or t
  misc_feature (407)..(407): n is a, c, g, or t
  misc_feature (431)..(431): n is a, c, g, or t
  misc_feature (437)..(438): n is a, c, g, or t
  misc_feature (440)..(440): n is a, c, g, or t
  misc_feature (586)..(586): n is a, c, g, or t
  misc_feature (614)..(614): n is a, c, g, or t
  misc_feature (672)..(672): n is a, c, g, or t
  misc_feature (679)..(679): n is a, c, g, or t
  misc_feature (712)..(712): n is a, c, g, or t
  misc_feature (716)..(716): n is a, c, g, or t
  misc_feature (742)..(742): n is a, c, g, or t
  misc_feature (747)..(747): n is a, c, g, or t
  misc_feature (749)..(749): n is a, c, g, or t
  misc_feature (758)..(758): n is a, c, g, or t
  misc_feature (761)..(761): n is a, c, g, or t
  misc_feature (886)..(886): n is a, c, g, or t
gggagggaaagaggcagacacaaacatgcgacaggcaggccgtgtgcccganggcagtcgggctccaaacaccaactctgtccggcgaaaccagggcgcagtcttcactgcagcggggccacaggcgcgcccgagcagtggaagtgcacattctgccacttgccgtcgcggcggtnccacacgcgggtctcctcagactggctggtgcggggccggccctgcccgtcaatgtactgcgtgancggatgtaagcaatgcaggcggcatcctctccaatgacgtgcacgtgtgggttcaggatggtcgtgtggattggnttgctgttcttggccagcaggttctcgaagtanaatctgtggaagtccatcccttcaaccaggttanncagtgcttcaggctcaaacgangtcagccctgggtcacagattttngcgtanncntcaaagtcaccgttgttgacggcctcgatgagctgctccgtggtcttaatgatctcctgcttccgggctttagcgtcttcatcctctatggtggtattggcactgtcagaagaatccttaatcccgtccactgggttatggatganggtggtttgaagatccagggcggcaggnggaagcgtccctttggggctggtggcggctgcactgtttttagtgctattcgtctggngcttgantccatctgctttcttgttgagtaaactcttggntganaaattccgtgtggccagcatggaagnaaagntnaaaaaatgnccnttctcctggcattgaactttttcagacactccacagtctcctgtctgtgcatcatggatgctaccgtggagcgttggcagacccacgggtgcttcagggccctcatgggctgtgatgcgcttggnagggttgatggtca

SEQ ID NO: 701457 - DNA, 224 bp, Homo sapiens
agaggagcgacttgatatcatgaaggatctaataactggtccagcggcaccccttatgcaaatcgctgctttgagtttcatgtgtattttcctcaagattatcccagttcaccccctattgtagaatctagagacaactggtggtaatagcgtgcgattcaatccaaacatttataatgatggcaaggtttagtttaagatattaaacaagtggcatggaagac

SEQ ID NO: 701458 - DNA, 1359 bp, Homo sapiens
gagcggctggctggtggcggcggccatttatgttcatcctcctcctcctcctgctcctcctggttggagcgcagtgtccggagcgggctggggggagatgatgcccgagagcagggttcggtgccttttcctcatgatccccagaccggatgacgagagcacagggaattttttcagaggacagaacaagaaagccagacagccgtacgcacaacacgatatgaaatagaacaaaaaacacagaagccgaacagaacaaaacaaaaccagatagcaccaaagagaaacaggagacaggaggatgagggataatacgcatgagaattaggtaggagatgaagaagagagagagggagatagagaggtgaagaagcagaaagtaacggagtcagaagaataagaagaagcacactgcaggcaggtgctgagatattagaagacgagagagcagacgaaagagaaaagtaaggtagatgagcacggagagtacaagggagtatagggtcggcagataaagagagacgtgggataagagtagaggcagacgccagagaggagagaagggatgagtagtgggagagagagtgcgacatagaactggcgaaacaagtggatagttagagcacaggagagtaaggatgcagaagatgggcataagagtaggggagggaaagggggtaataagagagttaaggagccgacgagagaggcagagagcagtagaggagcagacgacgacaggcagaggtcgacagaggaaaaagagggaggcaaaatgaggggaaagagacaagcaaaagaagactgagaagagcagcgcgaacgcaagaagcgaacagataacgcagaaggaaaagaaaagaggtgtggcagctggacatagacgtagacggggagtatagaaaaaggagaggcgaggaagacgcgctgagggtgacgaggccgagaggggaataagacggcgacgagaagagaagagaggcagaagacgagcaccgagatcgggctcagccgaggacaagcgccgagcgaacgaaagtacaagatacgatgatgcagagaggaggatagcagagacaggcgagcagagagagaagagacacgatactggacgagacgggagagacgggagcgaagagaggaggagagcaggtggaaaagggagaggagaatagggaagaacagacagggggggagggggaagggtgacggtgaatggagggggaggtggagaagaaaagaagagaggggaaggcgacggaggggacaggaaggcggagaggcggaacgggggggagagacgaggatagtgaggagggggagggggctgaggagtgacgcagaggaggacgagaggaa

SEQ ID NO: 701459 - DNA, 131 bp, Homo sapiens
  misc_feature (7)..(7): n is a, c, g, or t
acggatnacggactgggtgtgcacgactttgacgagggaaaaatctatggatagggctgaaatgtttccttgtattccttttataccaactggaactggcggcccaagttcggcttgtccatttccccttt

SEQ ID NO: 701460 - DNA, 999 bp, Homo sapiens
gctctttttccggctggaaccatggagggtgtaaaacgagaagacgaaggaggttcctgctgtgccagaagacccttaagaagaaacgcgacaggaattctcgcagatgctgaagatctaagctgcctgtagtaacatgaagtttgcccagacagatgcttcgaacaggcaacggacggagcgcttatctatgatacccgcaaagcactatcacaaggcatactataggccgactgttagcagaactgtaaattcgaactggcgaggatggcatgcacatagcgctgtcaacttctatgtacctgcagtaagccaaattggacgtactgtcactccgaatcagaggtatcaatggagtgacgcccaaaggttcgaaaggtgtcgcacgcttcttcgcctttcgtcaacatctttcaatggaaccctttgctgaagctcaaccaagggcttcgattaacattgctgaggacttggtacgagccaatatatttgccattggcgggtaaccccgaattcttgcaacgttcacgtaaaaattgcaaccttaattcgtatcaaagcgttgggttcactggccataaacatcaacttcacggaaagcccgacactttgccttctcgaccacgacttaaactgactcttgaaatttggcctcggagtcctcttggcgtaaaattaccggccattcaattctggccatggcaaggactttggatttcaatgcaggatcgtattactagtttgggtaaaaacggccttctcccacacacagggccccgatattgtaaccgtgtccccttgggtggggcccaccttatttccaaaacgttgggtcctttccataccacacggaaatggtgtgccacacttgcacgcaacaaacaagtgatcccaacccccaaattgcttgggctaaaaacaccgttttgtcaggacttgctctggcacaacacacggtatgcgtacccagcacatcaacacacggcctttactacgaag

SEQ ID NO: 701461 - DNA, 147 bp, Homo sapiens
atctaaattacagctgctttgaataaaaacgttaactaacaagctcacgctaagggtctcataggctgattgcttagcttaacgctttgttattcacaacgcagcctgtaatttacgttaactaaaactaacttatgcatcttataa

SEQ ID NO: 701462 - DNA, 246 bp, Homo sapiens
cggataggcctgaaaggtagaatcatcgggtacaatggagcagcagaggataaggcttaccttcatagtggatagtttaaagcagctctggcagcctctggctcgttttgactatgctgcagctccctggagcatagggttttccaggtgtgacagcagagactcaagtgatcaagtgatttggccaagggcatgcgggcagtgaagggcaaaacctgggcccacgtgttgggttaggtctacctg

SEQ ID NO: 701463 - DNA, 720 bp, Homo sapiens
cggaagttttatatcgtcgatccacgcgctccggtggcagccagcgaggccgccaagatttgtgcatacaatggtagcatccactgagctatggagaaagaagcagtctgatgtcatgcgcttacttctgagggtccgcctgctggcagtaccgacagctctctgctctccacagggctccccgccccacccgagacctgataaatgcgcgccgacatgggactacaaggccaagcaagggttacgtgatatatagcgattcagctgattcgacgatggatggaccgaaaacgcccaagtatcacataacggcgtgcaacttacgagacaagacctagtccaatcactgagtgtaaaaccaggactaagagatcagctcgaaacgcctttcagatccgattgcagacggagccgagcttggacgaccaacgtgctggcggctcctgaggagatacctgacgttctttacatggggttgggcgaacgattcacagcaatacaacattcaacatgagaggaacatccgtcattaggatcacccaatacacaatacaaagcactatcaaaaaaagcaaaattcatagaaaaccccagcatggcatcaacaccagaacccagttccaaccaaacaacacgctgcagattcagtagaaactagcacatacttacacagccatacacagccacaggaacttaaacaaaggacacgaaaatacacca

SEQ ID NO: 701464 - DNA, 167 bp, Homo sapiens
  misc_feature (38)..(38): n is a, c, g, or t
ggaaaacaattttactggtcagatgtggtggctcatgnctataatcccagcactttgggaggccgaggtgggtagatcacttcaggccaggagttcaagatgagtttggtcaacatagtgaaacctctctttaccaaaaaaaagtaataatgataataaacatttaa

SEQ ID NO: 701465 - DNA, 231 bp, Homo sapiens
cctcatatgatagtatcctttgtctcttatgaccgcatgcaggaagagaacaaacccatcaatggactgttggaacgacattcctacggacgtagcattaaggctgagcgatcgtggcttcatgacatgtagtctccgtactttgccacgctagtgatggtggatagcttaagcccaggaatttgagaccaggctgggcgatcatgacattacctcaccatgtagtgacct

SEQ ID NO: 701466 - DNA, 394 bp, Homo sapiens
  misc_feature (394)..(394): n is a, c, g, or t
tcccccgggctgcaggaattgggatcaagcctgtgtggagctcggtgagaagtgcgcaagatgcgtagtggacattgtggatgatgtgccaggagctggacgcctctatgcaggagcactctcgcaattaattgaactgatagctttacgggactgctgaaaccaacgagggaatgacttatatgatcggatctgactgcatggatgctagagtggtgcttcatgtatatgctgcaattagtgctggacggaccttctatgcagacagtggactctgtaggataggcgcatgcgtccttgtcacgaggtcatgtgatcatataatgggctagagaccgttattgaggctaggatagattgatttagtcacaatgtggttgcggtgttttttcgn

SEQ ID NO: 701467 - DNA, 755 bp, Homo sapiens
gattgtggacgcatcagaatgtactgattgaatcaagatgccttgtccaactcttgctactgattgaatccgtgaatactactcccaggattgtcggacatcatagtcccagtctgtacgtatcggcgacagcaggtatgagtcccgagtagaaattgtcggcgacgcatcgagctaatgtgccggtccgagatggttcacccgttcaacatccgtcaacaccgagactatcggcgtttgctattacagttgggcataaagtgctcagctccatccaatacgctgtatctcagcaggatcaatactctggaatcaagcatgtgccattctttagtatatgtcattaacgtttctcgacctgtcttcactgtaagtttcctgaggcctcaccaagaagctgagcagatgccagcaccatgctctctgtactgccctgcagaaactgtgaagacaattaaaacccttttttcacgacactaaccaaaagaaagcaaaacactacaaacaaacaaacaaaagagagtggttgcggggcaccagcaacagggaccacaagaaaaaagcgcgtgtcaagacaaacccacccgcgacgagaacagcggcggggccaacaaaaaaggtaaagggtggagccagtacgccccacagacaggtgacccacagagagaccgcggagccagcaaacagaaaaaagcactagcacagcaggatcaaaacaacgcccgggggggaaacccagaaggtatgaaacaacc

SEQ ID NO: 701468 - DNA, 279 bp, Homo sapiens
gataaccgggaagaaccatgaagtgtatgcatgttgatgggtctgctggcacgtcatctgaggtcttattgtacaatggtccccctcatcagaaagaagtccttgagacgcaccctgtccgagcgtggcctgctgaaggacttcctgaagaagcaacaacctcaacccagccagaaagtattacccccagtgaaaggttcccacactgggtagatgaacagcccctggaagaactacctgaatataggagtacttcggcactatcgggcatcggaactc

SEQ ID NO: 701469 - DNA, 367 bp, Homo sapiens
aaactttattaaaccctatcaaggttgtgttttccctttctgcaggtatgtttatcatactcagctttgcttgatcatagctctttctggtggtctttgggattatatgaccagcttcaatgtgccattcaaaccatagaatcataccatttaactctgattatttcaaggttaggtaatatttctataactgttcatttgttcttatagtaacattctgtggactttttcaacataactatattcttgatcaatatgaagggggttaaataaaaactttatttatttgtgaaggattttgtctatactttgaaaaaatctgaaaatcaacaagaaacagtaagtttacaacttacccctattacaa

SEQ ID NO: 701470 - DNA, 274 bp, Homo sapiens
agatgtgagagaaacagaagaacacccaatcgtctatcagggaactggtattaatcagccagatttaaaattttatttattatttttttttgagatggagtctcactctgtcacccaggctggagtgcaatggtgcgatctcagctcactgtaaccgcctcccggattcaagagattctcctgcctcagcctactaagaactgggattgcacacatgtgccaccacgcccggctgatttttttgtatttttagtagagacgaggttttgccgtg

SEQ ID NO: 701471 - DNA, 886 bp, Homo sapiens
  misc_feature (68)..(68): n is a, c, g, or t
  misc_feature (141)..(141): n is a, c, g, or t
gtttttcaccctgtggcggtttacgaccccccgctgggtgaaaactttagcggggttaatggtaaacntgccacgacgctggtgattgaccgcggaaagccgtcgcattagggagggattttggggaacccctttgccccnccgggggtttgcgagattacgcgcccccgcccttttagtaactgaacccgcgctgtaattttgtcccccggagagcccgcgtttccgtcgtgccccaggagtgcggggccccagagctctgcccaaaatagtcggccttctcccccgggcaaacatccaggacattggcgcgcagcaactggtcacgcccgaagtgtttgggcccctaaaacgcgggatacacccccccgaagtgacaccgctggccccaagagaggtaaaaagtattggcagtaggggaaacaaccgggtaaaagccaacactggaggcagagaaacacaatgggggatcactccacacacgagcatagtgtcccacacaacctattagaaatgcttacgctgcaaagatgctcaaagtggtgacggaggaaagattaaccactctatgcgcaacgttccttcggcaaggcacatggacagccaccactagtatatgaaacgatacatgaagtaacttcgctcccccacgtcattagtacaaaagaaagacagcacagggttgtcaaataatgggaggcggaaaccacccagttgtcggcaacacgcactccatggggcgccagcccttcgggagagcgggtgtaaagatgcttggtggtaacagattgcgtcgttcctacttttgcccaagggagcttgtgtgaaagtcaatcgcaccccgcataatcccaaaaagcccccttcacctgttcaaacatagaca

SEQ ID NO: 701472 - DNA, 161 bp, Homo sapiens
cgttccatggctccccatcgccagcccccccacgcccaccaggtaccgcctagccacactgcactgtggccccttgggaagagctcttttctcaactacttgaatggtcctaccaaagtgtttgatatgggcaagcaagggtttaacttaagcctaattcc

SEQ ID NO: 701473 - DNA, 579 bp, Homo sapiens
taagactccagcctgagcaactgagcaagacttttcacagtggtgaagagagcaagagttgtgcagtggtgccatcacagctcatgcagctttgaactcctgggctcaagcaatcctcctgcctcagcctcctgagtaactaggactacaggtgcatgccaccatgcccagttaattttaaaaatattttttggccgggcaagctggctcatgcctgtaatcccaggagttcaagaacagcccggacaaaatagtgagacccagggtctacaaaaagagttttaaaaatttgccaaacatggtggtatgcacctgtggtcctagccacttgggggctgaagtagggggctcgcttgagactgaaaggttgaggctgcagaaagccttgactacgccactgcactccatcctgggtaaaagagcaagactctgtctccaaaaaaaaaaaataatccaacaaacaaaccttttttttttggtagagaaagggtctatgttgtccaggctggtctcaaactcctgacctcaagtgataattccgcctcggcgtcctaaagtgcttgagccaccgtgccaggc

SEQ ID NO: 701474 - DNA, 431 bp, Homo sapiens
gagagagagagagagagagagagagagagagagagagagagagagagagagtgagtgagatatatctgtctactcgctccgttctcttactcgtttttgtttctctctttcccctaactctttccttctccttctcttttttcttcctccttctttcctttaccctcctttttctcctcttttctccccttttcttctctctctttcctttcttccttcttttctcttctctttcttctctttctctctcttcctctccttcctctctctcctgctgcctctttttatcctactctctttccttctcttccttttctcttcactctctgtacctccttcttatcctttctttccttttctctctctctctcttcccttctctcttctccttctcttcaccttttctctccttctatcttattattcgttcc

SEQ ID NO: 701475 - DNA, 447 bp, Homo sapiens
tacacagctattacagggctgctattttcataatgtacatgaacaatgtcagaacttttttaattttttggattattattagtattagtaaaggaagtgaaagacaggattgccttttatagattaaacgtttaggccattattgaaccaaagaatcctggcatatttcttacacttatggccatttacttattgtatttattttcagtagtaaagaccccgcttggatgttaattttgtattgtgtaagtattaagaacattagtgcaactgtacaggttgtcaccagttattgtgatattgattaattatttggctattttgatgaagaaaactttgttcatttgtttctactttcttagagaaattggcacgattcctcctcttttcaacatttcgtatgacttttttttcgggtgggaattaaaagctgtgaaattgttcaaa

SEQ ID NO: 701476 - DNA, 351 bp, Homo sapiens
  misc_feature (348)..(348): n is a, c, g, or t
attttcctttttatggtgatgttgaattgaggagagattgttccctgcctacatttattaaaagttaaaagaaaatccccagcacccttgggaggccaagacatgtggatcacttgaggaaggcccaggagttcgagaccagccctggccaacatagtgaaaccgtttctgtactaaaaatacaaaaaaaattaggctggcatggtggcgcatgcctgtagttcctagttccagctactcaggagtctgaggcacaaaaatcctttgaaccagaggaacaggtttcagtgagccaagaatgtgccacactgcacttcaagcctgggagacagagcaagactctatcangac

SEQ ID NO: 701477 - DNA, 184 bp, Homo sapiens
ggaaacaaaggagacgaggacgcatgcgtttggtgagtccggattctggtgggtcttcgctcaggctgggtgaagcgcttccgggtcgccgccggcagcagccttccggcgcgatgaagacaattaggctcagagaggttaagtgactcagccaaggtcaaacagctatctaggagccatgtcc

SEQ ID NO: 701478 - DNA, 753 bp, Homo sapiens
  misc_feature (358)..(358): n is a, c, g, or t
  misc_feature (392)..(392): n is a, c, g, or t
  misc_feature (401)..(401): n is a, c, g, or t
  misc_feature (419)..(419): n is a, c, g, or t
ctgtatccggggagtctgggtaggaccctgaattggctttcctgtacctggaggttgtgatttaatgtttttctggttgttgagaagatattgatttgggagttccatcctgctgaagcggatccctaccaggtccttgctgcttaggaatcggcttgggtggctgttgttgtaaaggaggttttatgatgtcctgcaggttttccttgctccttctgaaccactttttgtttcttggtggtttcttcctgggatgcctcagagtctgatatcaaatcaaaagggttgaatttatttacaacagaggaaacagcacttaaagcgttaacctctgagaggaagccaggcatcatactanacttgtgctcttcctttaaatcagttctggactntgattcttncaagctaatatggaaggnctcctcccaggcaatttctgctctgacctgaaagtgtctgtagttctacttttactgagaccaggttgagctggacgcccagggtccgggggtcttcctgattgctttggaggatgactactatccaactcttgtttcctgtgcatggaaggcgactccgcagcggccggggggacgcttcccttgggcagcccctgcgcccttgacatgacagcggcgatctgtctcctctcctcttcgctcagctggctcaaatccgcctccatgccggccgggatcgcggtgtgagaggggctccccgccccgctagctcctcctccagccgctgcggccg

SEQ ID NO: 701479 - DNA, 135 bp, Homo sapiens
  misc_feature (63)..(63): n is a, c, g, or t
gctcactacgctggtcccgacgatggggccgtgccttgacaccgcgtcgcggttccgcggcgntcggtgacgctctcgctggcccttgacaaactccgggggacgacgggtgtacacgctcgcacgctgcggccg

SEQ ID NO: 701480 - DNA, 616 bp, Homo sapiens
tccggtaggaaacgtctcgtggacagctcaaagcttaaaaaaaaatttttacccttttttaaaaaaacatttctgccccctcccccattgaacgggctccagggcagctcctttcctgcagggggcaggggaagagggccaccagggcagtgcctgttttcttgaaggcaccgaccctcctcctccccatgtccctgcctccagttccaattgcaggggtccaggtggcaggcccctctggaaaggaatgggtcttccccaagtttccaccccacccttggattggggccgcaggtgtggagggcctcatcaaactcttggggacccccaaccccacactctccggtccatggtccatgccgaaaccgcaatgtgcaaaatgtgggtgggggtgggcccaggctggcccggtcgcgggctaaagtctggataagttcgctgcccctggaggaggacccccaagggcgctagatgtctctagaggctgcaaagtcctggcctggggctcctcacagccccttaccccacaccgaattttttttttttttaaacaacacaacacaaaccgtgggcaacgcccacggcgggccaagggcccaaacttgggcgcaacaca

SEQ ID NO: 701481 - DNA, 685 bp, Homo sapiens
  misc_feature (365)..(365): n is a, c, g, or t
  misc_feature (388)..(388): n is a, c, g, or t
  misc_feature (395)..(395): n is a, c, g, or t
  misc_feature (457)..(457): n is a, c, g, or t
  misc_feature (555)..(555): n is a, c, g, or t
ggtggcgatctgaggtggaggcaggctgcggtccatgacggcagacagtagagcagtgcgtgcgccatggcagaggcttgcaggatccctgctgccttggtgatcccgggctgacagccagagagcacaacggctcaggtcctggatgaagtggacgggttagaatgaaagcaggagagtgcgacgcctgtctgctgcctcagcttgggttccactacttaaggtgcggttcctcgctatcgggtgccctggacagccttggtgaatggcccatgcaccgtgcagtagatcagtcgtgattagctcatcctaggtagtgatagcttgccagtctcatccctcggatcctccgaagaccgccgtcnaaccacgcgacccttgtctgtgnttcagcnctgcttcccatgtgttctatgggggctatcctaccatgctctcagtgtatccttcgcttggnagactgggacagccgtgtgccggcacatcttggtggcctttgaggtgttgtccctgggtcaagcgctcgtgttctaccgttatctctcgctagtatgnctcggtggcgcgaagaactgtgttccctgttaaccatctggcatcgcgagttaccaccggcgttccgagaactcgagccgacagtgaattccccgggtcgattgttggtgaacatacctaaacaggacaa

SEQ ID NO: 701482 - DNA, 743 bp, Homo sapiens
gctatctgtgcgtgatacaggtccttattggtggacctgatggcatgtcttgcccgtgatcaggtcctccattggtggccctgaggcgatgtcttgcccgtgatcaggtcctccattggtggccccccaccacgcccggggcatgcttttggcggggggggctgatgcaaccttttgttccaatagcatcagcttagcctgggttccaacatctcctccctttttctttaaaaaaagaggaggcggaccttaaccagctaggggaggtagaggctgtgctcctcctgagccttaattttcaggcttacaggtaccttttagggaggagaggatttttcgagtaccaacctctatgcaagccagcttacctctcaggagactcgacagtagccttagtaaggactctccttgcagtgccttgctttgcacctagcggtgtccattaccttcgtaaaagcatagtgtcgagcggtatgctgctcccgtaggaggggaaccggctacagtctgccatattctagatcacgtgttgctagttggtgatagtggatttgtatgggctttcccagtagggaattgagctgatccctgattaacgctgttactcgtcttaggatccaaggggcaaaagagaagaacaggatgatagcgaataagggtccaaggaaggggaggaggtaagggagaagtccattgaggccggtgaggaagggattgtctgcaagtgccttgcgtctttgttc

SEQ ID NO: 701483 - DNA, 135 bp, Homo sapiens
ggactatttaacagaaacccaggccaagaccgaagtggaaccagagagataggagttgtctgtgatcttctacccagccaaacggcaggactcgtgaaattgtgatgccttctaggaactacacccatacacaag

SEQ ID NO: 701484 - DNA, 652 bp, Homo sapiens
ttgcactgtaagtgctcggagacctggtgtggcaaatcatcttacctcttcatgctagatccatagaggtactcttcagcagatctttcgttcacacgaagtccacactcacctgttctccatgcagttctgcactcggagaatatgctgcctcaaagaaaatcagccttttgctaagatcaagcctagaggttagcattctcgttacaaccttacaggcgcctaatgcattcaagtttgaagtcgactgcctgatgaggccctagcagagaggcagcacgccccagtcaggtatatgggaattttcatcccatgtaggaatctagtgccatcctatgtctatctgtccaaccaggccttcatctccagttgtactacaaacctccttgtgtaagaggaaatatactttgcacgattaaggcttacacagtagtgctttttcctgtcacttggatttgcattcgaacctgcatttcgaagattttttatagcatgttttctgatcttcgctgacaatcgtcaggaggctgtcattgacgttgtagtctgtgcttaataaacttgcgtatcactctgctctgatccccacggaattaacttagcaaatgaaatgatatgttgggactttggcataatttgatatagcattgtt

SEQ ID NO: 701485 - DNA, 674 bp, Homo sapiens
  misc_feature (422)..(422): n is a, c, g, or t
  misc_feature (450)..(451): n is a, c, g, or t
tcggtacaggttgttattactgtcggtattctcttcatgtggaccattctctcagacacacaagacagaaacagtagcctttttgaaggaggaggtaaggattagattaacaagccctccatttatggtggaggtgcctgctccattaatccaatcaactcaacctttaaataacacttgtgcaaatatatcctggatgacacttgtgagggaaatgtggtaatctttctggacttttacaacacaaaaaattggaatgcgttttatcacaccaaagcaagctggaaagggtaatttggatttcacttgtggcatgctccatagtaattttctgtaaacgaagatccaatttttagggtgggggcaaatatacaaggtccaatgatttgaaagatgtttaatatttttttctccatgccttncaatttttcagcccaatgggaattcttnncttggaccagtctaagaattacagaattagagatggaaatattaggtatttaagctatctttctgtgatgaggggtattcctggagtccaattataggcgtttctgagggtgctttgacaatgggctttatagatgaaccgcgtggaaaggaaccctttgtgggtttagacaggctaacttgggagaccgggaactttggtaccttggcaggccgcggtggtt

SEQ ID NO: 701486 - DNA, 1161 bp, Homo sapiens
attgttttcgccgatgtggttgttttccgtgtgtgcctctcacttttggtcggtcctctgctcgacgtgttggcagcccactggggtcttctccacacactgccttgtgatcttgtgtcgcccccgtctcagcagtttttcgtcgcctgtagtgttgcgccgcgtccgcgtggtgtttttaaggggtcgccaccacactgtgtcaccccacagtaccctctcctttgccggggaaaatagcccctggggggctcctgcccccccccaagggccccctttcgcgggggtatcctttgtgggctgtgttgctgctactcgcgcttcctcggtgcccctcccttgtcgacgctccctgtagtctgcccaatgccgggtttttacctgattgggcccaaaggtggctcgtggaagtggaatcttttctgcctgcgcaccaaccaaaggggaagctcgcgggcccttaggaaattggacccacatggcccatctagtcaaacctgttgtccacccagtgtccgcattgttttgcttcgtttttttgaggtggaggttggagtgaaccgagatcatgcgtactgcgactctccagcctgggctacaagagtgagactttccacagaaaaataattatatataatatagaggaaatagaccacaggtttcccggctggtcaaactcctggcctcaaatgagtcctcccaccctcagcctcccacagcacaccgggagctacacggcacaacactcacccaatgtccacagctgtccccacgctttctaattctggtctattctttgtgccccacgagaacctcaagaaaggcactgataagccacgcccctgcagtgccgtccacccgcccctttgggcctgcctgtggctcttgttgccctcctcttgtggcggcaggaccctttgttggggcttctgtgcccatgcttttggggccccaggcggggctggtccacaattctccaggcgcccaacagccttcaaagatgggtataaggagcttgcccgtcccatgggccacccacaccattggtgactctgcgcccaccaccacccagccctgtccctgcacaaccctcctagtggggactagtgaatgacttgacctgtgacctccaataccaataaatgtgatccccccacccca

SEQ ID NO: 701487 - DNA, 385 bp, Homo sapiens
gctagatagtctctagtcttgtaatctggctcttagcaccagcttaccttgaactataaacactcaccttacttaatcatccttctgcaggactctgatgacacagaatagaggagatgttcgaagtctctaatctcatgatttcatgggtatagtaaaccttaacatgtgccaagccctcagcctgtccagactcactgcactctggcagtcccaagggcttccatggaattagtcaatggtatctaaatctcttagccaacatctaactctactaccttaagaaggtagttacggtcaggttgcagtgcctcatgcctataatacccagcactttgggatgcctagatgggtggctaaactttaggtaaggcgtttgagacta

SEQ ID NO: 701488 - DNA, 1223 bp, Homo sapiens
  misc_feature (1)..(1): n is a, c, g, or t
ncgtcgctgtgctcactccgtcttcctcacgcgtcgtctgcccgattcttttctttcggtctctgcccgtctttgtttgtgtcttgcgctcgtgttgtgtgcgtcttgtgctgtcgttcttgttgtctgcttccccccccttcgtgtgtgtttctgctgttgtctcttgtggttgtcgccctcctttcttgctctgtttcgctcgtgtgctgtgtcctggtcgcgcgtgccgttggtgtctcggccacccgtattttctccctttgtgtcggttatatttggtcctggtcgctcctgtgtgttgcgagtgctgcctgcttcgtgttggcatttgtgtctggggctcgtgcttgagtcatgttctggagtggggttctcggatagagctgttcaccatgtctttccaggtccgttcatgttgggccttggtgtattgctggatgattgtctgcttcttcccttcttttcctatcactgtaattattgcttttactatttgagtgcctttatgaatagtttactaattactatgtatgtatgcatttctgtttaagtctcatctgttatgattggatacttggtcttgtcaagtagtggtcagcattgggttgtgagcttgtcctactccatacgtgtttatcctgctatgcagttttacattgtgtgttcactatctattccaaggagccttgctagattactactactggcggttcctgctaggtcctaggctaggctattggcccttgtctgtgtccctataggtagcctatgattagttacgttagcttggtctgcttagcctagccgtgtgtgttgtgcgctaggctctaggcagcctctgcaccagagtcctagcacctgcccattccccagtcacactaatcatactcttctttcatagagattttattaccgacttagacctaccctagttttcctctctgttagtgtcctgagctcttttgcaacaataatgtaggtacagaccatatccctgtcccttccccaatcaggagctccactaccatgtagttgtttggttttccagaagctgccagtgggttcccgtgaattgcgttaagatatcgatgattttttttattgtttttcttcttgtttttttaaataatatatttaaaggcagtatctattgtactgtgaatttgcagtagaagatgcagaatgcactttaatataccttgggatgagtgtgtaattgg

SEQ ID NO: 701489 - DNA, 493 bp, Homo sapiens
  misc_feature (23)..(23): n is a, c, g, or t
  misc_feature (114)..(114): n is a, c, g, or t
  misc_feature (161)..(161): n is a, c, g, or t
  misc_feature (174)..(174): n is a, c, g, or t
  misc_feature (186)..(186): n is a, c, g, or t
  misc_feature (199)..(199): n is a, c, g, or t
  misc_feature (219)..(219): n is a, c, g, or t
  misc_feature (224)..(224): n is a, c, g, or t
  misc_feature (236)..(236): n is a, c, g, or t
  misc_feature (268)..(268): n is a, c, g, or t
  misc_feature (278)..(278): n is a, c, g, or t
  misc_feature (283)..(283): n is a, c, g, or t
  misc_feature (307)..(307): n is a, c, g, or t
  misc_feature (312)..(313): n is a, c, g, or t
  misc_feature (317)..(317): n is a, c, g, or t
  misc_feature (331)..(331): n is a, c, g, or t
  misc_feature (333)..(333): n is a, c, g, or t
  misc_feature (335)..(335): n is a, c, g, or t
  misc_feature (350)..(350): n is a, c, g, or t
  misc_feature (363)..(363): n is a, c, g, or t
  misc_feature (376)..(376): n is a, c, g, or t
  misc_feature (380)..(380): n is a, c, g, or t
  misc_feature (388)..(389): n is a, c, g, or t
  misc_feature (418)..(418): n is a, c, g, or t
  misc_feature (486)..(486): n is a, c, g, or t
tcataacccccatctttttaaancaagcccctcctattgtactctttgtaaaaatgcattggcttacctcgggctcttcgctaggaagaaaaatgtatttcatattttttaaanaaagccacgcccaccccctataggaaccagcccaccaagtggttatnggtgtaagataantttacataaccnctttttttttttngcgcgtttggtgggctgggngtagnaagggtggtgtntagtgtaggtgtatcccgcaatgaaggtgtanggccccgggngcccnagactacctgtgtgtctggttttnaaaannaaanggcgggtgggtttngngngcggatgggctgtgnggaaacgcttagngctgaagggaaangggngaaagtgnnttgcagaggctcgagatttacggggaggncggggatacgcgatgtacccgctatataaaagaaaaaaagagaacccgcatttattctccgcgcgggngggcccc

SEQ ID NO: 701490 - DNA, 202 bp, Homo sapiens
gcgggcacactcaagattatggtggacccacaggaggtgtgcccatcccagccctcactgggtgcacgctctctctttcttctatcatcctatactgccgcagacggcttctcgtcaattgtatgttagcttagctcttcaccagtgggcaacagcaacacactcattgcacgcaccttccaccactcgcaccatcagcaca

SEQ ID NO: 701491 - DNA, 296 bp, Homo sapiens
tccccaggcttggcagaccccaagttgagaacaataatgaacaattattgtatgaacaattgttagagacagctaatcacaaacaacctgcgggcacaatgacctcattccacacgtagcacccttcaacaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 701492 - DNA, 384 bp, Homo sapiens
ctcagcctgggtgagagagtcagactccacctcaaaaaaaaaaggagagagagaaaagaagaatcggcatacctgtaactcctccctctcaaggtttcagtccatatctcgaaaggacggtatgttactctacacaaccacaactcattaccagatttaagaaaattacccctccaccgcgcggtggctcatgcctgtaatcctagcatttggggaggctgaggcaagagggttgcttgagcccaggagtttgaaacaagcctggacaacatgggaggaccctgtctataaaaaattagctgggcatggtggcacacgcctgtggtctcagctatttgggaggctgaggtggtaggatcactatagcccagaactccagcctag

SEQ ID NO: 701493 - DNA, 919 bp, Homo sapiens
  misc_feature (120)..(120): n is a, c, g, or t
  misc_feature (610)..(610): n is a, c, g, or t
gaaaaaagtggccgggcgcagtggctcatgcctgtaatcccaacactctgggaggctgaggtggacagatcacttgaactcttgggctcaagcaatctgcccaccttggcctcccaaagngcctggcctcactcccctttttttaaccacacaatttgttcaagggtatgttcttgtacaagattcaaggggtgcagaagtaaaacatggaaattcgccctccccagagctcacctctgtggccagcggggtgcagacttccagccctctgcgtgctcatggtcgtaacatgtgcacctaaacacacgtgtttgtgaaacattgtcctgccgtggggaacgcaatgggcacttccagggcgctgtgcccctgccaggctggaatcttgggcccctcttgttcacatacagatacacccctgatgcctgatgtccagtgaggaaccaaggctgcggggaagggtggccccaccttcctcttgttatcaggcctcagacacactaggaggatggaggcgagttctctcagctgcccatcccactgaggggtgcccggcgtcagtgtcttgtctgcacttacgtcccagaacctctagagcttgcccccaggngggcactgctgggagggtgcgagcaccgctgcggcaccagaggccggttcttggctgatcttctggggctgggactgcctgaggtggtggggacaggtgtgggctgggcctgtggggggtgctagggcaacggacctacacaggcgccgaaactggaagtctcaggcactgggtcacatagtgatgaccattgttgtaataccgccttcgtctaataactaccggaatttccaaatgcctggccaagaaaatttggagtttaaaatcttgtctccgggatgagaaagcgagtggagtttgaaatcccaa

SEQ ID NO: 701494 - DNA, 945 bp, Homo sapiens
  misc_feature (146)..(146): n is a, c, g, or t
  misc_feature (636)..(636): n is a, c, g, or t
ctgctccgcccctctctgcctcccaaagtgctgggattacaggcgtgagccaccacgcctggccggagacggggtttcactatgttaccctggttggtcttgaactcttgggctcaagcaatctgcccaccttggcctcccaaagngcctggcctcactcccctttttttaaccacacaatttgttcaagggtatgttcttgtacaagattcaaggggtgcagaagtaaaacatggaaattcgccctccccagagctcacctctgtggccagcggggtgcagacttccagccctctgcgtgctcatggtcgtaacatgtgcacctaaacacacgtgtttgtgaaacattgtcctgccgtggggaacgcaatgggcacttccagggcgctgtgcccctgccaggctggaatcttgggcccctcttgttcacatacagatacacccctgatgcctgatgtccagtgaggaaccaaggctgcggggaagggtggccccaccttcctcttgttatcaggcctcagacacactaggaggatggaggcgagttctctcagctgcccatcccactgaggggtgcccggcgtcagtgtcttgtctgcacttacgtcccagaacctctagagcttgcccccaggngggcactgctgggagggtgcgagcaccgctgcggcaccagaggccggttcttggctgatcttctggggctgggactgcctgaggtggtggggacaggtgtgggctgggcctgtggggggtgctagggcaacggacctacacaggcgccgaaactggaagtctcaggcactgggtcacatagtgatgaccattgttgtaataccgccttcgtctaataactaccggaatttccaaatgcctggccaagaaaatttggagtttaaaatcttgtctccgggatgagaaagcgagtggagtttgaaatcccaa

SEQ ID NO: 701495 - DNA, 588 bp, Homo sapiens
  misc_feature (109)..(110): n is a, c, g, or t
  misc_feature (113)..(113): n is a, c, g, or t
  misc_feature (121)..(123): n is a, c, g, or t
  misc_feature (137)..(137): n is a, c, g, or t
  misc_feature (152)..(152): n is a, c, g, or t
  misc_feature (158)..(158): n is a, c, g, or t
  misc_feature (160)..(160): n is a, c, g, or t
  misc_feature (163)..(163): n is a, c, g, or t
  misc_feature (172)..(172): n is a, c, g, or t
  misc_feature (185)..(185): n is a, c, g, or t
  misc_feature (205)..(205): n is a, c, g, or t
  misc_feature (209)..(209): n is a, c, g, or t
  misc_feature (216)..(216): n is a, c, g, or t
  misc_feature (230)..(230): n is a, c, g, or t
  misc_feature (248)..(248): n is a, c, g, or t
  misc_feature (262)..(262): n is a, c, g, or t
  misc_feature (278)..(278): n is a, c, g, or t
  misc_feature (312)..(312): n is a, c, g, or t
ggctccacttgactgcagggtgtgtgacgtgagaggaaaagattgatctccgttctgggtaaaaaggtggcaagaggccctaaattcttggagtctgggagagctgccnntgntgatatgnnncctggaagccatgngtgttgagagctttncagacnanccncctttgggncgctttgctgttngtgatattaaacaaacgttncggngggggtnatcaaaacagtggncaaaaaggctgctggagntggcaaggtccccnagtttgcccagaaagntcagaagggtaaatgaatattatccctaaaaccngcccccccccttttaatcagtgggggaagaacggtttcagaactgtttggttcaattggccctttaagtttaggagtaaaagactgggtaatgataacaatggctcgttaaaccttccaaaggaaaggagaatgttttgtgggcccccttgggttttttttttggggggggcaggtttaaggtattaggttttaaaaacaggactttttaatgggaaccacttggcccaaaatttgtcccagaatttttgggcccctttaaaaaggttaatgggga

SEQ ID NO: 701496 - DNA, 1053 bp, Homo sapiens
ggtcttgcttgcctcaaatccaagcagtcttgaacacttggaggcaattaatgagtatatcttagtcaaaagaattgttggagctttttattaaagctgcagtttcagttctgctttggggaatgtgctatgaaagcagctgccaaaataagctcatttattttcttcaatcccactcagtgctcagtcactatattctgtttccttttttttttttccaagtggctttattgggttcccccttatgatggggaaagatgattttccagcagaaaacagggttggtccactttcaaagagtgatagtttctaaaacttttagagcaataaatattcatcagaggtcccaagtaagccagcagaagagttacgggttagagaaatcccttattccatgtctggactctaaatggatcaaggtactttccctgtgtaagggggattcttctaatggggatatgcaaaaacttcagttatacgtagtaagtgctagcaggtaatttcaggggcctttcttataacaacgtgtcacttgtgtttgtgccacattgtcgagttggtccagctatttccaaatatttccccaaaaaagggggcaaagggtaccaagctttccaatgagcattaaccctatttaactgggcgcaccgcatgtttgaacgaactcctattaaatcaggtcccatttggcactaagggttggaccttaacccacccattggggagaattggggacggcaagtttttaaggaaaatctcgttaggcttagtaggagtaccccctcatgtgggagcttgggtacttccaactacgctttgaaacgcggcttgggtgcggctattaaaaagcgctagggtgagaatgggcggacaatgggtcgtagactccatatacgcaaagaaaggggcagaacacacttcgtctttttccacgagacaccacacgcgatatggtggtacaccccacattgtagaagacgacagttgatcgcccttgataatacaccgtgcgttgtctctgagggcaacccactctatcacagggggtggcgc

SEQ ID NO: 701497 - DNA, 778 bp, Homo sapiens
gacatttgtctctgaaggaagagaatgaactcagccctagtctgacagtcctagattttgctgtgacatagagagtagttcttcaagcattatgtgctcacacgtcacataccagtgagggttctctgcaggggtataggggttatcgtgaattcgaaagtttatttcaaggcctcttttggggtagaaacaattgaagaggcagatgagcaacagagtctggcaagattagctggtccagattaacgaatattaaggaggctggtgaaaagttagcttgtagaagatggacgttatccttaagtttgaatagagttaggaaatcctagaaatggttaggcttcctgcacaagtggctatgttcatttaatggctagtgaaccatgggaatgtattttaatcctcctagctggtggtacgtgttgggctaaacgagactagaagtgatttgagaggggcgaagagaataggcaggacattccttctatagctttacatattgtagaatgttaatacttaagtgacgattgaagttacctgtgcagatgatagagtaagaggcattattagtatcagtgaggggaatagggaggataggatgcgggccttcttcaggcagatcttgctccgaggacatgagattctatgtgtgataggtgggaagacagaaaggactcggaagaagaattgggcatatgcctacagagcataagatctgtggaactagaatggttttactttgtgaagctgctatttaacggaaagattggatatacag

SEQ ID NO: 701498 - DNA, 1001 bp, Homo sapiens
gcgcggagcaaagcgctgtcactgtggaaaggggagcaagctcggtgaaggcccagtcgtagaccggacaccgaggcgtgcaggaagacccggcttctcgggtctgcagagggtcgggggcggtagcggtgtccttccgtgaaaggggacagtgtcgcgcttgtgcttccctggtggtagctccaggctaccctgaggttcggagattcttaatttcgacacttggtatattatatccccccaaaatgtgaacaaggatcactgttgcgacaccgtgttatacccttttctaactttaagggtcaggcggtaggctggctcgttggacacttattcttctctccgcggcacattggcgctcttgtgtagtgcgtgttgtacgggtccattcccaggcgactggttgacaaggcttcaagaaagaccatcaggcagggcccttgttcctgagaaacttgaccatttcttcctcacacaagccaacatgtgtcattactcatagctggttttaccgcaattcattaggtcattccccaataaagtgtgtcacctttgaagttgattacacaattactgggggagacggactcagaattgtaaaggcaggcaacggcccccttcctgtagggaaactccagcgccaaccacttgagattacgcacatgtgacttggctgcaaaaggtggacttttccacctctggtgggcgactgtcaggtgcatccaagcctgttgcttcatgtggtgaccgaaacattctgttatcaggaagtggaacctcgccaatttggatcatgggcagatttgatcaggttcgccaatgagtcattgatgaagatttgtgagaatgatccaacctttggctaataaggagatccgttggaaataacacataagaagtatcacaatgagcaaagatagataaaaaaaaagggggttcaaaataacaggagagaagaacgttttagtaggagcagagagtgataaaaaagagcgaggaat

SEQ ID NO: 701499 - DNA, 530 bp, Homo sapiens
ttcaagccgattcttgaggatacccgctttggatccgtcctattgtgaacaactggtttctgttgagcttggaaccacacatgttccggttgttcagaagaaacgttcccacacacaatggaagtgtcaagagcagccggggtgggtcagtactcttcctgctgcgggggctgctgttcgtgggcttgctcctctgctaccggctcttctgtgtggccctcgtgttctgctgaagcatacaggatgtccattagtctctgcacgaggtcatcattttcctgcccgtgttcttggcagagtagctcgatctctctcaacttcccaaagtagaaatccctttccttttccacgccttcaagggcaagttttaatgaatgtacctgttcattaagctgtatgacctgcgtttctaaatctttatcggatttggatgctgagccactgaaagaagcccttttggctgatgagggtcgagaaggtgtggatccctggtttagctgctggacttgatttagctgcacctgctgtgg

SEQ ID NO: 701500 - DNA, 138 bp, Homo sapiens
tggtccgtcgtttacaacgtttgtgactgtgacgacctggtgaggcaggagatggcttgagccaagaggttgagactgcagtgagccaggatcatgccactgtactccaacctgggtgaaagagtgagatcttgtctc

SEQ ID NO: 701501 - DNA, 342 bp, Homo sapiens
aaaagaaacaaccgattgaaaacataaccattacaggagctgggacacttaacagatgcaaatgtgctactgattgttatcatagcagaatctttattatagacataaaatttactactctttttgttttttgtgttttgttctttaaagtcaggtccaatatgtaaaaacagcattgctttctgaaattagggcccaattaataatcagcaagaattagatcgttccagttcccacttggaggcctttcatccctcgggtgtgctatggatggcttctaacaaaaactacacatatgtattcctgatcgccaacctttcccccacaacttctaaggttaag

SEQ ID NO: 701502 - DNA, 142 bp, Homo sapiens
attatgttatagcccatatgattatcaatgatgagtatggattggaagtattggttatggtcatggtccggagagtatatcgtgaagaggatagctattagaaggattatggcatgcggttcgcttgcgtgaggaaatactt

SEQ ID NO: 701503 - DNA, 209 bp, Homo sapiens
acacgggggaagttgtgagtgtatatagatgtaataatgattataacaccgggggaagttgtgagtgtatatagatgtaatgatgattgtaacaccgggggaagttgtgagtgtatatagatgtaatgatgattataacaccgggggaagttgtgagtgtatatagatgtaatgatgattataacaccgggggaagttgtgagtgtata

SEQ ID NO: 701504 - DNA, 1058 bp, Homo sapiens
  misc_feature (225)..(227): n is a, c, g, or t
  misc_feature (382)..(382): n is a, c, g, or t
  misc_feature (1047)..(1047): n is a, c, g, or t
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccccccccaaatttgggttannnttcccctaaaaaaaaaaggggacaaaggcccaagtttgggttttacaagaggaagtactcagccgctaaatccaaggttgaaaagaacaaagaaggagaaggttctcgcaactgttacaaaaccagttggtggtgacaagaacggcggtaccggntttaaaaccccccccccgggagggcgggctttggcgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgacctggggaaccccttccttgggggggtttccccctttccatggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 701505 - DNA, 1017 bp, Homo sapiens
cgccccggggctccttctgtggcgtcgcccccctctctggccccgtggtccccagtgtacccgatcgcctcgcccctcgctctcgtatcgcttgtctcgtcggatcctcgtccttggcgcggttctccgctcttccgcgcttctgtggcggccgctctccaccttggtccgaacccatttcctaagtggcccctattcgtgcgcctcgtacgcttgctatgacccatatcctcccacagggcataccttgggatgcttctttcgcgaccacgacgatgctcgtgtccaatgtctcgtcgtgccttggatcggggccatggaagcggtcagctgcttgcagcggatctcatgcgtggtcacatcgccgagaccttgagatggacggcagccttggatcgcagggtccacgagccctgcggtccggttggagtcgccctggaccgggtccatgcacggtgctgtcgctggagtgcctggtgttgtcctccggaatgctggttgccggaactctgctatcccctggttgtctacctgcctgcggggcacctgaccatgctgagatgatacgcagcacaagctgctgcgacggaggcgaatggagtcgtcagaccctgattggggccgctcgatgtctggtgggcagcctcattggagcagtagtgtccccgtggcaaggtagcgcaagcaccatgtacgtgccgcacacctgggctcctggggaacagctgggtgcagaaggtagtcacctggctatgggtcttgctggacgagtgctggcctagagctgggggaggacacttcccaacagtgtgttgggagccgcaaggcccaggtccgcatgtgtgcactatatgcctccctggcactgctatcaggactgagccaggagcaccaatagcatgtgcccgggcatggcctggcagctctccatgacagggcagagtgtttgcccaccaagctgctagccctaggaaggtccaggagctcataatatcgatgtggccagtctgtagcgcc

SEQ ID NO: 701506 - DNA, 859 bp, Homo sapiens
atgtgctactgtcttgtgtacctcctttcaattttggcctgctctgtgtgtctccgttatttactgcgggtcattgggaccccgtggtttccccaaatgggccggcgcctcattgtgggaccggccccttccccgggaagccccattcccctttcggcccaattaaggcacattttttcttgggacacacccagttgaccattgggcagtacacatagttggcaacctaaacagcgttggacacccccgggggacaaaataatgccggggggaaccaaacaattagcccgccaactatatggtgacggaaaacacagcctgaaccaggggggaaccaagtgtcagcagccaaatgggggacaaagtggcaaatgagtcccgcgcgtaagcccggaccccgcgagccgcgggcccgctgcggagaataatgcgtggctcatatcctccgcgctccgtggaacaaccaacggacatggacacatgttcagagcccccgccacagtgcaagcacctcatcaaaaagctgtcgccaggaaaaaatcaggaggccccatttgttccgtctcataaacaacaatgtgccccactcgtccgtgccagagtatttgagaaaatcattatagctctccccgagaagcgagagtttatcggtgagaagagcacccaacccacagtattggtgaccccttctgtagaaaaatttgtatttcccgctgagcattttctcccaaagtcgagtattggaggaacgcagatctccacaaatagcggccatggggcgagtaatatcttcggccttcgtttcaaacacctcttttttttccccgaaaaaacaaacaccttttcatcaaaaataaca

SEQ ID NO: 701507 - DNA, 519 bp, Homo sapiens
ctgggctcctcggggcgcgccccaggtggtccgaagcccggtccgccctccacgcaggtgccccgcgctccccgctcagccatgtctgtcctacatgcctgcgtggctgctggtgacctggggccaacaggtggcatctggcgttggcccatcgctgctgcgaacttgtgtccgacatgttctcctgcgcgcgactgggtcgcgttgcatccacctggctgctggtgacctgttgtgctgctgtgtgtgcccattgggccgtggccctgttgcccagggccaggcctttgcccactgtggcctgcggaaccgtggtgcccccattagactgatccccgccagacctggcccgttttccccccgaagccccggataagcctttagggaggaacccgaggttttccgtagaacctcctcggaaaccggtttatttcggcccaaatgtggaagacgggcccaaagtttcacccgatgggcgccggcccaccacccggtttttggcccgaggcccctggcgat

SEQ ID NO: 701508 - DNA, 103 bp, Homo sapiens
aaaccctcagggggggggggtttcccccctcctagggggttcaaccagggtttgtgaggaaagccctcaaaaggggtttaaaaaaaaaaattttttttagcca

SEQ ID NO: 701509 - DNA, 1372 bp, Homo sapiens
  misc_feature (484)..(484): n is a, c, g, or t
  misc_feature (1328)..(1328): n is a, c, g, or t
tctcttttaatttttttaatggggtctcaaaattcctgtgacaaatttgtgtggctcaggttgtgtttcccatttaaaagttgttacgtgattttacaaaacttaattaactttaaaagctgtgccagcacgcataaaagagaaacaccaaagtgggctccccaagaacatttctctccttttccttctcgtgagaggctttacggaagcgccattgtgttattccaattatacaccaagtctcttttacactatactataacactttaagagtgcgcccaattgtgaacaccaacacagagtgtttcttgtagacaccgggtccttttcacaccccacgtgtatttaaagaagtgtggggtgtggcagaggtatattgaggggtataatattatctcctatttgacgcccttctctgtggagacttatctctgtggggcgagacctttgtggtgtgcatctgtgtgctcaagacctcccgagncagagccctttttctgttgttccccagctgtgcttgtgtggtagtgaaccccccccccacgcgcgaaactgtgctcgtgttcctcctatatatttagcgaaaaccaagggacaaagaggcgggaaaccccagagagtggttgggcaatagagatccgtgaagaaaaagctccttctcccaaacacaccaatcttgttgttgggtcctgtgcccccgagggaaaacccccctatatttatttcgacagcgaagtggggggacagctacttattaccaaccgagaaaatctttcccagagaaatattcttatgggcgcgccccgactacttctccccaagctcgttttttatacccccgagaaacagcgggggcgaaaatcaacaatccgtttttccacttctaaaagctcaccaagaccaaacaatcttttgcccatgtgtccaaaatgtgttttgaagcccccgggtgtgttgggcacaaaattaccccaaatatatcaccgcaggggggggccaaatttatggacacagggggagcaccataataattattagggggacccccgagcgaagatgtgcgttcgccgaaggagaaataattccacaccctgtgtgaaacactgatgtgataaagccccagagtggtgtatcacacagtgggagggcggcgacatacatatgagcaaccggagtccacccaagcacaaacgattgtttgcccacgaccacagaacacattcctctgtgagaagaaaaacacttatttttggtcatctttgtggacccccatgttttgttccccacggaagaagaattttctccacaaggagacgtccatgggtggnactttcgtcaacgagatatatatatcccagatgagtagaaatac

SEQ ID NO: 701510 - DNA, 232 bp, Homo sapiens
tcgggctctactagccctattcacgttcttggggaagaggaatgcatcaacttcaatttcctatttctataataccgggagtattgtggggaggggtcccacagaagggcagcgtgctgaagcgccggctggtgaagctggtggtgaatttcctcttctactagaaatacaaaattagccaggtagtggtggcaggcgcctgtaatcccagctactcgggaggctgaggtgg

SEQ ID NO: 701511 - DNA, 339 bp, Homo sapiens
caggacgtagagcttattgctttggagtggggggatgttgactgggttggcggatctattcgcattgttcgcgccaagacgcgagcgggaatgcgcatagatcctgaagacgcgagtgtcagacggacggtgaagttgttgaagcctgcgctggatgcactgacccagcaaaaggccataacgtttttggccggcgggcggatatacatgaaccctcatagtggccagccatgtgaagagtctggccgcatccgtaaaatactttggctgccagccatgaagaagtccaggagtgcgctgccggcggcccaataccaaaaatcgcaaaacctacgcctc

SEQ ID NO: 701512 - DNA, 153 bp, Homo sapiens
atatttacgtattgtaaccgattagtatcactaaatgattagaaataaaggtaagaggtacacaataagttccatataagagaaagcaacaatacgtgaaataaaatcttgggtttatggtcaaacacttccctattagagacaaagtgtact

SEQ ID NO: 701513 - DNA, 924 bp, Homo sapiens
ctcctcggtctgccccctcattaaaattcacgttcccaaaaaaaaaaaaaaaaaaaaaaaaaaaaaggggaaaaaaaaaaaaaaaaaaaaaaaaaaaatttggggggggcccggcccagagaaaagagttttaacaaacccatggcgtgggggcgccgggcgcccccagagtgagtataggagcgacacgagtggtcaaatggagttggtaccccagagagacaactcggggaacagaaacacgtgggcggtgggattctccccacacaaaaaaacagcgccgcggggcggagaccgagcggtgtgtgcgaaaaccaacactcacagggagggaagtgctgaggagacaagaggcgggttcaccacacaagggggtgtcaccagagaggcgcagactgactactacaaaaatataggagccccgcgcgggggggagtacagcaagctgacgacacaatgagagcagatacatacacgagaccaacgaacgatcgacagaagagcgcaggagagaagcaacatagagagacggaaaacagcacgaagcgtgggaatagcgtgcacgaggagagccaggaagagaacagacagactacgagtaccagtacagagcaggcagcggaagagaggcaggacgagcggagacgagccgagggagagagacagcgccaagacgacgggaacgagcgacaagagagtacgagtgacgacagcagacgacgactgcagcgaaagagagcacagcgacgagacatggcgagacgcggcgagcgagcagaaagaccagacggactgtagcaggaagagcaggatcagagcacaacgcagacgacgaccggtcagcagagagcgtacgggagctaggcgcgacgacatagacgacaagtgcaacacagagacacaaccagcagacagccgacgaga

SEQ ID NO: 701514 - DNA, 137 bp, Homo sapiens
ttttattttactcaacattcaataaagttctttttaacacacgccggctccgtcactgacctccctcaggactgggcaggaggaaaccccagggggcatctctgtccttgtcctcacttcagcagacaactcaacct

SEQ ID NO: 701515 - DNA, 364 bp, Homo sapiens
aagatgagtagactgaaaactgttggaggctgtgctgcagggctggggtacgtaggaccgtatgggctgtgaggtcagcaaaatgaaacagttcatgctgggggacaacgtagagtaatttcaatgagctaaaaaaaaaagagttgggggcttgctgagtggctgaaacgcttgctgccaaggctgacaccctgagttcgaatcctgggacccatatggtagaagcagagatccaactcctacatgctgtcctctgacctacgtacacataggtgctatagcatgcacacatccacacctatacatgcataccccaaacaaataaatgtaataaaaataattttcttttttttttcactttaac

SEQ ID NO: 701516 - DNA, 137 bp, Homo sapiens
ggactatcaagatgtctctcagtcataccataggagaatgaaagcgactcactgctccccatgcaagaaagtgctgtcgagctccagtggaggtcccatcacaagcacgaggacaagcacatgacttgcttgtaaag

SEQ ID NO: 701517 - DNA, 510 bp, Homo sapiens
  misc_feature (510)..(510): n is a, c, g, or t
tagctgcaggagcttttattttattttatttttccatatcccagtggcacctggaacgccagcgagacagaactgttcactcccctggaaagggggcctgaagccagggagccaagtggtctggctcggcggttcccacccccatggagcccaggaaagtaagatccactggtttgaaattctcgcttccagcacagcagcaatctgagatccacctgggacggtggcgcttggtagggggaggggcgtccgccgttgctgaggcttgagcaggcggttttaccaccacagtgtaagcaaagctgctgggaagttcaaactgggtggagcccattgcagctcaacaaggctgccgtgttcaaactgcgagattgctcctccctggacagggcatctctgtaaaaaaggcagcagcccagtcaggcttgtagcagacttaaacgtccctgcctgatggctctgaagacagcagcggatctcccaacacagcatgcgagcctgctaagggcn

SEQ ID NO: 701518 - DNA, 864 bp, Homo sapiens
  misc_feature (4)..(4): n is a, c, g, or t
  misc_feature (61)..(61): n is a, c, g, or t
  misc_feature (75)..(75): n is a, c, g, or t
  misc_feature (91)..(91): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (111)..(111): n is a, c, g, or t
  misc_feature (118)..(118): n is a, c, g, or t
  misc_feature (128)..(128): n is a, c, g, or t
  misc_feature (137)..(137): n is a, c, g, or t
  misc_feature (140)..(140): n is a, c, g, or t
  misc_feature (179)..(179): n is a, c, g, or t
  misc_feature (188)..(188): n is a, c, g, or t
  misc_feature (190)..(190): n is a, c, g, or t
  misc_feature (217)..(217): n is a, c, g, or t
  misc_feature (251)..(251): n is a, c, g, or t
  misc_feature (278)..(278): n is a, c, g, or t
  misc_feature (291)..(291): n is a, c, g, or t
  misc_feature (293)..(293): n is a, c, g, or t
  misc_feature (506)..(506): n is a, c, g, or t
  misc_feature (570)..(570): n is a, c, g, or t
  misc_feature (657)..(657): n is a, c, g, or t
  misc_feature (681)..(681): n is a, c, g, or t
  misc_feature (696)..(696): n is a, c, g, or t
  misc_feature (769)..(769): n is a, c, g, or t
  misc_feature (771)..(771): n is a, c, g, or t
  misc_feature (778)..(778): n is a, c, g, or t
  misc_feature (782)..(784): n is a, c, g, or t
  misc_feature (855)..(855): n is a, c, g, or t
tttnttcttattacaaaaatgtattaaataatgcagtttctggtgttactttgttgcatcntgccttccaccccnttgacaatcacaaaantattctccacnangntggcntattgcnttatcctcanttttatcangantgggtaaactgaggcaccaaggtagatagttgcactaantggttacanantgcagtggctcttgggagttgcccttntctgcctggccgtggtgggttgtggtggggaaangggctcagggcaggaccacggcataantgggaaacatctnancaggagatgggaaagtctagaagggaagacactcaaagtctggaagggaaaagtctttgggtgaggcagagattccactgccagctttagaggtgggtagaagaaaggccagttctggtgaggaagccctgatctggaggcctagtcggagacttcgctgtagtaatacttgtgggcagctggcgttgtcttccagccggccgcccggaactnaatgatctccagcagcagcagctgggccagggagctgaggccagttgggagcaggaagccatcncggatcagcacaaagagctcatccatgcgctgcccattcattttctccagctgctccccaacccggtgcagctgcagcaccaaacantccacctcctcctccttgctcaanctgtctggctgggcngccggaagaggcagtcatagacagggttcaccagggccatcatgggcatgttgttccccctccggtcgtcccngntgttgcngatnnnggtgacatagcagacccagccctgcagggagcgtgctcgcagctgctcccgagcctggtactcctgctgcngccggttgc

SEQ ID NO: 701519 - DNA, 109 bp, Homo sapiens
tgctcctgccaagtgtcttccctgatatgtgctgaggttgttgcttctctcccctagaaatcggaggagagactccacactgaggtagtgtttcttctcctccatgctt

SEQ ID NO: 701520 - DNA, 381 bp, Homo sapiens
  misc_feature (226)..(226): n is a, c, g, or t
  misc_feature (229)..(229): n is a, c, g, or t
  misc_feature (232)..(232): n is a, c, g, or t
  misc_feature (242)..(242): n is a, c, g, or t
  misc_feature (260)..(260): n is a, c, g, or t
  misc_feature (335)..(335): n is a, c, g, or t
  misc_feature (348)..(348): n is a, c, g, or t
tgtagagactcctcagaatctcggtactgcaacatgctgttggaggacctgagatgcaaccttgaccactttttggagaatgttcattctcccttgcttttggagatgcccgcccacttcttcgatgccaccggcatcccgttaaggccttggccgttctccaatgttcatggtaatcacttcgtgcagtgtgcagaacagctgtcactgtgtcatccgacatggnctngcnttgcagtgtngtgctgttgttccctccnggaagcctgtggactaggtctcgcatggcgtatttgccgatgagctccttatttctgacgtccaaggccatgttncgcagcgcagtgncaccgcgcacaccacaggtcattgtctattacg

SEQ ID NO: 701521 - DNA, 117 bp, Homo sapiens
tccagctggccccaaggcctgacgtatatactgtaaatgaaacttggttggggtcaagcttccttctttctaacccccagacttgggcctctgagtgaaatgtctctcttggcccgg

SEQ ID NO: 701522 - DNA, 555 bp, Homo sapiens
ccaggcgtcggaaaagagtacaatattggtgtcctaagacaccttcaggtacatcttaggtcatttacgctgctatctcgactgtcaatactatgtgcccagaggatattggaaacagaatcaggctttggggtgagccatagtaatctgcgtgaacaacacgatgcttaaaatataattcatggtggatatgtttacgatgaacgctttacacagctttagggacatccagctatgctaagtaaagtcttaggcggttcctttgctgatcagaagatctgccaaggctgcccacataggtacgaatgtgaagacatcttttacgaccctaacacgtagacacttagaaaatcaccaaaatcttcttgattcttatggaacagtctgtcacaaggagatttactagaaggtgcaaatgcactatcaatatgtgaccacatgccaataaacacggttgataccagttaatagcgctatgactgattacaagaacataccctcctgatcattgctataccacctaaagcgaattgactactgactggggaaagagca

SEQ ID NO: 701523 - DNA, 764 bp, Homo sapiens
  misc_feature (496)..(496): n is a, c, g, or t
  misc_feature (527)..(528): n is a, c, g, or t
  misc_feature (624)..(624): n is a, c, g, or t
  misc_feature (634)..(634): n is a, c, g, or t
  misc_feature (641)..(641): n is a, c, g, or t
  misc_feature (648)..(648): n is a, c, g, or t
  misc_feature (662)..(662): n is a, c, g, or t
gggtgtggtggctcacgcttgtaatcccagcactttggaaggccgaggtgggcagatcactggaggtcaggagttcgagaccagcctggccaacatggcgaaatcccatctctactaacaatacaaaaattcgccgggcatggtggcaggcacctgtagttccagctactctggaggctgaggcaagagaactgcttgaacccgggaggcagaggttgcaatgagccaagattgtgccactgcaccccagcctgggcgacaagacctcaaggcaggtcctttaggaggtattccagaagaaggctttgttaccttaggagaggcagcttcctgcatgttactgcctgtgaagacattcagtgggacaagatgtggaggtggaagacagtgatattaatgatcttgaccttgtgtaggcctaggctaacatgtgtgtttgtgtcttagtttttaacaaaaaagtttgaaaagtaaacaaacaaacaaaaaaccacanaattttaaaaataggagcttacaaaggccgnntgcggtggctcatgcctgtaatcccagcattctgggaggatgaggtgggcagatcactcgaggtcaggagttccagacctgcctggccaacatggngccccgtctncactaanactacanacattaggcctggnagtgtcgggggtgcctgtaatcccagctacttgggagcgtgaggcaggagaatcacttgaacctcgggccgagggttgcaggagccgagatgaggccattgc

SEQ ID NO: 701524 - DNA, 180 bp, Homo sapiens
ccacctgagtccaaaagctactaaaaggactggtgtaattttaaataaaaactaaggcagagaggctttgggcaagagttagaagaattgggaaggccttaaatataggtagcttagtaatgaaaaatgtgaagtgacctttcgtaacggacgtcatcccaagatccaagagtaattcac

SEQ ID NO: 701525 - DNA, 222 bp, Homo sapiens
gaccagtcctgtgggagcacaataactgcggtgtcgcgagacataaaccgctctatgaggcaggctacaggcgacctgccaggctgggattgctgcgcatgtcagacagttcaccaaatgtgctgtctagcagccgcaggctctcccctaccaagtcgaacaaccgctgagcctcctcccggccctcgtgattgttattgtagtccgtggtggcagcagcac

SEQ ID NO: 701526 - DNA, 514 bp, Homo sapiens
tcgtgtgtaccaccgactctcacactcgacttacgttactggatacatcatattgccacaaaaagtgggaaaactgtggccaattttagacatcatttcactgacaaacacaaaaaagcatctatcatccatccttggcctcttccaattcgggaactcaacacaccactacatctttattgccctggccttaaaacactagtgctatgtctcgggcacacacgggttggctgggtcagtgggaatggtacctctggtagcaccactcttcaatactctggccctccttcggtgggagcctctaagaagcaaaggcttctcaagggtggatacagctcctacagatcaagggtcactaacctctacagacatgggagccctggaagtctggtatttagggccaagctcccttcaagcaaattcttcaccccacactcaggatcatacaaagttctttgggcaaataacactcttctcccctctcggtcctttctgagtagtgacaaccagcccc

SEQ ID NO: 701527 - DNA, 293 bp, Homo sapiens
  misc_feature (3)..(3): n is a, c, g, or t
  misc_feature (12)..(12): n is a, c, g, or t
  misc_feature (19)..(19): n is a, c, g, or t
  misc_feature (29)..(29): n is a, c, g, or t
  misc_feature (38)..(38): n is a, c, g, or t
  misc_feature (46)..(46): n is a, c, g, or t
  misc_feature (59)..(59): n is a, c, g, or t
  misc_feature (70)..(70): n is a, c, g, or t
  misc_feature (73)..(73): n is a, c, g, or t
  misc_feature (76)..(77): n is a, c, g, or t
  misc_feature (81)..(81): n is a, c, g, or t
  misc_feature (99)..(100): n is a, c, g, or t
  misc_feature (113)..(113): n is a, c, g, or t
  misc_feature (117)..(117): n is a, c, g, or t
  misc_feature (126)..(127): n is a, c, g, or t
  misc_feature (134)..(134): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (172)..(172): n is a, c, g, or t
  misc_feature (177)..(177): n is a, c, g, or t
  misc_feature (183)..(183): n is a, c, g, or t
  misc_feature (196)..(196): n is a, c, g, or t
  misc_feature (200)..(200): n is a, c, g, or t
  misc_feature (205)..(205): n is a, c, g, or t
  misc_feature (208)..(209): n is a, c, g, or t
  misc_feature (217)..(217): n is a, c, g, or t
  misc_feature (224)..(224): n is a, c, g, or t
  misc_feature (238)..(238): n is a, c, g, or t
  misc_feature (249)..(250): n is a, c, g, or t
  misc_feature (269)..(269): n is a, c, g, or t
  misc_feature (271)..(271): n is a, c, g, or t
  misc_feature (285)..(285): n is a, c, g, or t
canttatgggancagtaancacagtagtntgattatanctgggaanggatctacagttntacagctgtanccnccnnaaangccggtgaagaatgctanntttctaggctgancttntgttataannttaatantcagaaggcaagggttatgngnctnatgtgtccttttnttttncatttnttaattctgaatnttanttttnaannaaaatganttttttngaccttactaattntaatttgcaannttaaaaataaatgaaaaantncttaagtttctganccatccct

SEQ ID NO: 701528 - DNA, 129 bp, Homo sapiens
gattctagtattagagatcaggttcgtccttcaatgtcgtgtctggctatcacctgtcgtgaggttagtttgattagtcattgttgggtggtacttagtcggttgttgatgagatatttggaggtgggg

SEQ ID NO: 701529 - DNA, 332 bp, Homo sapiens
taggataattgtagattcacatgcagttgtaagaaataatacatagagatcccatgtactctctagccacattggcatagtagtgacattttgcaaaaatatgatgcaaaatcacaaccatgatattaacattaacacagtcaaaatataaaacaattccattaccacaaggatgccttctgttgtcctttcatagacacaaccaaactcctttcgcacccatccccaacttcaagtcctgacttcgggcaaccatttcataattttgtcatgtcaagaatcttatataaaggtattcacttgggacctatgggcattaattttctttgatg

SEQ ID NO: 701530 - DNA, 1454 bp, Homo sapiens
  misc_feature (1454)..(1454): n is a, c, g, or t
ggagaaactttcagttttttttttttgggtggtttggtctttgtacaaaattttattaaaggttctttagaaaagcaactattccagaacctccagaaattaccagctgtgccaaggaacacccgtgtttatgctggtggggacgtggcgtggggcatgtggcaggcggcttctgtggctttcccaccctttcgtgttcgggaatgcggggtggtgggcagatatctcattcttggggtttccacaagtgcctcacgtgtggctcaggcaggggcctctctatagggccaatctttaccaggtggggtctcccagggccagcatgtgactctttcacctgtaagtgcccagaaaacccgtgtgtcgtgaagcaaccaggtgtgtgccgcaacagcagttgtctcaaagcgatacagatagttaacacacaggggctcttccgacgtggtggatctcatttcaggggcccattccaaaaaactttcagtggattttatagccctctgatttcccctcggaggtttttccccaagaaacccacaaaccttctgcagcccttttgggccccccagttcttccattagagtgaacccggaagaaacacccatatagcagggccccttccggaaacaggcaaaagcccctcctataggaggttttgtgtaagcgacagaaggacctctgtgcccgtgggccacatgtgggccacaccagaaccctcttagtttggcccaacctctttttcccgacatttaaaagccttctaccaacttgccctttcttgggaaaaggccaaaaacctcttttcttgaaccttacgcggcagttcagattccccgaaatcccggcgcgggcccctttccctccacaaagaggaaaacactttctggggccttcactgaggtgggactacaagcagtaagtgaattccgtgctcccctgtgtatgggttttaactatcggtcacacctacaaattcccagaaagtatcgcccatttttcagcacaggacccccgaagttaagaaacactcattcgacgtacaacccttttagaatatttccccttcagtgaaaaagctgtcccctttcttgagggaatctttggccgtgcgcctatttgcagcgcggggtccgcaagaaaaccactatctctcgcaccaatggctgtgttctccccccagtggtaatgtgcttgcacccgaaacagggggcgccacttgtgcaaaaaagacacaacacgcggggtaaacagggctcctcttcgaacacaagtggttcgtgtcccccccttgtggcacaacaacagcccttttgctgagtaaaacgcctacaacagtacgtttgcgatcaaagtggtgcctacaaaacaagactgaccgccgttcaatgatgtagtactaccgcgtcacatcctactatctccaaatacatcatcttcttcctctcgagagn

SEQ ID NO: 701531 - DNA, 928 bp, Homo sapiens
agcggtgttgctggatgacgactggctgaatgctcggctcgcgaaggaaggaggcaggcatgttaagatagttgtcagctttcaggaggaaatgacgtggaaggaggattccgagaacgcgactatctcttatcttattggctgcattgggagttcagtggcaagacgaagtgggatgtgctcgaatggggtggttaggagggctgtgcaatagaatacatcattcgatgtcgacccagttgagtcagactagggctgaattcagacagctggttcttgactacgtgcgtcggagaagatcaacgcgcatgaaacacgttccgaaacacgcggaggctgcattgccatggtgggcgtactcatggttaggcacgacgaacatcgagtcaatcttcaggtggagctggtgcaagagagggctacgtcaattcacatagacgagactctgggaagctactagcttgggatgctcattggagttacactttgaatttgcccccaaaggctcccgatcactggccagaggggcttgatcgatgtacgcgcaattcgctgggcagttaggcaagaccaatccagatactgaggaaatccagtttatcatcgtgttggggacacacaccaaggtggtgtacttacatgggagataaataaccatgcgttcaccacatgtgtgccgagaccccgggccgtggttcgtgggaggttacttaatagagtctggcggttttcaggacagaaagggggcaccgtgcgcgaaggttttgggatgcaagaaactggggggcacttgtagtcggacccaacgcgtaagtacacccggttgtgtgagatccaaatttaaggttgcccaaaggcacagggcaaattgggcgggccccaggtataacccgtgaattcactaaatcccattggtgctggaaccaca

SEQ ID NO: 701532 - DNA, 288 bp, Homo sapiens
gcactctgcgttgtcttaagtcaccctgcattccatagccctgtgctaatccctgtgctctcacggtatcccagggccaggctgagagcacacagccatcccactatgccgcatgccgcctagccaccttcaggcagactatgggacgcagggctcccatctgtcccgtcggatcgccgtgtgaccagtagtggatccgtcatccccaacactcgtgctcgctcagacactttgataggatgtctgggtgccatcaccagcaggagcgcgttgcacgccgggccggcg

SEQ ID NO: 701533 - DNA, 124 bp, Homo sapiens
ggaaccggagctggaagcaggccaaagaagaggttcaggttgaaattgaacagtaccgcctgcagagggggaagatttcaaggccaaggaagctgcggcattgggttccgtgcagttgcagcac

SEQ ID NO: 701534 - DNA, 499 bp, Homo sapiens
gggtcggagggagagcggatatgtcgatatgaatatcaaggaaatcctcaagatatatatattatttagtgggatgaccctgtggatggggatgtgaattactttactgtggtttccaatctgtgaagtaggaagtgttgtattttaaagagcataaaacaaattcacaaaaggttaagtgattggctcaatgtcacatagctaataagagcactagacaggatgtgaacccagctagactgactccagaggctaagacattagcaactaaactatgctgactaatggttgtttatttttatgtcaccaaagtccaaacaggacagagtaagatgaggatggacaagccacagtgcaaatgcagaaggacctaaatgtgggaaattaatccagatagcaaatgatacctaggtcaaagagtctcggcactctctggtaaatatttttcccagaaggtttcaaacataattcaagtttatttaaaagtctaaatcagttt

SEQ ID NO: 701535 - DNA, 187 bp, Homo sapiens
gacatctggttggacggtaccacggacactgtgtcgttacggacagcctaccgaccgacaactacgtaccgttccttgttacgtactttacgaccttacggtggacttacctgagtgactactttctgacacgtctcaacctactacgaccaccagtctgctaacacacccctggtgtgaacaacgt

SEQ ID NO: 701536 - DNA, 710 bp, Homo sapiens
gatgggactaatacaagtatcgtttgccaaaacttctagagagcaatttcaacagaagctgataaaataatggagaaatacagacaacttcactgggccagatggagaacagacaatttggatgaactaaataaaagcaagatcatctgtttgatcacagatacccataacgaattaaactccgatgttcagtggtaaaagtagagtcatgaagttttaagacaaaggatatattggtggaatgatgatacgttttcagtctgcaatcggtgttggtccttgtgtcatagactatattacagaaagtggatgagctgtcactgagaagacaatcatctggggttcagactgaaaagacgtatctaaatgtcccactcttaagccctacataagagaatccagtagaacaagaaagtctttatctcattaggcaaggttcagtagatgagcagagtcatgccacctattcattggattgccttgacaattccgattggagcagatcaagcaaatattctggtggaagatgcaactattggtatagtcgataatagaattagctgatatcaagccaaggatcgtgaactattagaatatagcaatacgtaaatctctccattgatagacgatcatagttctcttgaacagcagacgttcagtctagttggactcgttcaaaccaggttctgtgaatacgtaagttagtaaaa

SEQ ID NO: 701537 - DNA, 877 bp, Homo sapiens
  misc_feature (169)..(169): n is a, c, g, or t
  misc_feature (218)..(218): n is a, c, g, or t
  misc_feature (220)..(220): n is a, c, g, or t
  misc_feature (229)..(229): n is a, c, g, or t
  misc_feature (231)..(232): n is a, c, g, or t
  misc_feature (235)..(235): n is a, c, g, or t
  misc_feature (243)..(243): n is a, c, g, or t
  misc_feature (258)..(259): n is a, c, g, or t
  misc_feature (274)..(274): n is a, c, g, or t
  misc_feature (283)..(283): n is a, c, g, or t
  misc_feature (335)..(335): n is a, c, g, or t
  misc_feature (407)..(407): n is a, c, g, or t
  misc_feature (423)..(423): n is a, c, g, or t
  misc_feature (426)..(426): n is a, c, g, or t
  misc_feature (439)..(439): n is a, c, g, or t
  misc_feature (445)..(445): n is a, c, g, or t
  misc_feature (451)..(451): n is a, c, g, or t
  misc_feature (489)..(490): n is a, c, g, or t
  misc_feature (500)..(500): n is a, c, g, or t
  misc_feature (602)..(602): n is a, c, g, or t
agcgggagtgggacagcgctggtgcggagactgcttccggactccaggtaccgcgcttggcggcagtggccccagacttctgtcttttcagctgcagtgaagctcggggctgcagaattgcaaccttgccaatggacctgatcggttgggttatgcagccctcgtgacntttggaagcattttgggatataacggagaggtggtgtcccgtctttgantngctggtctntnntgnggatgttnggccggctatggagnnttacccgtgtctccnatgacaaangagatgtacaccgtgtcacctgtgtttaagcctcatgatgatccctgagacnttgtcttgtggctgctctgagcatctggaggaaacagaaaaactaagttcatgtcatcctgctgtaatgggncagagcatattttttngtntttaaaagataancttcantatggnatgctagaaacacaaatagcatgtcacctctaatatgnnacattagttngaggtaggttttttctaaagcaaaaattttaactgtgtttctaattgtcaagcactattttcacttaaaaggtgtctaatgaatcatgatatactcttccanttgtggtgtcctcatacatatcatggctactgtgaaaatccaatcctcatgtctccaggtagctacctacactgtcacatcaggacgcctcagtggtccccgcaagcacatgtcccatccgccatcggttctctttgcaatcttcagaaatagcttcccatcatgttgcgccggccattttcttaaatttttgcccgctgcccgcagttccctcccacgattgggcgccaaaaacaaacctgtgggggcgaagaaacacggcgcagagaaattta

SEQ ID NO: 701538 - DNA, 682 bp, Homo sapiens
  misc_feature (278)..(278): n is a, c, g, or t
cgtatgggaccaaacggtaacgggcccggtgacaatgccacggggagccccaacggccacaatgccaaacagttcggccagccaaaaggcgaaaagctgctcccccagggtgcacccgagttcggcaatggcacttaacagcccaactctcgtcgcacgaaattcgcccaaaagcgcttacgccaccgaggcgcacaatcgggagccccagaacgcaacgtcccgtggcagagaaaacaacctctggagaccccgcccgtgtgcccggggctgcatgntgcaacaagtccaggcgaccccttgggcaaaataccgcgaaaatctgtttggaaagctacaaggacacctgcgctgaaacggctaaacggcggccagcacgggtcgggcaatcaaagggcccccgggtgggggcccagaaagaagacaccgcgtcaaaaaattggtatacacagctggtgcgaccaaggctttgagaaagaggggcttgacccctggatcttttgaaaccggtcaccgccctcatactgatcgagacaagttgggaagactcccgttcgcactccagcgaagcacctgtgtctataaaggcaaaatgttcccgagggggtccacatatggcagacgcttctgccgaagacaccttctgtcgcccggagaatgaccaaagagaccaaccatgaca

SEQ ID NO: 701539 - DNA, 981 bp, Homo sapiens
  misc_feature (169)..(169): n is a, c, g, or t
  misc_feature (218)..(218): n is a, c, g, or t
  misc_feature (220)..(220): n is a, c, g, or t
  misc_feature (229)..(229): n is a, c, g, or t
  misc_feature (231)..(232): n is a, c, g, or t
  misc_feature (235)..(235): n is a, c, g, or t
  misc_feature (243)..(243): n is a, c, g, or t
  misc_feature (258)..(259): n is a, c, g, or t
  misc_feature (274)..(274): n is a, c, g, or t
  misc_feature (283)..(283): n is a, c, g, or t
  misc_feature (439)..(439): n is a, c, g, or t
  misc_feature (511)..(511): n is a, c, g, or t
  misc_feature (527)..(527): n is a, c, g, or t
  misc_feature (530)..(530): n is a, c, g, or t
  misc_feature (543)..(543): n is a, c, g, or t
  misc_feature (549)..(549): n is a, c, g, or t
  misc_feature (555)..(555): n is a, c, g, or t
  misc_feature (593)..(594): n is a, c, g, or t
  misc_feature (604)..(604): n is a, c, g, or t
  misc_feature (706)..(706): n is a, c, g, or t
agcgggagtgggacagcgctggtgcggagactgcttccggactccaggtaccgcgcttggcggcagtggccccagacttctgtcttttcagctgcagtgaagctcggggctgcagaattgcaaccttgccaatggacctgatcggttgggttatgcagccctcgtgacntttggaagcattttgggatataacggagaggtggtgtcccgtctttgantngctggtctntnntgnggatgttnggccggctatggagnnttacccgtgtctccnatgacaaangagatgttgtaagtgtcgctgtgtacagcgtttcttccctgggctaccactaaatgggtgtgagaatttaacgaagggtccccagaaaaataattgccctggccggggtttgggtgcagcggtttaaagccctcactgagtggagtccctgagacnttgtcttgtggctgctctgagcatctggaggaaacagaaaaactaagttcatgtcatcctgctgtaatgggncagagcatattttttngtntttaaaagataancttcantatggnatgctagaaacacaaatagcatgtcacctctaatatgnnacattagttngaggtaggttttttctaaagcaaaaattttaactgtgtttctaattgtcaagcactattttcacttaaaaggtgtctaatgaatcatgatatactcttccanttgtggtgtcctcatacatatcatggctactgtgaaaatccaatcctcatgtctccaggtagctacctacactgtcacatcaggacgcctcagtggtccccgcaagcacatgtcccatccgccatcggttctctttgcaatcttcagaaatagcttcccatcatgttgcgccggccattttcttaaatttttgcccgctgcccgcagttccctcccacgattgggcgccaaaaacaaacctgtgggggcgaagaaacacggcgcagagaaattta

SEQ ID NO: 701540 - DNA, 259 bp, Homo sapiens
aaaaggaaaaaaaaaaaaaaaatcaaaaaactgctatataaatggagtcacacaggctgttaccttttgaaattggccttttttcactcagcataatgcccttgagttccagcaaagctgttgaatgtattaccagtttgttcctttttattttgtactccatggtatgtatggatgtaccacaatttgttaaccattcatttactaagggtcatttaatatttcaaaataaacctgctttaaacatttgcttgtaaaa

SEQ ID NO: 701541 - DNA, 399 bp, Homo sapiens
ggcaaagaacttactgattcttgagaaacagtagctcaagaacacatggatcctgggaactgaagcctatctgggccgggcgcagtggctgacgcctgtaatctcagcactgtgggaggctgaggtgggcggatcacttgaggtcaggagtttgagaccagcctggccaacctggtaaatccctgtctctactacaaaaaaattacccaggcatggtggcagtcacctgtaatcccagctactaaggaggctgaggcgagataattggagtaatcccagctatgaaggaggctgacgcggaggttgcagtgagccaagatttcgccactgcactccagcctgggcgacagagcaagactccatctcaaaaataaatttaaaataaaacaaagcctaaaa

SEQ ID NO: 701542 - DNA, 371 bp, Homo sapiens
gtaggtcgaggtgggagaatcacttgaacctgcgaggcggaggttgcagtgagcagagatcatgccattgcactccaacctgggcaacagagcaagactctgtctcagaaaaataaataataaataataaattaattaaataaataactcagaatcatggggctgaaggaggtggctcacatctgtaatcccagcaagttgggacaccaaggcaggcagatcacttgaagccaggcgttggagaccagcctggccaacacagtgaaaccctgtctctactaaaaatataaaaattagtcaggcatggtggcgcaagcctgtaatgccagctactccggaggctgaggcacgagaattgcttgaacctgggg

SEQ ID NO: 701543 - DNA, 1041 bp, Homo sapiens
aagagttcagtcgttgatctgtatgcaaatcggagtcccaagtgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatatttattttatttagatgaagtttattactcatgtgtggcccaggctggggtgtaatggcatgatctcaggtcactgcaacctccatcccgggttcaagcatttcttctgtctcagcctcccgaatagcggggattacaggcaccgtgccatcacaccagactaatttaggtataatgggtggagatggggtttcaccaggtggaccaggctggatgtgagctccgtgacctcaggtgatccaaccaactcggtctcccaaggtgctggggttacaggcctgagccagtgagcccggcccagggaaaatgtctgtgaaccacttctcacatcccggtcactttcaataaggggtctttgatgtcttcactgggttcttgggacggagggactttcgaactttaagggtgcaacaaacagtcagaaatatacttcacactgagactggagcgcaacaaagggaaacgagcaaagagaaaatgtcacaaacaatacatacctcccgggggacgacctccgaaggacaagacaggaaataacaccgggggtggaaccaataaagacttggatcacccatgggggggaccaaaaattggagggcacaacaaaacaggggaaggactaacagatcaccgatgaggcccgaagtaagaacacagatggtacagggcccatagaagacaaaaacacgaccggccaacacccgcgctgaaaagcaatgcaatgggaacactcgggtgacctggacacacagaagaaagcaaaaacggcgtaacacaggaggcgagtgtaacaacacatcgaaaacaaaatgaagagacgaaaag

SEQ ID NO: 701544 - DNA, 189 bp, Homo sapiens
agagccctctaagaaaaaatgtttttaagttacctgtgtgcaagactgaggtaggaggataacctgagcccaggaggctgagaccggactggtcaacatggtgaaaccttgtctctagcaaacatacaaaaattaaccggttgtgatagtgtgcacctgcagtcccagctactcaggaggctgaggtgg

SEQ ID NO: 701545 - DNA, 407 bp, Homo sapiens
gcaaggctcgtcgtagagatgccaagctacagtcatgccaagagcctgaagcaccaccatctcagcatgtggtccttatgcaagggagggcaaatgatttgatgaagtacctatgggctaaagaccatacgacgattcccatcaagcgctcggacatgctgaaggacatcatcaaagaatacactgatgtgcaccacgaaatcattgaacgagcatgctattccttgaagaaggtatttgggattcaattgaaggaaattgatcagaatgaccacttgtacagtttactcagcaccttagagcccactgatgcaggcatactgagaacgactaaggactcacccaagctgagtctgctgatggtgcttcttagcatcatattcatgtggtaggacagtgaggctgtc

SEQ ID NO: 701546 - DNA, 199 bp, Homo sapiens
ccatcacatatacacctgcctgtgtgctaaacattctgtactgttctttaggtgacttgctccctattagataaacaatatcatcaataaagtatactggtcagactgatcagatttcctaaagtcattgattaattacttcataactctgaatccggtctaaacaattcttcattgactcatatactccatcaatatc

SEQ ID NO: 701547 - DNA, 780 bp, Homo sapiens
gtgtgtgtgtgtgtgtgtgtgtgtgttggatctactaacatgtttagcaaatgtctctgacagtgtggccatgagcagatgagaccagctcttgcgttgggtggaaggccacactgcagttggcagtatagcctttggtgtctcagtgcgctcgttgcttattccatgctttctctctcccactctctctctcgtgtgcgccttccctgcaagtggcatgcctttgtgcacaagtgctgtgttgtgttcatcactcactttgcttatactcctggaaatgtgttgtgagtgagttaggagaatggatggtgctatattacatgtgctctctcattatcctgtcaaataacaagtggttggagcactcgtggtgtcccaagcacttctgtgtggtggagaggaattaagatcattagtaggatgctaaataagagggggtcctctatgttttcattacttgattaaagtgaattaatcaacccagaatagtgtgtatatgagtagttgtcaactaataatcacactactcatagtgtcattctgtggacaactttggtgtaataacacgaggtagttttggctacaaaatctctcttccgtgagtcataccatacaagcaatgacagtgctctcctgtccagtacaagcgtgggggaacatttagagtggaaactggtggggacacaccccccattatcttaattattataagacactacagacgcttagtgggggcctgccaacagagtgctagttactaaataacgtgaacacatacat

SEQ ID NO: 701548 - DNA, 1741 bp, Homo sapiens
  misc_feature (479)..(479): n is a, c, g, or t
  misc_feature (1003)..(1003): n is a, c, g, or t
  misc_feature (1040)..(1040): n is a, c, g, or t
  misc_feature (1068)..(1068): n is a, c, g, or t
gacctcttgattgtcatggtgggtacttgttacctgttccgctatcgagtcttggaagggagaagtgatggagaagtgttacttgtagagaaataccactacatctacactagatccgaagatattctaatctagaggcctcgacgtccacacgcacgggtgacccatggcctagcaggggggacttgattgcatggacctgtgtgtgcgtctctgcaaccacattgtagtgactggacctccattgtaaggagactctccttacgacactcgcgagtacgcaccataggctctactttactaccttgaaacaagagtcgcgagaggagtaaatacgtgtccgactcgttgctggcgcaactagagttacaggagggcccctcatgtcagggcgtcgctcctgttctgttcctcaccactagctgggtgaatcccttcgcaccgtgccgcgtacaccctttgctttacccttcccgaanccgcctctaataggcacactgcctcttggagtctcccttcacgcgtactcctccggtgtgcctagccaggcataggtaaaccacacaggcacactatgaccgctttcccccatttcccaaaggtgcgattggggaaggggtccaagaagggtggaccatttttggcctcacgagagtctgcgggcatgtgtgggttgctaagtgccatccccacttgtagtatctttttaccactcgacctagattgggtcttgtttccatggtccattttacgttttcgcttttcgacactggttaattagacatggcactttactatagaagtcgggggattgtccttgtacgatgtcccctttggcacacgttatgctacgtggcccataaggattatataaacatttacagcaacacatgttccccgacaaaggttccgtggcgtaggctgtccaaaggctggcggaaaaccttccatgcattgggcattgtacctccagcgccatcgccggtagatcaagggggctganaggaaattccttgttgtaacacatgacaccactttcncctatacttttatatccgattttgtgcnccaaacatccccctattaaaccgtaatacgcttcagcgcgtcctcattcaatttttggtcaaccctatgtgagccaatcttaaggcccgtttggcagattggttccgttcacacgttggaacctggacagggctgggggtcctgtcactttcatatagtgccaatatcccgcgttgcccaagcgccaatgtgggcccctgtctcttttaataacccgtcccaaggtgttggagagtcccacaacaacggccagtaacacattttaattttccccacaattcgccttgggcttcgcgcagatttaagaaaaccccccccgcgtggtgtgctacagatagcataattgagttcaatgcaggttcgcaaacaaccccccgtgggggtgtaggcggccactaccaccaacggcgttccgctggatgtccccccactgcgatcccgcccattaccacctggacgccccacaacaatttccacttttcaaaacagggcgtataacaggcaactgtacaccaagaggaacccctacagcagctggcactcacaagggtacaccacagcgggccgtcacccatagccatgcgccagcgcgctgtttgatgttgtcgcaacccattcggagaccatacgcgacatcgcgcagaccggcacccacaaccacaatagctgatgc

SEQ ID NO: 701549 - DNA, 202 bp, Homo sapiens
  misc_feature (26)..(26): n is a, c, g, or t
  misc_feature (32)..(32): n is a, c, g, or t
  misc_feature (130)..(130): n is a, c, g, or t
  misc_feature (156)..(156): n is a, c, g, or t
cagagaacagggaaacccgtgaaacnggagcngggagcagcaccgagggcaaccaggacagctgtgtgaagaagacctcatgtgttgggttctctcccctccttcctgttcctcttagagaccagtttanccccattctttttttttatcaacgcncaaaataaatcaaggctgcaatgcagctggtgctgttcagagggta

SEQ ID NO: 701550 - DNA, 130 bp, Homo sapiens
ggtgttctggaggatggtagcacgtataacacactggggaatggagcaaaacagtcttatgaatatcgaacacgcaaggctgtgagactacctatagtagatatttgcaccctatgacattggtaggtcc

SEQ ID NO: 701551 - DNA, 189 bp, Homo sapiens
  misc_feature (81)..(81): n is a, c, g, or t
  misc_feature (104)..(104): n is a, c, g, or t
  misc_feature (110)..(110): n is a, c, g, or t
  misc_feature (118)..(118): n is a, c, g, or t
  misc_feature (140)..(140): n is a, c, g, or t
  misc_feature (151)..(151): n is a, c, g, or t
  misc_feature (175)..(175): n is a, c, g, or t
  misc_feature (183)..(183): n is a, c, g, or t
acggggcaaatgtggatccaaaaaaccagggccatgaccaggtcccctgtggagcagccatctatttacctgactcctganccaggctgccgtggtgtcatttntgtcanccgtgctntgtttccttttggagttttttntccccattatntttgttcctggggaataaaaactncccttggncctaga

SEQ ID NO: 701552 - DNA, 163 bp, Homo sapiens
agatgctgtgaacaatgaaaggaatatgtgggcccgagcttaaatcacatagctgaacgacagttatcccttcctccctattcactctaactaataaatatgaagggctgttgaagctcagggccctgttgccctaatatcaaggagccgcccgacctttcgt

SEQ ID NO: 701553 - DNA, 353 bp, Homo sapiens
taatgatgtgcatcaaaatatgtgcccttcctcacagaaaggtttaaatgctatctgaaccgagcacatctggtcctctccacttcgtggtttttcctagtagcctttctttatccagtaaaaatagatttcctattcatgaagtgaaagtggatcatcataaaggtcttcatcctcatcaccttcatgttgacgcaggccaagccatgacctgtgttgtagtctatgtcgtgtcccatacacatatgcaccaaaatgagcacatgctatcacgcgaggccacctagaagatctagttgtcaaggggcacagaagagctctcgtgtgcctccttaacagcaccatatccatct

SEQ ID NO: 701554 - DNA, 403 bp, Homo sapiens
ctttgggcaaaacagagtttctacaatcatgttgacatgtttttaaagtaattacagcagtttgtcataagcaccaaccagatattcatttataggtgaaggttatttctaagaacaaggatgttaaaaaagaaacaagagaaaatagtaaatggtcttataaagacagtatgacacatctttgaagtggtgattgcaactccacataactttcgacttccaattttcacttgtatgtaggtgttaatgaatctcctttatataaactgtatgacataagattaagaaaagtcataaaaatagtttgaccctaaagaaatcccctgcaatattttttctcaaacattgaaagtgaaaaataagcactattttatggtagatggaccatccatccaggggaaga

SEQ ID NO: 701555 - DNA, 590 bp, Homo sapiens
  misc_feature (486)..(486): n is a, c, g, or t
catttaagaaatgccatttccttgaaagaaaaaccttttcggctaaaatttctaaaaattactttggctacctggctaattttatgctgtgccattaattaatgaagacccttcccttggggagcattccaccttttttttgccagacttgttggaatcctaggtgttacccatttagtttaggacgctcttcttcattggccgcaattaattaaattgatggcttttcccttgcttgactggcgaaagggcattttatcccccctggagatgagcctattttcggcctgtgaacccccacgcctcaccatgggtacctagaacccagtcaccctgattaggaatttttaagaacgagttcttaacacgcgaaggacagatgattaacactgatgctaggcattcattggttagccacacgttttctgagaattccctcgcccggaacaactgcgcgggcactgatttatttttgtcccgcagtcngacggaaatatcctggcctcggacaggctttttagggtgaaaacctatggtgcacggaagtggtcatacgttgcctttcttgaaggcaaactggggggccaaat

SEQ ID NO: 701556 - DNA, 958 bp, Homo sapiens
tgggtggtctctacccggatcaaataggaccccaagcgggggagggaaaaaaaaaaacccccagggggagatatccccccccaccccatggggctgctcgtgccagccaccatccgcgggtgtcgcgcaaaacgagaacacccagttagcagcgaggggagtacgagaaaccaccaccacaagactatttttctacgagtatcctcggggtgcctcaccacacgaggaaacacctgggaagaaaaatcgaagtttctaagaaagcgcggcgtgtacaccctcgtggggctacacggtcttatatatattattatgagatgacgattatgagacagatcattatttttatcaacaagggtgacggggtgcaccttacgtggtgcccaccccggcacttctccatcatgtggggtgggcttccaaacacagggggatgcatgcgatgtaacaaaactatcacgctccctacggttgcggccttctggcggcaaagggggttctccaccacggggtgggcagaaggcggacgacagttttgacaaagagggcggcgtccaccagcggggggcctactcccccctctgttggtttggttacgagcaacggtgaagggcaggaacagctgggcagccccagggttcttcccctggccaaacagggggtgttctacatagtggtggtgtcggcccctagtgaaacccgctgagaaggggggtacacaccacagactcatggaaaacccccttgagatgtgctccaaagagaaaccccctcgggaaaagtgcaaggagtcaggagcatacagacccagatgatatttataaccactacagcgccctggtggtggcacacacacctcgctggggagaggcagcaaccgccgtgggataaacaattacacgtgcaagacacaataaaacacccgtgtggcgggaggagagcggcgtgcccttatatc

SEQ ID NO: 701557 - DNA, 462 bp, Homo sapiens
tattccacggggaacaccagacgagctacttaagaacagctaaaagagcacacccgtctatgtagcacaatagggggaagattatagggtagaggcgacaaacctacggagccgggtgatagcgggtggtccaggatagaatcttagtacagctttaaattggcccactagaaccctctaaatcccctggtaacttgagcggttagtccaaagaggaacagctcttgggacactaggaaaaacctggtagagagagtaaaaattttaacacccatagtaggcctaaaagcagccaccaattaagaaagcgtccaggctcaacacccactacctaaaaaatcccaaacatataattggaactcctcacacccaatgggaccaatctatcacccgggggaaaagtagctgaacagagtagggtacacaaaaatgtcctggatgatgtaatcaatatcctccagc

SEQ ID NO: 701558 - DNA, 1018 bp, Homo sapiens
gtctccgagaacgaagcggcctccgggttcgtgtgctccgagcccgagtactgtttgcggccgtcgtcccgtcctggagcaggattgaggaagcgcctctcacttccccgcgaacccgcagaacaggccgccggcgctgtggagaccggcggagcttcccgctccttcaccaaggggccctgacgcgcagttgaaagcgcggattttgccgggcgcggcggctgcgtccggagtcccagcgccttgggaggcgaggcgggaggatccccacggcccgggagctcgagaccagcccgggcaaatattttgaaagtcatgagcgggacggaaggtgggactgggagagctgttctcgggcaggtggacgctgtggattagcggagagggaaggcactttcgttctcggcaccgtgaggctgtcctggtcaatcctgttttcatgcttgagggtctctggtgcagcagctccaccagccttgacaccaggacttctgtggaatccagacggagtcatgctctgtcacccaggctggagtgcggtggtgtgatctcggctcactgcaacctctgcccgatcacgcgattcttctgcctcagcctcctgacaagtggggattaccggcgcccgcagcaagccctggctaatttttggtaaagtagaggtgggtttcccatggtgggcgcgctggtcttgaacccctgacctcaggtgagcaccccttccagctcccaaggtgtgggattcagcgttgagcacacaccggttaggctggttactcttttggcctatccacgctgggtgccggcgattgggcactcttgtgggccgtggcgcgtttccccgtgcccggggggccccacagggtgccgctgttgacccccgcgcagcgaggtctcttcttcggccgcgagtgggccctttctctccatcgggctggggctcagcgatggcgtgggcagacagcgctcgcgcgcttggcgacggcagatcgtatgcgtcctgtgttttgtgcggtcg

SEQ ID NO: 701559 - DNA, 413 bp, Homo sapiens
  misc_feature (2)..(2): n is a, c, g, or t
tntgtccttccatctgttggatagccgagagtattcggatggagtcccacagacaattagcggatactcagcctcgcgggactcaactgcagccttcgcaccgattgccgccgagatcttctgtgcagcagataaggcgcggcgcccgatttcgttagttacccaactcgtctcgcgcatttcgccattttcgagcttgtaggtgaagcctcggactagccaatgacgctttccgccatgctcaaaagagacgaggctgtctctcggtaggttgagcgcttcgccaaggcgcattcctgtaaaggccacgcatagagctataagagtcgtttggcagtcaaggatccgggagcaaagaaaatgtggaccgtgccagtcgacgcggccgcaatttagtagtagtaggcggccgc

SEQ ID NO: 701560 - DNA, 329 bp, Homo sapiens
gccttggtccgagagaaagttaggatagttgacgaaagctgccttttggctggagggagaggcttatggcgggaatgccctattagctttgcaagggggcccttcagaagtcgctgggctcggaatgctctataggtcgtgcttgggagtgaccctgttcgaagagatactcgcccagcccagcctccgggccacccagcctgtggaggttggtcaggtggtcacccatcttcttgataagcttcacttcctcatctaggaagtgagtctccaggaagtcacagagatggaggtccgtgcgggcagaacccagggcatgaagatccaaa

SEQ ID NO: 701561 - DNA, 500 bp, Homo sapiens
cctgcaggctctacctaccgaatagaagtttggcgcacccgggagtaagcaagtctatcggtttcattttccaacagcatgtgctcacttagagactcttggtcccttttggtaattctcatattatttcacacattttcattattatatctgttatggttatgtatgatccgtgacctttgacgttacggtgaggtgaagtaaataaatgtggtatgtgtccggacggcggtaccagcgggcggtaccctcatctctctctactctccttaggcctcctggttccctaagacacaacaatatggattgtaggccaattagtaccccttggacaaggtcacatagtcacctaagagctcggttgaagatgtacaagaaaatgtccttttcataccggctaacaacatccatccggcagtcggtggatccaggagtcaattggacatagaagtctgattaaagaaacacctttcgaaaggctagggcggctatacagagga

SEQ ID NO: 701562 - DNA, 323 bp, Homo sapiens
cagttccccactccgctgctgatgagcattgcgatttgtgggaagataatatatccgtccttttcactgagataggtctaacatagccagaatcactatcagatgtgcacctcactttcttaaccatttcttaacattgctcagttatgttaaaattagcttgtttttaattgattattttacattatctattttatttcatagttaggttacgctacaggatactgttatgtacactggttaggaatcctttcctccctccatatttttataaaactgatgctaatgaatcttctacctgctttttgtgatttctttttctt

SEQ ID NO: 701563 - DNA, 105 bp, Homo sapiens
  misc_feature (8)..(8): n is a, c, g, or t
  misc_feature (60)..(60): n is a, c, g, or t
  misc_feature (84)..(84): n is a, c, g, or t
gagtctgnccgtattcgcactcattcggacatgcagtgcagaagggacagttagcatgcngggagaatatggaggtcaggaagngagccgagttccagactccca

SEQ ID NO: 701564 - DNA, 1008 bp, Homo sapiens
ctcgacccccatgcaagccatcgtcatctggaagtacaagtctttactgccgggaccgccatcggccgatgtccttctccccggccagcgtcggacaaccaggctcaatgcccagtctggcagacgggaacccaggctaccaaccccgtacttcgagtgccaggacagcgtgcgcaccgtcagggtcgtggccaccaagcagggctaacgcgtgtgaccctgggagattactaccagtgccggaggattaccatcaccaggaaatgcatgacctgaccttttgaccagacggcgtggggggacagtggtgtgtattactgctccgtgggtctcagcccaggacctccacggggaactactgagtgcctacgcatgagctcatcgtccttgactggctcttcgtggttgtggtatgcctggctgccttcctcatcttcctcctcctgggccatctgctggtgccagtgctgcccgtacagcttgctgctgctacgatcaggtgcccctgcttgccacagacaatgtgctgcctgcccccgaggccctgtatgccgccggcaaaagcaggcacctcagggtgttcccagcatttttatgtgccacgatgacttatgcccaccatgtcatcccgacaaagaccaaaaccaaacaaccgtatgattcccattgagacccgagccatacagacgccgatacgcctgtgacggtgtacaccgggatgaccctagcacagcggtgataactcaagcctgaagtccaccagccttattgtaccccgtgtcctcacgggaaaagtaggtaccaaggacagtcaattgaccccacagattacgacgccgggctaccagtgaacttgaacgccaacccaaccagtgatagactccatgacggactcatgttcataaattctaataacgatggatggacacattacgaaccacctgtcttaacctagtctccccatttgttcgtttttacgcatggtctatacattgaagtacgctcctg

SEQ ID NO: 701565 - DNA, 213 bp, Homo sapiens
gggttcccttttctgctcgagtgatcgacagccttgacttgtccttccttgtctcagaggggaccaaggaattggatttcctcagggtctggggcctgggctgtggcttgaggttccgagcctgctgcctccaagctctgcttgagggcctggtccggggtcctgcgccgcgcaggttcccataccaaacaccttctgagaacagtacggttg

SEQ ID NO: 701566 - DNA, 972 bp, Homo sapiens
  misc_feature (332)..(332): n is a, c, g, or t
  misc_feature (382)..(382): n is a, c, g, or t
  misc_feature (384)..(384): n is a, c, g, or t
  misc_feature (405)..(405): n is a, c, g, or t
  misc_feature (411)..(411): n is a, c, g, or t
  misc_feature (440)..(440): n is a, c, g, or t
  misc_feature (456)..(456): n is a, c, g, or t
  misc_feature (472)..(472): n is a, c, g, or t
  misc_feature (481)..(481): n is a, c, g, or t
  misc_feature (496)..(496): n is a, c, g, or t
  misc_feature (509)..(509): n is a, c, g, or t
  misc_feature (532)..(532): n is a, c, g, or t
  misc_feature (546)..(546): n is a, c, g, or t
  misc_feature (556)..(556): n is a, c, g, or t
caaccaatcgtgtagaaggcaccgcacgtggtatgtggtctacactggggatcgcacttgtgatgggaagaatgccacacttgacttctgggctggaaggaggtcagacccccattgctgcagcaaatcgaacattttatccacatcatcacgggtgtggctgtgttcctgggctgtgtcttgtcttcatcctttgctctcatccttggagtacacctggcttgaggcgtgtcatcttcctcatcggtagtcaatcgtagccaatgtgccggaaggtggcgtgggcactgtcacggtctgtctgacacttactgccaaacgcatggcaaggnaaaactgcttagtgaagaacttagaagctgtggagaccttggggtccacntncaccatctgctctgataaaantggaantctgactcagaaccggatgacagtgcccnacatgtggtttgacanatcaaatccatgaagntgatacganagagaatcagagtgntgtctcttggacnagacttcagctacctgcttgctntgtccagaagtgcnggtcttgtancaggcagtgtttcaggctaatcaggatgaacctacctattcttaagcgggcggttgcaggagatgcctctgagtcaggactcttaagagtgcatagagctgtgctgggttccgtgaaggacgatgaggagaagatacgcaaatcgtcgagatacgcttaactcagcaggagtacagttgtgatcatagaagccaaggatcgaggccaaacctgttgtgattaggggccccgaaggtctaaacgggcggcctttccctccggaaggcaacccggtaagggaaaacccttaaaccatatgggggggccaaaaaatctcaggttggccttgcgagacacgcagggcctgaagaaaggaacacaacagcgggggcgcaaagcacagcggtctgcggacggattagagggcccatgagtgg

SEQ ID NO: 701567 - DNA, 184 bp, Homo sapiens
  misc_feature (172)..(172): n is a, c, g, or t
atcagatttgaatacatcggcccacagccataggacatactgcagctacggtagcgcgaacactcatcccgtctacaaatgaagtttccgatctgtgtgttctgaattccaagagcctgagctcctcaagagaatgggtctgaggaggggctcacctcacgcccatcccgancacatgtagatc

SEQ ID NO: 701568 - DNA, 888 bp, Homo sapiens
gacccggagcagccctcaactcactcttcagcttccctgctgtgttgcagcccggccgctccatcatgctttttatgttcctagattcaacaagtctcctaaggccaccttctaatgccaagaacctacatagcttcctacaaatctcagagcacccagcactcattcttctgtcaactgccttcgaccgcgtactagtctcttttttctttctttctcttcttcgccatgcagttccttcagtgctgaccagatgctgcattccacggaggcatttctcctgttgacagcacacaggtgattccaagatcaccttcagccaggtcggtgatgtccttcgagctctgggcacaaatcccaccaacatgcagaggtccggaaacgttctgggaacaccccagcacatgaaagagtgaatgccacagaacaatgcgtggcacaattctgcctatgatgcaagccatttccaacaactaggacaggccacctatgcacgacttgtggcgggtcctggtgtcttgaccacggcgccactggccccagtcatgcttgctgacactccgcatgtctacgccccctgggtgacaccagttgcaacgcggacgaagtggaagtctgattggcaggttcagaagatccaatggtgcgtcaatacgacgtttgtggtcagaataagttactggtgggtctaagaccagcttgttaagagatggtgacttattatccacatgaaatttcagattgtacatcctcggaacagaattggtgtcaatggacatatttattaaggttgagatcacaaaagttgtatgagatatgataaaaaaaatgggggaataatggggaataaattaagatggaacggaatgtcaccgtctcagcatctga

SEQ ID NO: 701569 - DNA, 929 bp, Homo sapiens
  misc_feature (85)..(85): n is a, c, g, or t
  misc_feature (237)..(237): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (305)..(305): n is a, c, g, or t
  misc_feature (317)..(317): n is a, c, g, or t
  misc_feature (336)..(336): n is a, c, g, or t
  misc_feature (342)..(342): n is a, c, g, or t
  misc_feature (353)..(353): n is a, c, g, or t
  misc_feature (359)..(359): n is a, c, g, or t
  misc_feature (377)..(377): n is a, c, g, or t
  misc_feature (379)..(379): n is a, c, g, or t
  misc_feature (385)..(385): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (399)..(402): n is a, c, g, or t
  misc_feature (404)..(405): n is a, c, g, or t
  misc_feature (408)..(408): n is a, c, g, or t
  misc_feature (410)..(410): n is a, c, g, or t
  misc_feature (412)..(412): n is a, c, g, or t
  misc_feature (414)..(414): n is a, c, g, or t
  misc_feature (421)..(421): n is a, c, g, or t
  misc_feature (424)..(428): n is a, c, g, or t
  misc_feature (430)..(435): n is a, c, g, or t
  misc_feature (632)..(634): n is a, c, g, or t
  misc_feature (646)..(646): n is a, c, g, or t
  misc_feature (649)..(649): n is a, c, g, or t
  misc_feature (735)..(735): n is a, c, g, or t
  misc_feature (809)..(809): n is a, c, g, or t
  misc_feature (818)..(818): n is a, c, g, or t
  misc_feature (833)..(833): n is a, c, g, or t
  misc_feature (895)..(895): n is a, c, g, or t
tcctccggggaacaccgggaaggctcgacgctccaggacaggaccagccacgctgacaggtcgatttgcccaggcccgcgcccgnacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtnccagaggggccgggtggctcagacgacccaccactccccnancntgaccgtgctgaacagaccccccnacacgagagaanataaaggagcaataaagtnacgagnactttcgtccnccaatngagagcccgaggggcacncnagcccngcgtgngntncccnnnncnnggncngncntcggggngcnnnnngnnnnnngcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctnnntctgctcctccnccntcagcctggtctccccctcttctctgccctccacccccgtctctgcactgagatacataagaaacaagggtagtttactgtctgtnttgttttctgggttttcagtgtcctagcggaatgcaagtaggcagccagcccgtctgttccctctccgacccgncccgtcccngcccccgtacactgngcttctgttataccatctttgcctgactctctccggcttctccattgaatggctaatgtgtntgtgaaataaagaaataaagaaaaacaaacgcga

SEQ ID NO: 701570 - DNA, 104 bp, Homo sapiens
atcactgagatgggcatttcctataattaggttattccaatgagttgctgaaatcaagtgtgccattgaccaatggatgcacttggttagccttaattttttta

SEQ ID NO: 701571 - DNA, 348 bp, Homo sapiens
acaccctccttaatatttatattccttactgtattactagatattaagtgtacttatgacaatcaatggtgctcatgtgttctaggggacaaaagtgaaatgaatctgtcattataccaggaaagtcaacatcctcagatcaaatgtgccttaataaatttgttttcatttagattacaaacagtgatagacaagaccattataatacacgtcattggagggctgcgtataaagtaaatagcctgatgctcattaggaaaaataaaccagtgaacaatatttctctattgtacttatcagaaccattttgtctcattatccctgttctagctgaagtcttgtctcacg

SEQ ID NO: 701572 - DNA, 175 bp, Homo sapiens
attatccccatatggcagaaagattttctttaaaaaaaaagatagaataacacaagaaaccaatttaggattatgcttcactcagaggaggcaggcagggaggacacaccaggtgcttaaatacactgggcatgtattctatctccaattgggcaatgggtacattgacgttcac

SEQ ID NO: 701573 - DNA, 300 bp, Homo sapiens
gtgcggcggctggttctagtctagaatctcagtgctacatgaggggaggatgatgtgcgtcgccacagctctgcttaatctcctctcacatataacacacaagcacactctgcctaatactagcataagattttgtgtaccgtgggaggggcttaagttgttaggggtgtttatcgttttcttgcctttataaagctttttttgggaaaaggattcccagaagaacactttaagagtaatgtcaaacatcggtgcagcccagccccggcccgggggtaacccgaggctcggaattccggt

SEQ ID NO: 701574 - DNA, 335 bp, Homo sapiens
tacggttgcaaaaaaacaacggagggggcctttctgtccgacatcttgacgaggctgcagtgactgctgctatactgcgagcttctcaatgccggctaaggactacaagaagaagaaggacgctggaaagtctgccaagaaagacaaagacccagtgaacaaatccaggggcaacgccaaaaagaataactggtccataggcaaagttcgggacacgctcaatagcttaatacttgatgacaaagctacctatgataaactctgttaagaagttcccaactataaacttataaccccagctgtggtctctgagagactgaagattcaaggctccc

SEQ ID NO: 701575 - DNA, 1157 bp, Homo sapiens
  misc_feature (1063)..(1063): n is a, c, g, or t
ggtggaggaggtccttcgggagggggctgagagcctcgagcagacaactgggtctggaggcacgtgagtgtcctctgggcgagtatacaacctggcagtggtgatgggcctgcgaccctgacgtactttaaacagctttcgtgtgcgccttgcgacgtactctgcatgctgcgacaacaggcatggtccctttgggctagctccgtggcagccagtacgattgccaatcagtggctgcagtcccgccgattcagtgttcattaccgtgggtaggctcccagcatggcgcgagtttactgcagacgtggtggtgacccgtgagtgtgctgctggagcctccacgcggtgcccccgtagaagcgtgcgcaaatctcagtcgacgatcagacaaggttggcttgtgcgcagtctggcccatgagctcagtcagccagagtgaagcagcatcgcaggaccttgtgctgacagacacggggaagcaacactttggatacccttggtcgaaggcgtcatatcatggcgtcttggatccttgctacaagcacagttgacgcacttcgacgtctaccgtaccgttacgggtgtattggacttgttgtgacattccgtccacttgagcggccgggagttgccaagaagttgggcgatggaccattggatcgcaccgatgatgcaacgactaatcactcacacgcgtaaaggtggaacccaggaggtcgacggcacacacccgaagtgcgaggagggaaaccaccggattggaaacacaagcttcattggagagcgcctatatggaagtctatgccctgacggaacggtgggatgggccgacatgaatgtgacgacgcaattgcaagagcaggagtgtaatggaaggatgcatggcttgcaggggattgaggggggaatgttcccaagggaggtaagaatggagagacagtcggacatatcggaggcgatgggccacacaaatggcggagcacagacgcgactagagccggcgagaaagcccgaacgtacaatggaatgaccacgttccagggggagacccgaacgttgcagnagatcccgcgaaacaatgacaagggacgataacagtcgaaaagtacaccgaacgtgatcggagcagtaacaaaggaacacgcacatcgagaacg

SEQ ID NO: 701576 - DNA, 535 bp, Homo sapiens
acctttgaggatgtggctgtgtacttcacccagaatgaatgggccagcctgcaccctacgcagagggccctatacagggaggtgatgctggagaattatgcaaatgtgacttccttgttttcacttctccgaaccctgaggcagtgtgtgaagctgggacgccagccatgttccagaccgcttggcgccaaatggagtcttgctctatcgacaggctggagtgcagtggcgcgatcctggttcactgcaccctccccctctggggttcaagcgattctcctgcctcagcctcccgagtagctgggactacaagcacgcgcccccacacccagctaatttttgtatttttagtagagaccaggtttccccatgttggccaggatggtctcgatcccttgacctcgtgattccccccccttggcttcccaaagtgctgggattacaggcgtgagcccccgtgcccaccctctctttgttaatgtggtgaattacatgatttttctttcaaatattaaaccacctctgcggtgggata

SEQ ID NO: 701577 - DNA, 446 bp, Homo sapiens
gcgtgatctctactaaacatgtcaagttatgcttagcatgggcatagtgattcactatctgtagtcccagtttacttggagagggggtgatgctggggcagcaggatcgcttgaacccaggaggttgaggttgcagtgagccaagatggtaccagtctaggtgacaaagtgacaccctgtctcaaaaaagaaaccaaacaaacataaaaaaaaaaaaaaaggcaaatcagcccaaatttgggcatttcccctctctcgctaaacagctgcttatcccgagagagcatttgaactggaaacagcaggaaacagtgggaaaggcattccaaagacaggcttggcggtcgtaaaggccgggcttagtcatccaggcttcacacttcggacaaaagggccattacttcgcattactctgcaggaccggaatgtgaactaaaatggtgctg

SEQ ID NO: 701578 - DNA, 234 bp, Homo sapiens
  misc_feature (147)..(147): n is a, c, g, or t
ctgaggtcccgacgacatcacactcatagcatctcgcaatcgtactgcgagagcggaggccagtagcactagcctctgcgctgaggtgctggacgatatcagcagctgtagctacaaacccaggcttctcacagctacagcatgaanaatctcctgagtcacaatcctaggagagtctggagcagtgaacgtcacacgcggcagagggcctgccacatgcctagagtcagagct

SEQ ID NO: 701579 - DNA, 334 bp, Homo sapiens
  misc_feature (49)..(49): n is a, c, g, or t
  misc_feature (130)..(131): n is a, c, g, or t
  misc_feature (133)..(133): n is a, c, g, or t
  misc_feature (136)..(136): n is a, c, g, or t
  misc_feature (315)..(315): n is a, c, g, or t
gaattcggcacgaggttaaatgttgtattggctggggattttaattgcntacgagaccgtagccagataaggtgtttacgctgatcaggtaacaaggcgcgccaaaaagcaaaacgcccgcatatgcgcnncnagngaacacgtcgtagagggaagattattcttcttcgtcgcgcaggaaccaatcagcatatcaacgtgaacggtgttgatcagctgacgtgcggaagacatcagtttgctccagaagtcctggtggtgaccacaaaccaccaaatccatatcgtatttcttgattgcatcgaccagaacctngcccaggtcgccgctgccg

SEQ ID NO: 701580 - DNA, 222 bp, Homo sapiens
cagtccaacatccggggggtggactacacatgaataggtctagggcttttattttaataattaattgattggttaacttttggagagggagtttccctctggtggaccaggctgggagttgcaaggtcacgatctgggctcaccgcaaatttggcctccggggttcaagcaattctctggcctcagcctcctgagtagctgggatggcaggcgcccgccacc

SEQ ID NO: 701581 - DNA, 1396 bp, Homo sapiens
gggcggaccttgacttcgcctccgaatgctgtcagtggtgtgcagcagcctgtctgagggggtgggcgtgtggcgctgctccgaaatctccgctgagctcattctgctccctgacagagctgcaggagctgtgaggctgtatacgaacggctctgcaggcgcaggagccaacagtggtgtgcagagcagcagctggcatgctccttttggaaccagtaaaacaccatatgaaagtaagcattgtgtccactctccaccgaatgggtcctaatctcgccagctgcattgaggggcagcatgcaaaagccagctggctggcacatgatcacctttacctgcagctgcatgggcatgagaaatgtagtccatgacaacacgttcagtcaagacgttgaacctgtgccaaggaaaccggcctcatatcatggccattcacgagagctgactgacactcttggacacctgaaagattactgcatggacatggcgtacatgacatgcatatagacggacgatgcacagaactataatggccacgcactgggtctttgcgaagacaacaatacttcgcactctgcatacatatgatagcaccattgggcacccgacgctcggggatcaattggaagcctcccagcaccagaacacggcgccaccagcaagcggagaagcacatgcacttgaatcgcgcaactccacgggcacaatctgcgcagagcagagaccagtccatagagaccacaccagatacatacacaaagcaccccaaatgtaagtggaccacgcagaaaaagaatttgatgtccccaattggggccccaaacacacatcgagaaccagcgagtcaaaatatatgcaccacaaagggcaagggaccgacgacctacacattacgaagaaattctttcccccacccatgtgaccgtgagacaattatgacacaatgaaagatcgaaggagggaacgatgtgaagaaaaccggtctaccatagagaagatcacgcatatgctgcaatagacacagctagggaaccagtcgtagccacaccataaaatggaatcaaaacaatggcatacaaatcgaaatagaaaatagaaaatactaaaccaaaatctcaaacatctgaaaccacacaaacccattgacatcaccaaccacatatcagacagaacataacaccatataaacttctactaatatcagttaaaaactagatcatttaaactcccccacaacattataagaataaaacaccacactaaaccacacaaatacctctcacaacacgacaatatcataatacacacacaatatagacaacacataaataaacacataactacacaactactcagtagaccaaactagtacatatatcgacaccacacaaaacag

SEQ ID NO: 701582 - DNA, 278 bp, Homo sapiens
ttgagctcggtacccacaatcaccaccttcatgatataataatggtacttacttatgttccttcaagctaagactgggtgcacagtgatcccttttgcttctctgaaccctatcttggacgacaataccttggtgacatttgacacactcttggatggttgactattatggagtaaagctattacgaagtctactctggggaggatacaagaaagggtgtgtcctccaccaatgggtacctggtgatgtattaaatggcgagggggaatggactatga

SEQ ID NO: 701583 - DNA, 393 bp, Homo sapiens
atgagaattgtaatcttgtgcttgtagttgcggagggtggatttgaattctggaatttaggttccggagacaataagtcacataacactttctccgatagggtacagcatgtcctgaataggctatagtaaatcacctcagactggtcataggtgttgcatgcaaacatttctccattttactccctttggtaatgaatctagtaatagatggaaattttccctagattcactgtgttagtcagttggggaagtttggaggcaaagatacaggagtttatggggaggtagtgtacataaatataatcatatgctatataaggaagtttgggtcagcagcaggaccatatataggatatgattatatttatgtacactagctccccataaactc

SEQ ID NO: 701584 - DNA, 283 bp, Homo sapiens
aggatagaaggaaaccagaacatggactggtccaaaccaagaaatgtacagtaagtctcatgtaaaccatctgatgtagtgatacttgaatatataagctctgtagtattggtttgctagagtcaccaccttgagattacagatagttagcatcagttatgtagctataatatgtctatagtatataaatctataatcaaaaataacagcaactacggaatcagataactgactctaagcttataacaaggagtgaatatataaatcagtgtaccctcagtcc

SEQ ID NO: 701585 - DNA, 215 bp, Homo sapiens
ggggggttttttttccccccaggggccccgtttccgggaaaaggggtgtccccccccggggcctggggggggttttaaccccattccctttcccctggggccgggggggggaaagggtccccccttttttcccctttttttgttccccccgggttccccctccttggggggggggggggccggtttttttttttccttaattgggttttttttta

SEQ ID NO: 701586 - DNA, 589 bp, Homo sapiens
  misc_feature (29)..(29): n is a, c, g, or t
  misc_feature (137)..(137): n is a, c, g, or t
  misc_feature (152)..(152): n is a, c, g, or t
  misc_feature (164)..(164): n is a, c, g, or t
  misc_feature (168)..(168): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (186)..(186): n is a, c, g, or t
  misc_feature (191)..(191): n is a, c, g, or t
  misc_feature (196)..(196): n is a, c, g, or t
  misc_feature (198)..(198): n is a, c, g, or t
  misc_feature (200)..(202): n is a, c, g, or t
  misc_feature (204)..(204): n is a, c, g, or t
  misc_feature (211)..(211): n is a, c, g, or t
  misc_feature (213)..(213): n is a, c, g, or t
  misc_feature (220)..(220): n is a, c, g, or t
  misc_feature (228)..(228): n is a, c, g, or t
  misc_feature (230)..(230): n is a, c, g, or t
  misc_feature (240)..(240): n is a, c, g, or t
  misc_feature (273)..(273): n is a, c, g, or t
  misc_feature (288)..(288): n is a, c, g, or t
  misc_feature (299)..(299): n is a, c, g, or t
  misc_feature (303)..(303): n is a, c, g, or t
  misc_feature (319)..(319): n is a, c, g, or t
  misc_feature (325)..(325): n is a, c, g, or t
  misc_feature (373)..(373): n is a, c, g, or t
  misc_feature (384)..(385): n is a, c, g, or t
  misc_feature (401)..(402): n is a, c, g, or t
  misc_feature (404)..(404): n is a, c, g, or t
  misc_feature (406)..(406): n is a, c, g, or t
  misc_feature (424)..(425): n is a, c, g, or t
  misc_feature (434)..(435): n is a, c, g, or t
  misc_feature (438)..(438): n is a, c, g, or t
  misc_feature (448)..(448): n is a, c, g, or t
  misc_feature (454)..(454): n is a, c, g, or t
  misc_feature (464)..(465): n is a, c, g, or t
  misc_feature (474)..(475): n is a, c, g, or t
  misc_feature (483)..(483): n is a, c, g, or t
  misc_feature (489)..(489): n is a, c, g, or t
  misc_feature (491)..(491): n is a, c, g, or t
  misc_feature (493)..(493): n is a, c, g, or t
  misc_feature (495)..(495): n is a, c, g, or t
  misc_feature (506)..(506): n is a, c, g, or t
  misc_feature (511)..(512): n is a, c, g, or t
  misc_feature (523)..(523): n is a, c, g, or t
  misc_feature (529)..(529): n is a, c, g, or t
  misc_feature (560)..(560): n is a, c, g, or t
aaaatgcagacacactattacaggctgtnaagtaacaaatgagtgttacacaattaaaatattaacacatacttatgggatttgttgaatgactaacagacccataaaagaaattaaatctgagacgaaatccagtnttagcacctacaatntctctgacagtnaaantntnaangtggnttctcnctccntaatngnannntnaaactcncncccaaanacagcgcncncaaaccccanggataaacgaaaggcataagccgccccgatccnaggtacggacagccnaaagctgagcnacanatatggactcagactngtgagngttacttgagatgtacttactgtactttagccaattcattagatttcngggcgcggaannctggagatgagagaanncngnggggcagaaggggggccnnagggatagnnaanaattagtaanttacantttttttccnntcatttttnnttctcagnagtgantngnanaacaaaacganaagtnnaatagtgtttnccggcnttttccatatccaggggcacagcggggactnttaggtggcgggggggggggcggccactt

SEQ ID NO: 701587 - DNA, 935 bp, Homo sapiens
gaaaacgcacaaaaccagagacaaccgactcagcgtcagtcagagcctgggtgttcaataggacagaggccggaggcaggcggcttagacgctcgcagtgcccgtgccacctgccctgccctgccctgctcgctcgctctgccctgcctgcgccgcggtgcactgacctgccagcatgctgcctgagagtgggcttgcccctgcttgctgcctgctgcctgcctgcctgcctgctgctgcctgctgctgcctgctgctgctgctgctacttggtgctgctgagatggctggctgagctgtgcgtgggctgctgcgcggagtgtgctgttcctgcttgcccgccctgcacacccctgagctgcctgtgccgcctgctgggcccccgcctggttgcgcctgccctgccgcggtggcctgcagttggccggacgtgcgcccctgcatgccatgcgccgtggcggctctgtccggggatgcctgtggctagctgtgcttgctgctctgtgtgttgcgcccgtgcttggatgtgtgcgatgttgctgttgctggtgcggtcttaacaaccccctgcgctgctggaccagtggtgctgcggctgctatccccacccgggctccgagcttgcccctgcaggcgctggtcattggtgcgatttgcacttgtgagaatgcgccgggacgccgaagtaatggcgccagcccggagcaggttgccgacacatggctgatgaccactcagaaggagtgcctggtggcagaaccacgttggacagccccgatgaacgtgttgggcggtggagtgcagtgctggcctgacgcccctcaagtcgggtatgatgagctgccgtgttctggagcaggtcctgacagcacggcgatggccaggtgaactcacttggctgagcccacagtgaccccctcagctctccacgctgc

SEQ ID NO: 701588 - DNA, 1002 bp, Homo sapiens
  misc_feature (44)..(44): n is a, c, g, or t
  misc_feature (56)..(57): n is a, c, g, or t
  misc_feature (64)..(64): n is a, c, g, or t
  misc_feature (67)..(67): n is a, c, g, or t
  misc_feature (70)..(70): n is a, c, g, or t
  misc_feature (79)..(79): n is a, c, g, or t
  misc_feature (88)..(88): n is a, c, g, or t
  misc_feature (99)..(99): n is a, c, g, or t
  misc_feature (118)..(118): n is a, c, g, or t
  misc_feature (142)..(142): n is a, c, g, or t
  misc_feature (166)..(166): n is a, c, g, or t
  misc_feature (177)..(177): n is a, c, g, or t
  misc_feature (184)..(184): n is a, c, g, or t
  misc_feature (206)..(207): n is a, c, g, or t
  misc_feature (211)..(211): n is a, c, g, or t
  misc_feature (215)..(216): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (236)..(236): n is a, c, g, or t
  misc_feature (238)..(238): n is a, c, g, or t
  misc_feature (244)..(244): n is a, c, g, or t
  misc_feature (252)..(252): n is a, c, g, or t
  misc_feature (269)..(269): n is a, c, g, or t
  misc_feature (271)..(271): n is a, c, g, or t
  misc_feature (281)..(281): n is a, c, g, or t
  misc_feature (288)..(288): n is a, c, g, or t
  misc_feature (294)..(294): n is a, c, g, or t
  misc_feature (297)..(298): n is a, c, g, or t
  misc_feature (300)..(300): n is a, c, g, or t
  misc_feature (306)..(307): n is a, c, g, or t
  misc_feature (309)..(309): n is a, c, g, or t
  misc_feature (354)..(354): n is a, c, g, or t
  misc_feature (366)..(366): n is a, c, g, or t
  misc_feature (956)..(956): n is a, c, g, or t
ttttccacatactttttcaacccactattcttcctattttccanctcatccccttnntttttanaanaanaaaaccttnctgaaaatncagacaaattnggcattatcttgagaaatnaactcatgaagctaccttctgatnttgtaactgccgtaagaggaaaangattattaaangctattntcattaaagaaaccaaagattnntatncttnnaagntntntctactacttcnanataatngacttctngccaatccaacccatgncnacattatcanttttgcncctccnctnntnatcaannangatgagcttcgagagtccattgaaattattaacaagaccatcttntctttctgaggntagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttatntcaatacttctttaaatttaaaatatcatcttatatttcaaatgtc

SEQ ID NO: 701589 - DNA, 900 bp, Homo sapiens
  misc_feature (784)..(784): n is a, c, g, or t
cctcttgccgctgctcttttgcgtatcaaattcttgccgggccactgttgctaccacccccgcccggaatgcgcgctctacgttgcgaggttccgcggagcccattgaaccaaataattgaagttagtatagggcaccccggctggacgtgcacacacacgatctgggtatctcatgtttgtttggaatagtacgcacatgtgttcaaccaccctgggccaaatttttccattcgggaagcattttgttttctcaccacgagcgtgcgcacacgctatgtctctgccatacgccttccattaactcttcggtactgggtcttgagtatcaatccgcgcgcatttattttgcgtgaccactcggtgggtgacaaccctcggcgttgctatgttctctccccctgattgttggatccgcctctcgcttagtccgaaataattcgcaccccctcgtctcgcacaccaggcactctccccaccaaggtcggtggttagcaagtgcacccaagcgtcacacacacacacccctttgtggagtgagaccaccaacaaccggcgctagttgagagacacacgctgctcaaacatacgcccccgtttcgctacaaaaatgaaagtttcccacgtttcttttacaaatgcatctattatatctggcacacacgagtacgatacatagatacaacatatactctccttactgacgaaccatgtgagcacagacgcagagacattctcacagttctctaattatgtagtcaacgcacgcaaagtcaccccccctngttggataacatactccgaaccacacacatcgttggatcttcctagaagtaacatcttgttcttaccacaacgccattccaaaaaaccaccttctttttccccaaacccataacaa

SEQ ID NO: 701590 - DNA, 1356 bp, Homo sapiens
  misc_feature (1)..(1): n is a, c, g, or t
ntctattcgtgtccctccttattcgttttgctttttgtttcctcgctgtcggttgttgtctttctgtcgctccttgtgtccttcttgttctcggttggttttctctcttttgctggtggttactgtttggtcttctgcggtcctgccgtgtgatatctattctcctttgtgtgctttgcccgtctttctgtggctctgtgtgtgcttttctcggtttgttccttccttttaacgtgtcgtgcaacgttggggggctcttcgtctctgcgttgggtgttcttgtacttttgggggtgcctaccatttctgctgtctcgcctgtggttgtttccttcctcttctcagtggtggcccgatgtgtgttctatattggcgccctcgtaagttgttttgattgctttgggtttttcctctttgcctcttgtgtgcctcatgcgggctttctctgtggtggtccccgttttctctctttcggggcttcgtccttgttggtctgcccctgtattttctctttgggtgtatcctggtccccgcttattctgatctgcgttcttacgttgcctttggcggctagctcagtctttttgtgctggtttgtcggttacgctggttaagctgagctgttggcgagctcctatgcgccccttatgtggtctcttggcttggtatgtgatgccgtatgaatgcgctcttagggagctctaggggtgtgtcagtatctctctggaggctggttcccttggtaccgactgtactagttcttggtttcctctcgtctcctactgtcgcatccctctggctatcatagtaacccgtagtgccgcatgcgtggcacatcatctctctcagggtccctttcgacgcggtgtctatttcgaggaagatgctgtcatcctgctggtgatggggcgttgaactctctgctcgcctgcactgggtatcctgggtcactggcccatgggctgatgttcattcactgtgttgattttatttgacaccctgtgtagtggtggtgtctcatctttctccatctgcgcctgagtagtctggtctgtagggcctgcctctactgcatatatccttccccaacagtcgttctagtgataagtcgttccttagttctcagttatgatccaggcggcctagccagtgtctgaccataggtgcataggggtcaggtgcagaggtggcagggatggtctccagatagaccagaaatgcacttaaactgcaacgtcccgtctccttccctcaccccctatcccatccccacctcccagccccagcaccagtcctcctaggagcaggaccctgatgaagcgggcggcggtggggctgtactcgtgggactaactt

SEQ ID NO: 701591 - DNA, 1002 bp, Homo sapiens
  misc_feature (44)..(44): n is a, c, g, or t
  misc_feature (56)..(57): n is a, c, g, or t
  misc_feature (64)..(64): n is a, c, g, or t
  misc_feature (67)..(67): n is a, c, g, or t
  misc_feature (70)..(70): n is a, c, g, or t
  misc_feature (79)..(79): n is a, c, g, or t
  misc_feature (88)..(88): n is a, c, g, or t
  misc_feature (99)..(99): n is a, c, g, or t
  misc_feature (118)..(118): n is a, c, g, or t
  misc_feature (142)..(142): n is a, c, g, or t
  misc_feature (166)..(166): n is a, c, g, or t
  misc_feature (177)..(177): n is a, c, g, or t
  misc_feature (184)..(184): n is a, c, g, or t
  misc_feature (206)..(207): n is a, c, g, or t
  misc_feature (211)..(211): n is a, c, g, or t
  misc_feature (215)..(216): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (236)..(236): n is a, c, g, or t
  misc_feature (238)..(238): n is a, c, g, or t
  misc_feature (244)..(244): n is a, c, g, or t
  misc_feature (252)..(252): n is a, c, g, or t
  misc_feature (269)..(269): n is a, c, g, or t
  misc_feature (271)..(271): n is a, c, g, or t
  misc_feature (281)..(281): n is a, c, g, or t
  misc_feature (288)..(288): n is a, c, g, or t
  misc_feature (294)..(294): n is a, c, g, or t
  misc_feature (297)..(298): n is a, c, g, or t
  misc_feature (300)..(300): n is a, c, g, or t
  misc_feature (306)..(307): n is a, c, g, or t
  misc_feature (309)..(309): n is a, c, g, or t
  misc_feature (354)..(354): n is a, c, g, or t
  misc_feature (366)..(366): n is a, c, g, or t
  misc_feature (563)..(563): n is a, c, g, or t
  misc_feature (571)..(571): n is a, c, g, or t
  misc_feature (582)..(582): n is a, c, g, or t
  misc_feature (589)..(589): n is a, c, g, or t
  misc_feature (599)..(599): n is a, c, g, or t
  misc_feature (602)..(602): n is a, c, g, or t
  misc_feature (610)..(610): n is a, c, g, or t
  misc_feature (618)..(620): n is a, c, g, or t
  misc_feature (623)..(624): n is a, c, g, or t
  misc_feature (626)..(626): n is a, c, g, or t
  misc_feature (629)..(629): n is a, c, g, or t
  misc_feature (632)..(632): n is a, c, g, or t
  misc_feature (634)..(634): n is a, c, g, or t
  misc_feature (646)..(646): n is a, c, g, or t
  misc_feature (648)..(648): n is a, c, g, or t
  misc_feature (654)..(654): n is a, c, g, or t
  misc_feature (956)..(956): n is a, c, g, or t
ttttccacatactttttcaacccactattcttcctattttccanctcatccccttnntttttanaanaanaaaaccttnctgaaaatncagacaaattnggcattatcttgagaaatnaactcatgaagctaccttctgatnttgtaactgccgtaagaggaaaangattattaaangctattntcattaaagaaaccaaagattnntatncttnnaagntntntctactacttcnanataatngacttctngccaatccaacccatgncnacattatcanttttgcncctccnctnntnatcaannangatgagcttcgagagtccattgaaattattaacaagaccatcttntctttctgaggntagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtcccgtccctccctaatgncctggccnccctattccgntgcagcncccccctgcnccngtgccccncctccggnnnccnncntcnctntnccgccccccccncnctcccncccctccgtctcattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttatntcaatacttctttaaatttaaaatatcatcttatatttcaaatgtc

SEQ ID NO: 701592 - DNA, 434 bp, Homo sapiens
gcccttgggcatatgtttttcaaaagagaaactacttttcatttggtaccatagcgtgacgagcaggggccaatgactgtaaaacatgctgtggcacatatatttatagtctgttatgtggaacaaatgtaatatattgaaactttatattatatataaggaactttgtactatccgcatttcgtatcagtattatgtagcatgacagagactgtgaggtctgagcagctggtggctcaggacgttgagaaactcgaaggaatcctttcgtgaggatgcgcagctatccctacccatctctctcacctcaaacggaggagaaaggggaatcagagataatgtgagtgtgtccttgttctctgttcttaggaggaatgttcttaccaactgttcatacgctttataaaccaataaatgtattctgagtaaagaga

SEQ ID NO: 701593 - DNA, 410 bp, Homo sapiens
atcgactcgccgtacgaaaggtggaatagtaccagcctgcagtggagactgcaagcggaggcgatgaagcgagctgcattgtaaaagaaggtctggaaagctcatttgcaggaaccgcttattagcacaggacagtgaaccacacgtccacaacagcccaagatcagactatctgccagactcatcatgctgggggattacacacagcaggctcatgtttgtgcacacttctactagacggcagctggactgtactatgccagaataagacaatgtactgcatcgccagaggatcctgactgtctatgcgacctgcattacaacttatggccttagtgctaccgtcgatagtctatgcgatgactaccagcccagaattgagtgaactgtgttatcattctatatgacct

SEQ ID NO: 701594 - DNA, 474 bp, Homo sapiens
  misc_feature (257)..(257): n is a, c, g, or t
  misc_feature (270)..(270): n is a, c, g, or t
cctctagagcggacgcctactactactaaattcgcggccgcgtcgacgctcgaagcgcacggcggagtcaaggctgttggggttcaggccatagttcgggatgtcatccgcaacgcgtgcgatgccgctgctgccaagcgtttcctggcggcccacgttggtcaaaccgacgtcgctacgggccacaagtgcgccgtcggccctgacgacgcttgaagcctcgccaaccttggaaacctgcccaaatcggccggaangcgcgatcatggncaaaccatcagtcattaactcagtgacttgcgccgctgactcatagctgttgccttgcaagctcgagacaaattccctgcccgtctgcctggtgatcatttgaccgccgcggtccaccgtcgggtcggcaatcggcccagcaggcgtcggtcatttccagtgggctgctattacctaaaagcccaccggcagtcttggcaagac

SEQ ID NO: 701595 - DNA, 207 bp, Homo sapiens
cccgtctcggcgtaaggtgatgccggcctggcggaataagccccagtcgtcttgctcgatggcagattgatcccccacggacaagcctgccaggatgcccgctgcacgccggtctgacacatgggcaaaaatcgcggcccgtatgcgctggcgccagcggtccatcaccccttgccatggccactcggcctgttacgccgatgcggg

SEQ ID NO: 701596 - DNA, 256 bp, Homo sapiens
gtcgacactaattggagaccatttgaatgacagacttgtggaacctgaaatcactccatcctctggcaccaactcatgactccttaatcatctgactagagccccactagggttgccccaccagtcccggctaatttttgtatttttagtagagacggggtttcaccatgttggccaggttggtctcgaactcctgacctcagatgatccgcctgcctcagcttcccaaagttctaggattacagtcgacgcgggc

SEQ ID NO: 701597 - DNA, 803 bp, Homo sapiens
tctctttgataatatctgtgtattggtccacggaccgagtcgatggctcaagaagtgatacaagagcgatcgagagaacagtgcgcagatctgcctgggtcaactttatcaagcactctcgtggttggtggtcccacagcagccgcgaaggtcgtcagaactatcatattccagcgaataacacacaggggcttccccttccaccacaagagaactccaacagcggtaaaccaaaagtcaaccagagccttttaaatttagcggcagccaagtctccaactatttctcgtgtaatacctatatcaagccaagagatttgtgacaattaatctacacaacgtggtacacactttatatattctctaccacatacatccgtgggacctgtgcctgtgacaagggacgtgacacaaccatatgcgcagcacaacacgcacgcttgggtggcgtctaagaaccccatctacacattattaacaatttctacacaccgtatttgtcccacaacagtgggagaaacgccctttctataaaaaaacacatcactcatgtactatataacttggggcgccaacctaaaattttatacttgtggtcgacacagccgctcacattacgagaaaggcctggcgctattttccccattctgttgcgtccaaagacatgttgggcccaaaacacgcgggggacctactaccatttcctatataaaacacccccgttggcgtaatcatgcggtaataacacccatgggccctcaccaagaaccaacagggggcttttacaacgacagtgacacacca

SEQ ID NO: 701598 - DNA, 398 bp, Homo sapiens
cattccattccactctggttgattccattccattccattccattccattccattccattccactccattccattacattccacacgcactccgtttaattcagttccattcctttccaatccattgcactccattccattccattccattgcagtccattccattccattccgttccgttccgttccattacattcaattccattccattccgttccattccactccattccattccattccattccattccattccattccattccattctattccattaaatttcattccattccattccattccattaaattccattccattccattagtttctaatcgggttgattccaatcctttccattatattcaagtcctttccattccatgccattccc

SEQ ID NO: 701599 - DNA, 1320 bp, Homo sapiens
  misc_feature (1320)..(1320): n is a, c, g, or t
ttgtcagtgccataggttatcctcgtggtcactggttacaagtgccgcaatggcccatcatctcatgtgcattggcgcatctgtgggtggcagcccatggtagcaggggccacgtgtcctgcactgtcacaggcacagtgcattgcgtggccaccacaatccatcactcctggcacaagcacagcaacccagctctgtcttcctgcacacatggcatcggcagccgcagcgcatgcatgcactgtgtcgtgaccacgtgccgacacgcaaccgtggcatgcacactttgcacggcagcatcccaggtggcatgcatcgtcaggcaagcatgggtcacaccgacatgcgctcttaagcgccgtcggccgacttgacactggacgttggtggcacagacatccacatacaagtggcacaggcacacatgcacagcgtcgcgcattatgtctccagtgtactccagtcgcatctcttcatcagcggcttggtcgcgccatgattgggctataccgaccatgatacatcaccaaggcaactattgacggagcgcccgagtgccacggcgcgcatcacctgcaggtacagggagatatcgagtacccagccgtgacaccaacactgcgccgcaaagccccagtcgtgctactcaacacaactaccaacaacattcacgcctgggacgttcatggccgcggcgccctagtagataccgcagactacataggagacggctcgacggcacgcacgcaactcgcattacaacccacggacggcgcgcaggttgacagtggacgctgaggatccatcgccacttgcacctaccagatctggagcgcacagcgacgcaacgacaactggatcctcaagaacaacacacaagagcaatgccaggacacggccaaagacaccctacagtacacggctccacctgatacaggggctcacccacagcattgtggccacgactaacgccgtggcgcacaaggtacgcagcgtaacatccagcaacggaagccaaggtaacacatcgagcccaatcaacggacacaacagggccgcaaccggaaacagaaggggaccacaaaaggggaccaaaaagggaccaggagacacatcgggagagcgtcaccactcggcccggcaccaagcagcacatgaagcacagacagacagagacgatagagcagacacaccgaagcgaggagcaagcacaaagaagaaaacccaccactgaccgacagacgaaagcaacagcgaagacacaggacaccaaccagtaccactccgcgcgcacgtacacgactgcggtgagcagaagcn

SEQ ID NO: 701600 - DNA, 100 bp, Homo sapiens
cactgttgttcatacctagtcgctgtatcgggggggggggtatgaacaacagtgcaggtataaccaacagtgcaagttataacaacagtgcaggtataaa

SEQ ID NO: 701601 - DNA, 130 bp, Homo sapiens
atgactgatggtagttggaacgggtacatgtcaagatagtgggatggttaaattgtctcacggttagtaattttgcagagggcgctcagtactcgcctgcccactgtgtccattgctgtctcacaactgg

SEQ ID NO: 701602 - DNA, 276 bp, Homo sapiens
ccagataatttccgaatacccttatgttaacttttcactagtcataagaatgacattacgtcatttgtaaaaaatgtcatagagaactcatggagcactgagactatctcaatatcccacattgagaatacgttatttaggattctatgagtttgtatgtgtgctgtttaatgagaatgatgagcctgggcattttcacatctcttattatacttttacatgtttagaatatttgcccttctgtctgatcattatctgtttgggaaagtcttattc

SEQ ID NO: 701603 - DNA, 117 bp, Homo sapiens
ccaagagtccttttataccacgaaccacgttcgtttgaagtaggaatgctagtctggcataaacataaaaaataccccttctggccagcagtggtcaaaagcgtcaggcagagagat

SEQ ID NO: 701604 - DNA, 1388 bp, Homo sapiens
ccacgcgtcgcggacgcgtggggtcctaaaacatctaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaagaaaaaaaataaataaaaaaaaaaaaaaaaaaagaataatctgagatgggagagtgagggagtgagatgtttgtttattgttgttgtggttggtgattttttgtttttatttttggtatggtggtgtgacggtcggtggtgtgtcgcgcgtcggtgatgtgtggtgtatgcgtgtgtaatatctaattatgaatgtcgtcgtcgtagttcgacatgacgtcgtatgttataagatagagtacagatacagcagggtgcgcgcgagggaagataagcaggcaatacgatgccaccgcacatagtagagtagcgaagcagtcttgggctgtcggggggcgggaggagagtgagggagagatcgtggaggcgcgacggcaagtgcaggagtagtgatagcgagggagcggagcagcgccgctgcagcgatgggcggtggcagtgtgtcagaactaccacaggggggcgtagtgcggggatcgtgcggcggagtgaggatgatgcagtttactgagtgacatgctccattcgcaatctttgaatctcatacacattataaaataatatgacacacttaaattagtattagtttcatcttttacttattcatcccacacacaagaaagataaacaataacaaaaactcaaacacaaaaccacaaaaaataacaaacccaccaccccaccgcgggagcaggagaggcaggcgggggtggaatggaggggggggaggggggagggagacgggggggcgcgggggagggcatccggacggaggaggggagagagagaggcgaggcccggcggagggagcgggcggaccggggcagggggaggccgggggccgaaggagagagagagaaggcaagcggagtgagcgagggaagagagcgaggaacggagcagggaagccggcgacgacgatggggggcggatgaggagcggagagggaagcgaggaaccaacgggcggggagttgagggtgggggaggcggcagggaggggaggaggcaggggcggggaaccacttggcgatatacgaaacataacccaatcgagtcgagaataaataactaaacataccaaacacaacaataacacacacccaacccaatcaacaaacctacacgaaataaacaaaaataagcgaacaacaaacaaagtcaaaccaggcaaccactaaccgccctcctatcgacaagccagccaccacaaacagaacagaaacaaccaactccaaccaaaccctatcaccatataac

SEQ ID NO: 701605 - DNA, 255 bp, Homo sapiens
gtcatcaggtgaacggggggcacgtcaccgctgatcacatgtctttactgatgacaacggtgcctacaggtgtgggcccccgttgcacagtgaccgggagtacacggtgacctcacggagggagggctatgtccggagggcgggggaaggaaccatcggagacttcaaggcctatgcccgggcgggcgtacgcttggacgatagaggcggaggatgaccagcccctcgggggagtcctcttatcccggaggcatg

SEQ ID NO: 701606 - DNA, 91 bp, Homo sapiens
cccgggcgcctcctggagagcaaggacgcgggggagcagagatgatccgagccgcgccgccgtcgctgttcctgctgctgctgctgctgct

SEQ ID NO: 701607 - DNA, 1164 bp, Homo sapiens
  misc_feature (930)..(930): n is a, c, g, or t
ggaagatggcggaggtgggggagataagttcgagggctgccgactacccgtgctgcggcgtggaaccaggcacaacgagagatgagtggcccctgggcgagatcctgagcgtgaaggacatcagttggccggacagcattttctacgtccattacattgactttcgaacaatacggtctggagtgaatgggtgacgcatgagcggcgtggacctaaagaagatccagttgcccctggaaagaggccagagaacccgctactaatgaacggacttcctgggtcctcgtccttggctctccagagagagaggtgacacgggaaggtggtagggtggtttctaccagcaactcctagtgcccagcagatgacagaccctggtcttcggagttcctcgcccgagaatggaatgctcggaccagtagggctagtggcatgcctcgagacaggatcggaatgcgaaccatctgaatggtttagggctagcgtgatgaggactcccaggaccacgtctgctgcatcggcatactaaccgttcaggtatccaatcgctatgtacgtgggccgaggactggctgatctggatcggaagcccacgagcgaacatgcgtactacctcgggaatgaaagaacccttgagtgctttgagctgggggccgggagccggcctcaaggccgtgggggttccgttgctcccctcgtgacccgacggaggctcgaccagattgccctgtcctcctaactgttggcgagttctggctcaagtacggcgcgtaggttcccgtgttcttccaggcatgtgaccagtgtggaactaggacttcctcctggcagaagattaacgcaagggcaccatgtcctcttggagaattgcgggcgctaaaaacacgaggtttcccggaaacgcagtccctgggcccgggtttccttgangcacaagaaccggtgtttgaaccaaacctatcacacatgggtacgaataatcgatgaaggcccctcggggggatcccgagaaagaacggacacaagggggggaacagccacaccggagaaaacagcatgtagaaccacggaggaacccacacaaagctactaataaaacacaacaatgttaagggacataacacatcctccccccttctgggcccctcccctccctccctcccc

SEQ ID NO: 701608 - DNA, 824 bp, Homo sapiens
gcttgaccgtgctacctgcagaggggtccatacggcgttgttctggattcccgtctggtaacttaaagatgaaacttcacacaatgtcacgtagcccttgatgtcctgcaaatgaaggaggaggagtgtccttagatgtttcctatggcagacaggaacccacttaggttgggcaccaaacatcttgtaactatccaagagttggtaagctagataatcgagtcatatgtagagagggtaataagccgtaatggctagtctagtgagtacattaacatcatcgacatggagggactctgtgtggaggaagccttgctgcatggactagatcgttgccacttgttgcgcatttgaaaattcctgtctagatgctcagtagttgactagtcctccagagaatactgggccagagggactgtgcttgaatgcttgtagcaaggtcgtagactcttctagtggagccgaccatcaccaaattgcatggaacgcgataactcctggaaccttcactaaccctagaatccaggcgattctcttctcggtgagccacgtgcttcgttgtggttactgagccccggggcttagcagcagcctctccacgtgggcatcttatgttgaagcctagcctatcgcatgtgcgctgttgtgaacacagattttccgtcctgcgctaatgtggactttgccttccccatgcaagcaactagggagctcactcagtgggttgatgtggtggatgctggtcgggaagttctgcgctggcgtggcatttcccggaacagcctgcgaggtctgcctgttcttgtgcttcttgagatctgaaa

SEQ ID NO: 701609 - DNA, 409 bp, Homo sapiens
agagaactagtctcgagtctttcttttttacccccatttcttcctaataggaaatcaaggataagcaagggacacccatgtttggtcttattcctgttgcaatgaaacttctagttccacagactttgcatgctggcttctctaaccctgtgtgctgcatgagcctgatactcatccttaattctttttaaacttcatgcttaactactgtgggataataactgtctgcagctctagttaaatcatacttataactatgtccttatattccactctatgcttttggtattgatgatctttacactattaaatggcatttgatactggatctatattgtatggtcttaataagacctacttcttgtcatcccattctttatcctctactttcatgcttgatatcgatgtt

SEQ ID NO: 701610 - DNA, 141 bp, Homo sapiens
cgttatcagcagacaagccacaattaacataggtacaattggtcatgtagctcatgggaaatccacagtcgtcaaagctatttctggagttcatactgtcaggagaatcgcttaaacccagaggcagaattactatagttg

SEQ ID NO: 701611 - DNA, 131 bp, Homo sapiens
tggccagtgtcccggtcaccatgcaggagttctgtcctttgaactccatagtgacccctttttaccttgttccagatgaggacaggtgttgggtattccgatgacctcatcagctcaagtacacctgggca

SEQ ID NO: 701612 - DNA, 322 bp, Homo sapiens
aagatcgtgccactgcactccagcatgggcgacgaagcaagactgtctcacaaaaaaaaaaaacaaagttatcttaagtttctatggggaaaccagatatcccttgattcggacttcctgggctatggtttaaagctaactataactttctggctaatggagtggctcattggcttctcggggatagctaggtgctgggaatttcatgaggggactcaagatttgccttaatttccatgctggggggccttgaggcccttagagaagccctggctctctctccatggtcagcaggggcttcagtcggccctcaagtgtcccc

SEQ ID NO: 701613 - DNA, 664 bp, Homo sapiens
ctgggtggttcttgcttgtcttggtcttccccgcaagaccgcgccaccagtgcctcttgggccaagacactggccgcgcacgtttccccctgggaacaagaggtcttctggtagaaatgtgccctctcggccggcctttgtgggcaaaagactcccacacttgtctcccggaacttccgaggtctcacacttcaggtgtcccattcccaggaagaccatgcggtagttgtccctcgcgtcttgcgccttttcttgttttcaaacgagggccagtgccccagagctcccacaacacccgctcccgagagcgccctctgatgggaccagcccttaccccaccccaaccttgggcgccaggccacggtgccccgcctggccactcaagtagtttattgcgctccgtccgttccgtccctgggcccactggcctggcgcctgttcccccacgggctttcatgtgccacccaccccccggcaggcctttccctgtgccacgccacggagccaaacaaggggcccaagtgcaggcaaccacttgctgagaaccgtttcctgtgccctcccccgccccatccccggttttctgtgttgtgtctttcccggctcaggcagaggcgcctgtccctgctttttttttgaccgggaaattaatgcccctgaagga

SEQ ID NO: 701614 - DNA, 404 bp, Homo sapiens
gtgccaataaatgtgatgataacatacatttcatatataactcagcctataatacatttaatgatatatgaactattttgaaccataaccaccttaaaatgtttgggcatcctggattatgccagtcctaaaatacacacacacacacacacacacacaaacatacacacgcacacatatatacaaatatggtgaaatactatcaaatctgaaggtcatacatatggactgccccttatctgaaatgcttgggcctagaagtggttcagttgtcagattttttggggatggggaaatatttgcgtatacatagtgagatatctggggaatgggacccaagtctaaacacaaaatgggtttatgtcttatatggacctcgtacaaatagcctgatagatgagaga

SEQ ID NO: 701615 - DNA, 281 bp, Homo sapiens
agttcctgaacgacggccccaaaccggggcagtcccgattttgaatattcagcagctcgctgaagtttgtccctaaaggcaaaaaaacttttgcctcccagggtcactaggcgggcagcccccaccccccccagacggcccccccactgaggccccacgttggccattcccccttggagttggaaccctgggggtcgaaacaggaaggcagggggcagtggttgaaacatcaggaccctcccaaggccccggctttgaacaagacctttttgttttttgga

SEQ ID NO: 701616 - DNA, 218 bp, Homo sapiens
attaaagcagccggtctaaatgttgagcctttttggctggcttgtttgcaaggacctcgcaacgtcaaattgggagctcatctgcatgtaggggccgtggcctctccagcactggtgctcaccacaggaggtcctcccctcactctctctcactgaggaagaagtgacaaagaagagtcagagtctatataatggctttgctttactacctcttataa

SEQ ID NO: 701617 - DNA, 316 bp, Homo sapiens
tctctctgggcagcgacgcacctttaccattcactggtggctgctgcatggacttggcagcttctagtatctgctcctcaagttcaatgactcatctgctccttgggcttgggccgggcttccgctgctctagctttttggctgcagcctcaatggcggctgcagctcccaagagctcattctcagcaatgactgtggggtcctctgggtctaccccttctgttcccttcatggcttcagcagcctggatgagctcagtgacggaaccagccacacgctttgaatgtcctgtcaactgctgcttcagttctgggct

SEQ ID NO: 701618 - DNA, 467 bp, Homo sapiens
gaaaacgtctgcaaaataggctactttctgtagtcatttttcatttccaaagcactcagcaaaagctggctgttttattgtaagtactctggcaattcacctttcaattcaaatatcctgtagagaacgcttcctctgagaagccactggatgtctgtatggtgcaggaggttcatgtgctgtctgtccaggtttttgttttgggtgtttttttttttttaaacattttggcataaatgggtcttggatacaggtaaccagtttggtaacattatccagaacttcactgtatcttcagagtttggatatcagcatctcgtggggagaaagcaggggtgctataagtgtcaacatcgggatttctttttttttttaaaaaacgcaaagggctttagggggacacccacggggggggccccgggggggtagataccagacctcgggtaatcgagatttgatgtcccaac

SEQ ID NO: 701619 - DNA, 106 bp, Homo sapiens
cgcggctcggatcccgcgttgctgtggctctggcgtagaccagtggctacagctccaattagacccctagcctgggaatctccagcatgccatgggcatcagtccg

SEQ ID NO: 701620 - DNA, 501 bp, Homo sapiens
actaaaggtgttaacagctctatagcatccatgctacctatttactacatatagggactcatgccgagaagtacgacttaaaaaagctattctgctacatttcgtgtgtcaatgcatgaagtctagccttgtacataatacattttgtcgtcgtcttgtatgctatactaatgcagattgcttgattatgctaatgagtagtctcttacctcattctgatccattgtaatatagcacatttcagtctcagtcagtgatctagcaagaataaatcctggagatggaattgcatattttttcttttaaagaccatggcttttcccatttgttggtcacaggtaattttgtaaacagaaaaggaaacatattgctctcagtctctactgcaactttattctgtctctaaaaacaagagcctgcgaggtattcttcaaagaatgtatcactatatatgaaatctaaacaagaaacagagtcaacactgaagtgctggatggaaag

SEQ ID NO: 701621 - DNA, 819 bp, Homo sapiens
  misc_feature (8)..(8): n is a, c, g, or t
  misc_feature (17)..(17): n is a, c, g, or t
  misc_feature (75)..(75): n is a, c, g, or t
  misc_feature (148)..(148): n is a, c, g, or t
  misc_feature (166)..(166): n is a, c, g, or t
  misc_feature (176)..(176): n is a, c, g, or t
  misc_feature (181)..(181): n is a, c, g, or t
  misc_feature (195)..(195): n is a, c, g, or t
  misc_feature (214)..(214): n is a, c, g, or t
  misc_feature (223)..(224): n is a, c, g, or t
  misc_feature (228)..(228): n is a, c, g, or t
  misc_feature (248)..(248): n is a, c, g, or t
  misc_feature (253)..(253): n is a, c, g, or t
  misc_feature (256)..(256): n is a, c, g, or t
  misc_feature (258)..(258): n is a, c, g, or t
  misc_feature (260)..(261): n is a, c, g, or t
  misc_feature (267)..(267): n is a, c, g, or t
  misc_feature (271)..(271): n is a, c, g, or t
  misc_feature (280)..(282): n is a, c, g, or t
  misc_feature (286)..(286): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (311)..(312): n is a, c, g, or t
  misc_feature (315)..(316): n is a, c, g, or t
  misc_feature (325)..(325): n is a, c, g, or t
  misc_feature (350)..(350): n is a, c, g, or t
  misc_feature (354)..(355): n is a, c, g, or t
  misc_feature (363)..(363): n is a, c, g, or t
  misc_feature (412)..(412): n is a, c, g, or t
  misc_feature (433)..(433): n is a, c, g, or t
  misc_feature (443)..(443): n is a, c, g, or t
  misc_feature (448)..(448): n is a, c, g, or t
  misc_feature (470)..(470): n is a, c, g, or t
  misc_feature (479)..(479): n is a, c, g, or t
  misc_feature (481)..(481): n is a, c, g, or t
  misc_feature (509)..(509): n is a, c, g, or t
  misc_feature (558)..(558): n is a, c, g, or t
  misc_feature (595)..(595): n is a, c, g, or t
  misc_feature (614)..(614): n is a, c, g, or t
  misc_feature (623)..(623): n is a, c, g, or t
  misc_feature (675)..(675): n is a, c, g, or t
  misc_feature (688)..(688): n is a, c, g, or t
  misc_feature (692)..(692): n is a, c, g, or t
  misc_feature (704)..(704): n is a, c, g, or t
  misc_feature (817)..(817): n is a, c, g, or t
atgattancttctcatntggtggtggcaagcactaaaatcctgattttaacagaatagtagtaaaaatgcctcantgatttaagttgaaagccgtacactggtacatggctcttgtacccagtatcaggcatgtacaaatccctttcnttcaaaaatacaaaatanattatctgtnggcanggccaatgacagcngttaaccattatatatttngtgaactgnnaccngtaactgatggttatagtgnttttnagncngnntttttnttcnttttctccnnntggnttntntggngttattggtgagggcnntgnnttgggcttnctgtcacagttcattaataaaggtnaagnnctagtttnggtgttagaacatgccacctcccataccacctcccattccacccattgntcccattccagggtccttctnttctttaggnatttntgtgactacaacttctgctgtngttaacagngnggccacaccagcagcatccaataaagcngttctcacaacctttgttgggtcaatgattcctttttccaccatattcncaaaatctccagccatagcatcataaccaacttctgngggactttgcataattttntcaactatnaaagatccttcaacacctgcattcttagcaatggtcattgctggaatttttngtgttcttttaanaatntctataccaatnttttgatcttcattagctggagtcaatgagtccaaggctggaatgcatcgaaggagggcacaaccccctcccaaaacaatgccttcttcaacagcagctcttgtagcattaangg

SEQ ID NO: 701622 - DNA, 408 bp, Homo sapiens
cggagtggagtggaagtggaatggaatgtaataggaagaaatggaatcgaacggagtgcagtggagtggaacggattgcaaaggaatgggaaggaatggaattgaatggactggggtggaatggagtgaagtggaatgcaatggaatggagtggagtgcagtggaatgcaatggaatggaatggaatggattcgaatggaatggattcggaaggaatggactggaatggaatggactcaaatggaatttactacaacggaatgaatccgtatggaatggaatggaatggactggaatggaattgactctaatggaatggatcagaatggaatggactagaaaggaatgaactcgaatggaacggactccaatggaatggaatagaatggaatggacttgcaaggaatg

SEQ ID NO: 701623 - DNA, 446 bp, Homo sapiens
gggaataaaggatcatttgacaactggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaccttgtggcccccttggcccaagccgaattttaaattgggcaaggtttttcctgggggccgaatttgggcctaattggccaattcccccttatggggggccttttaaaattcaatggcccgggttttaaaaacgtgggactgggaaaaccctggggttccccaatttaaatccctttgaaaaaaatccccttttcccaagtggggtaaataccaaaaggcccccaccgatgggcctttccaaaaattggccaaccttaatgggcaatggaaattggaagccttatttttggttccgggt

SEQ ID NO: 701624 - DNA, 237 bp, Homo sapiens
caaatgctgctttattcttacaaatactgtaaaaattaatttaaaatatttgcatgctcagtcttttcctcttatctacaatacaaatggtttgtcttaaaagtctggttttttttctttttacaaatgtaccttatctgcatcaacattagtaatatgtataaaaatctaccattacaaaaataatttaaggtaaaataaacacgtttagcttctctcgcagtttagtggtggtaa

SEQ ID NO: 701625 - DNA, 288 bp, Homo sapiens
  misc_feature (5)..(5): n is a, c, g, or t
aattntgtatttttagtagagacggggcttcaccatgttggccaggctggtttcaaactcctgacctgatccgctggccttggcctcccaaagtgctgtgattacgggcgtgagccaccgcgcctgcctagactccccatttctaagtgtacagttaattcactagtgttaagtacatttacattattgtgcaaccaatctccgtaacttttttcatcttgcaaaactgaaactctgtatccattaaataagaacttcatattcccctgtcccttctgtcgtcttctc

SEQ ID NO: 701626 - DNA, 765 bp, Homo sapiens
ctaattttttaattttttgtagagatgggttacccaggctggtcttgaactcctggatcaagcgatcctcccacccctgcctcccaaagagctgggatcacagatgtgagccacagtgaatggccaagaaaataatttacttaggaaaccagtatttttttcaaacagaatatttaaagcaaaaagtctgaaaaaaaaaaacccataatgttaacatgtaattaaaatcataaattaacatttcttaaagcaaatgtttgacactgaattgaatctattccattattaccattggcctttaattattttcacttttgaaataaatactggcttttttttttggaaatgggagtttcgctcttaattggcccaggctggatgtgcaatgggcgcaatctgggctcactggcatactctgcctcccctgggtccaagtgggtcctcgtgcataagccacctgagtagctggggcgctcccccaccaaggcccagctaattttggtggtatttgggaatagggtttcatcatgtgggccaggctcgtcttgaactccgtggcctcaagtgatctgcccatctgggcctccaaagtgctgggatacgggcatgagccacagtgcctgaccagtctaggcttatcttaccagttgaggaatcggacaacctgtttgacatagggcggacatgggccaacggaacacctgcttacttccaatgttaatcaattccagcactatttctctattaaaactacctgcattatcc

SEQ ID NO: 701627 - DNA, 151 bp, Homo sapiens
gccatcgtgagccttaaggcaccaaggaggctaaaggtttgccactttaagaggggacctgagatctgcaactacagctactccaccacgttcttggctgtaagctcaacaggcagaggctgatagtatgcctggaggagtcctgtacatc

SEQ ID NO: 701628 - DNA, 255 bp, Homo sapiens
gtgattacaggatcttacagctctctctgatggttcttctggtatactaaggcgtggaggcaggtgagcttaccgaaaagtggaaagctacaggaaagtggatgaagagtgaagaagcggggaagtagagcatcccaagttgggctggagcggcagttgggaggagaaaacagcaagagtgcagcccgactgcaggacgctgctggagaggtgaacgagggaggcagcaggggtaccggagctcagaattcggta

SEQ ID NO: 701629 - DNA, 1207 bp, Homo sapiens
gcgggcagcaggaggacacgtggaaacgcaaccgccaggaggaaaggcgggacacagcgggaagggaggtttgcctcccctctcttcctgtggtgacccccacctcacttacaaaaatcaccaccgacgtttgggaaccgtgcacgccgacgtttgggaaccgtgcacgccgactgaaagcaaagctcagctgacctgcgaggagtccccggggagctgccgcggtggtcgccgttgagtccgtccgtgccgctggggccgaggcagctggagatgtggtcaacgggctgatgggcacggctgtgggaccccatcattcccctgccccgcatgactctgctctcccagctcgactgctcacttcagacttcccttatggaaggagttgccagatagagcaagtaaaatacagtgtgccagacacaggtttatttcaacactgggaaggctccattcctacttaaacccagcagggaacagggagcggtgtgcagaggaggtggcctgcccgggaagccggccttggtgctgggactgcagggagagggctgtgaggaagagcacaggcttcatgcacattgcacagaggaggagattcatggggacagcaggcactggttaggcacagcgggaaggttatcgaagacaaaacacatttctacccaagtttaaatgacctgctatgcccacagagcttgatccagaagtgcacaggtaagtatttagcaggctggccgatgttgatttgaacaatctcaagaatgtgctctttagtgcattaaacatatgtgacgagagctgagcacgtttaaaatctcagtaactttggggtttgtaagtgttgtagctcatagtgtcggttaaggttagacatctcagtcacatgctgtcttggcaccagctgtggactgtgctgtgaaagagatctgtgaccttgcaccctgagatctcaggctcaattaagagacaaaacaggcaatgcagtatcagtgcagatgggaaagagaaagcagaaagtatgaagagggaaaggaggagcacaaaggagttagcattagtctctactgagcaattcctattccaaccacgccctaaatgatgagttggatcctagcagaaagggaacacatgttatttttaactgattttaacttgatttattgtaacctatcaggagctcttaataaatatggctctttatgttgtt

SEQ ID NO: 701630 - DNA, 825 bp, Homo sapiens
gcgggcagcaggaggacacgtggaaacgcaaccgccaggaggaaaggcgggacacagcgggaagggaggtttgcctcccctctcttcctgtggtgacccccacctcacttacaaaaatcaccaccgacgtttgggaaccgtgcacgccgacgtttgggaaccgtgcacgccgactgaaagcaaagctcagctgacctgcgaggagtccccggggagctgccgcggtggtcgccgttgagtccgtccgtgccgctggggccgaggcagctggagatgtggtcaacgggctgatgggcacggctgtgggaccccatcattcccctgccccgcatgactctgctctcccagctcgactgctcacttcagacttcccttatggaaggagttgccagatagagcaagtaaaatacagtgtgccagacacaggtttatttcaacactgggaaggctccattcctacttaaacccagcagggaacagggagcggtgtgcagaggaggtggcctgcccgggaagccggccttggtgctgggactgcagggagagggctgtgaggaagagcacaggcttcatgcacattgcacagaggaggagattcatggggacagcaggcactggttaggcacagcgggaaggttatcgaagacaaaacacatttctacccaagtttaaatgacctgctatgcccacagagcttgatccagaagtgcacagtagagacggggtttcaccatgttagccgggatggtctcgatctcctgacctcgtgatctgcccgcctcaggctcccaaagtgctgggattacaggagtgagccacggtccc

SEQ ID NO: 701631 - DNA, 482 bp, Homo sapiens
tgcacctactgcccaagtcacgattgaagccgtagcaccaaagtttccgagtggaaggatgttcttctacttgtacacaattttgccccataatcttaccggctacatctggtacaaacgggcaaatgacaggacctctaccatatacattacatcattatttagttacacggttaaataagttatatatacggcctgtatatagatggacgatgaaacagcttattccaactgcttccctgcttgtatccagacgtgttacccgtggtggacgcagtgatcctacatcctttacacatcataatagggagatgatgggcactagaggcagtaactggacgtttcaccttcaccttacacctggagactcctaagccctccatctccatcagcaacttaaatcccagggagaccatggaggctgtgagcttaacctgtgaccctgtgactccagacgcatgctacctttggtgtattaatgg

SEQ ID NO: 701632 - DNA, 455 bp, Homo sapiens
  misc_feature (26)..(26): n is a, c, g, or t
tggccaagaagaagaagaagaagaanccggggccacccaaggcccccgccaagaaaccgaagaagccagccgcgaagaaggcgtgcattaagccggtcggcgctaccgccaagcgccaaggaaccccgggcccgaccggccaccacaatggccgaaggcgcatccaccggaaggccttaatgcgcgtgtacgtggcccagttggtggccaggccagctttcaaggtgcccttcctggtgggccagtacctgctgtacggcttcgaggtgcgaccgttctttccctgcagccgccagccctgcccgcacgtggtggactgcttcgtgtcgcgccctactgaaaagacggtcttcctgctggttatgtacgtggtcagctgcctgtgcctgctgctcaacctctgtgagatggcccacctgggcttgggcagcgcgcaggacgcggtgcgcggccgc

SEQ ID NO: 701633 - DNA, 328 bp, Homo sapiens
ggttttttttttttaaaaaaaaaatttttttcacccccgggggtttttttaaaaaaattggtttttaaaaaattttcccgggggttccgggccccaacccctttttttaggacccaaaatttttttaaaatttcccccccgaggggggggtttttttttaattcccccaaccctgggggggtcccgggggaaagaccctttttttaaagccttgaaaaaaggggcccttcccctttttttttcaaaaaaccttttttcctttttttgggggtccccccccttttaattgggggttttggggggcccaaaaaccctctttcctttttta

SEQ ID NO: 701634 - DNA, 732 bp, Homo sapiens
  misc_feature (339)..(339): n is a, c, g, or t
ctgggttcgggcatcagccaccacctccagaacaatgagctactccgtgacatctttggcctgggccctgtgctgttgctggatgccactgccctgaaggcctgctatgttccacgctttgagaagcacctgtacaatagctagcttgccttcaaagcccggaccaaggctcgtaagtccgtgtgcgggacaatgtcgggtcagacaatccgtgtgaagcaggacctgtctgaagaggagactttgctatgcccttgtgatccgtattctttaacgagaagacatgtgcaacaactggtctccagcctaagtatttgtcatcttgtattttgttttganatgtagctaaaacacaagatacacagtacatggggtgggtagctagggtggcccggacacttgggacccgtgacccctttgtccctgcagctcagcccatgtggccccttcctgtcctgtctcaggccaggctattatatgtgccattcctcaggtctgtggggcaggcgctagggggcctttcctcttcctttcctttctcaggccttgctcccccaggatgatcccactcttaggggggtggtggcatctggacgaatgccaccacagcaggtggtggtggcaaagctacctggaatggattcgcgtgctgatctgtaaggatgattacatgctattaaaccagaacggtcatgccttcaagattaattttcaactatagggccgttaggg

SEQ ID NO: 701635 - DNA, 476 bp, Homo sapiens
  misc_feature (335)..(335): n is a, c, g, or t
  misc_feature (385)..(385): n is a, c, g, or t
ccgggtccatgcacagttaaaagccatatagcgcgccacctaatagattctacaattaacatttggctatacagacagtccccaacttatgagggttggacttacaatttggaccttactatgggttatcgggggcatggaaggcattttcaacttatgttattttcaatttatgaggggataactaggatgtaacaccatggcaagtcagggggcatctatactggctagaataatctcttaaatttataaatcaggtctggtcgcttccgtatttaaaaccagccaatcattcccatcacactcagagtaaagttaaagtcttgccaggcggngtgcggtggctcaggcctgtaatcccagcattgggggaggctgaggctgncggatcacctgaggtcaggagtccgagaccagtctggccaacctggagaaaccccatctctattaaaaataccaaattacctgtgcgtggg

SEQ ID NO: 701636 - DNA, 116 bp, Homo sapiens
tgtgtagatcaacaagaaatgttatgaaatggcctcccaccttcggcgtcccagtactgacctcgatctgtcccattccccttcaccgctccccacagctttgcacccctttcctc

SEQ ID NO: 701637 - DNA, 378 bp, Homo sapiens
  misc_feature (17)..(17): n is a, c, g, or t
ctggccaaggggcattnttgcataatatgattagggtgggatgaccagccttccccgtgcagcatgtaaatggcacacctggccaaaccaatctgtggaccctatgtaaatcagacaccacctcctcaagcctgcctataaaatctgctgtgttggccacttttcccttttttgtcagaaacctctctctcaagagagagagctgctctgctgtctcctttcttctgcctattaaactctgctccttaacccactctgtgtgtgtgtccatgtccttaattttcttggcatgagacaacaaaccccaggtattcaaccccagacaacaatgtcacttcattatgccagagtcagggtaggaaagtaaggttcatggat

SEQ ID NO: 701638 - DNA, 994 bp, Homo sapiens
  misc_feature (31)..(31): n is a, c, g, or t
  misc_feature (89)..(89): n is a, c, g, or t
  misc_feature (196)..(196): n is a, c, g, or t
  misc_feature (204)..(204): n is a, c, g, or t
  misc_feature (320)..(320): n is a, c, g, or t
  misc_feature (335)..(336): n is a, c, g, or t
  misc_feature (355)..(355): n is a, c, g, or t
  misc_feature (364)..(364): n is a, c, g, or t
  misc_feature (368)..(368): n is a, c, g, or t
  misc_feature (370)..(371): n is a, c, g, or t
  misc_feature (378)..(379): n is a, c, g, or t
  misc_feature (384)..(384): n is a, c, g, or t
  misc_feature (391)..(391): n is a, c, g, or t
  misc_feature (396)..(396): n is a, c, g, or t
  misc_feature (398)..(398): n is a, c, g, or t
  misc_feature (401)..(401): n is a, c, g, or t
  misc_feature (409)..(409): n is a, c, g, or t
  misc_feature (442)..(442): n is a, c, g, or t
  misc_feature (444)..(444): n is a, c, g, or t
  misc_feature (446)..(447): n is a, c, g, or t
  misc_feature (449)..(449): n is a, c, g, or t
  misc_feature (453)..(453): n is a, c, g, or t
  misc_feature (457)..(457): n is a, c, g, or t
  misc_feature (463)..(463): n is a, c, g, or t
  misc_feature (472)..(472): n is a, c, g, or t
  misc_feature (475)..(476): n is a, c, g, or t
  misc_feature (510)..(510): n is a, c, g, or t
  misc_feature (512)..(512): n is a, c, g, or t
  misc_feature (517)..(517): n is a, c, g, or t
  misc_feature (526)..(526): n is a, c, g, or t
  misc_feature (529)..(529): n is a, c, g, or t
  misc_feature (537)..(537): n is a, c, g, or t
  misc_feature (554)..(554): n is a, c, g, or t
  misc_feature (566)..(566): n is a, c, g, or t
  misc_feature (611)..(611): n is a, c, g, or t
  misc_feature (659)..(659): n is a, c, g, or t
ttattaacgtttattgtcttttttattattnccttttatttttctcacgtttcccagttaaatttatgttaagacactattaaatttcngacaaaatatatatatttcttttaaatctttacaataaatcaagatgtagaagcttacatagggcacatttttgtttatttaggtactcaattccagctcccttggntgcaaatnaccctggtgacagtgtgtacaaagtcttctctttgctttttataattttaaagcaaataacacatttaactgtatttaagtctgtgcaaataatccttcagaagacatatccaagnctctctttgccgagnncattttctctctcaaagangattccctncctntnncttcagnnaaccncctcctntccancnganctcaaaangccttcaagctgttcagtaagtgtagttcaganangnntncgtnatangggttngagcttccngtnngcactgtacatgccccagtgaacaggcgagaggntnttttngttgctgtngtntgcttgtnttatttttttacaggtnagttagcagttnttgtgcccactgaccggcaccatgcattccaagtttaactttgcnacctgcccctttttggaatggtgtccgtgaaagctgtagtgcaaacgngagagcatctgttgccgctgatcctgcagcctcttattttcacttcgaagcatcctcagggccaacataataagcaacactaaaatcagccctccagcaatgggcacggcaatgaccgctgcccggaaccacaactctttggaagaagtcagctcctgcaccttggtgataaggtttctgctaccatcatgctgatacctgtttccttgtcctgaggcctcacccctgggaggagagagaacatcgtgcagccctctgtaattgcacatgtcttcatgacagcattcaatgtgggtatggtggtgccagagtggtttcgggcctgtttggcttgg

SEQ ID NO: 701639 - DNA, 669 bp, Homo sapiens
cagtattacagggagaatctcctggggtatattattccttaacagttccctggaatgtattaaactctggacaaatagggatgctgggatctcagggtggagtttttggttactggatggtcacatggattgaaaaccaagttctggtcctgggctatgatggttggttcctcagaaaggcttctgggtctaaccacaggctcccactctcactggttggtggttctctctttggatggtatttctttctttagatcacataataatttcataatatcaatttggtttacttaattatagtggtccccccttcatttgggtttcaactctattttcactttttttttttattttgagacagagcctcgctctggtcaacccagctggagtgcgaaggggtgaccttggctcactggaatctctaactcccaggttcaagcgaatttcggggctcaggctcccaagtagctgggattaccgggtgctggcaacatggccaggtaatttttggattattaatagacctagggtttcggcctatcaggcaggctaatctccaactcctgatctccagtgatccattggctgttattccagaactatggaggtctaggggaccggaatcagagtcgtgacagaagggcactaggactcttggacacacatcgt

SEQ ID NO: 701640 - DNA, 448 bp, Homo sapiens
aagaattcggcacgaggcagctcggaggcgctggggtcctaagttcctggccccacggcgcacagcttccccaccgcacagcccccagcgtacagggcccctgccggccgccgcctgcccaccctgcttgccgcccaccggtccccgctcggccccatctcagcctcatctctgggttctttccctcgtcgaggcctcttcgttcatttgtttgtttgttctctttctctctccttccctcccctcctctttctctcccccttttttttcttttttccttttttttttttttttgtctctgttctgtgtacccaggcagcccattgagtaacttctttgacgtaattaaacaacttttttcagacgagaagaacgggcaggcggcccaggcccccagcacgcccgccaagcggagtgcccacggcccactcggtgactccgcggccgc

SEQ ID NO: 701641 - DNA, 1035 bp, Homo sapiens
gggatcggtcgcctgaccaggtatcagctcttctgggctcaagatggacaacaagaagcggctggcctacgccatcatccatgttcctgcatgaccacgctccggcacgggggcctcttcgtccgatgctcaggaaaacttggaagtcgccatccagttgcctggagactgcgtttgagggtgacgtgtagaagacagtgaccttgcagctccctcatactctgtccggacgatatttagaaggctggactgccacgggcaaggagatgcctgcaggacctgaaggaagccccgcgcggaaccccgtcttccgaggaggactcagcagaggcagaagctgcctcaaaagccgaaggaagacgagcagatgaaacgtgcgaaacactttggaatgctgccgtagcgattctctacgggacaatagccgatcgacgctctagtcactactgcaaacgccgtgctaattgtctgctagacaggaagggcgcacgcgcttacagcggagacatcgggccaacctaccgcacggcacgcagttggccagtgacttgttgagccgagggcccaaatctggggcacttggaccccgggacccgtaccagccaaaggccctacgggccagcggcaaggggccctggcggcccctcccagcccgccaagcagccacgtagggaggcccgtggccttccacgtaacaagaggaaggggcatctgggcagcctgtgaagacccggaacagaggcaaggaacattacgagggttccccaaccctgcaaggactgggcgggagcctggaagacctgccacgggaagggccgccaaggccccacggcggagggccgctgggccacgcaattcgaacatccgcgggggcctgctttgaaagcaacccgctgggggttccattgaacgcagtggatatcgaccctaaattgaacgtaagggcccgcagaattcaggacaggtctagggtccgcgcatgaattccccgtgggtaaccagccaccgttgggaaatccacgggaccggaccatg

SEQ ID NO: 701642 - DNA, 440 bp, Homo sapiens
  misc_feature (112)..(112): n is a, c, g, or t
  misc_feature (375)..(375): n is a, c, g, or t
  misc_feature (421)..(421): n is a, c, g, or t
  misc_feature (430)..(430): n is a, c, g, or t
  misc_feature (432)..(432): n is a, c, g, or t
  misc_feature (435)..(435): n is a, c, g, or t
caggctgttactcaaaattcactctccagccctgctttggagcagttgggaacttcagcattttgatccacctttttggagccacctcatgtgaaagatggatgagaccttngtcagcaaacctggtaagacctcaccagtcctgtcctgaggaatgggtgttagtttttgccttgcccttcaccctggagagttaagcatacgttctttgggtggaggtaaaatgtgactactctctccacaccacggggaacatcagaaacacaagtatgcaaacacacattcttgttcacctatacacaaataaattcccttttagagtgaaaaccagacactgtttaaagcgcccactttaaaaatgaaaactaagacttntgaaaacaagtaataacaactgatctttggacttaatttttttttngagactgcntntcnaaaaa

SEQ ID NO: 701643 - DNA, 636 bp, Homo sapiens
gctgcttccccagctccagaacttccggccagtgcatgacattttggcttcctgaccttgtgctacggctgcatccgttatcctaagtagtgtgtactccggtgccatacatggtcctgtcgctgaacgcctgctgcttgcatgcgtggtgcttgacaaggcttctggctccggtggtgtcccagtgaccgcgcgcctagatcccattcgttgaccgccggaggggtacagcttgggatcatgggaattggtcggtatgcggctttacctcctgcattccgtgacccttcactccgtgtccacgcgggtcgtgtgactccgtgtcagcaccgtggaggatcgcttacagggatggccagatgtgaacggggtccgtttctgatccctcagactgtgacctgaccagaccccaccggacccaatccgtggtacatgttagctgccactttagtaggcgcgtgccgtcccctgcgtagtcatgtcacttcgatacttgccagtcagcctcttctgcactcatgacctcttgatgtctccatggtgacctccttgggggtcactgactcctgcgtgtgtggcggtcccccttgttaacaatataactctatttaaactttaaaacaaaacaaaaaaaaa

SEQ ID NO: 701644 - DNA, 492 bp, Homo sapiens
ctatccaagctgtacaggctgagcctgggacactaacagatcaggatgatcgagaacgggagcctgagcttcctgcccaccctccgaggagctccacattggaccacaacacgttggccaggatgccctcaggactcccagaactcaagctcctccaggtggtctatctgcactccaacaacatcaccaaagatgggtgtcaacgacttctgtcccatgggcttcggggtgaagcgggcctactacaacggcatcagcctcttcaacaaccccgtgccctactgggaggtgcagccggacacttatccgcatgcgtcactgaccgcctggccatccagtttggcaactacaaaaagtagaggcagctgcagccaccgcggggcctcagtgggggtctctggggaacacagatagacatcctgatggggaggcagcgccaggaagctaagccagggcccagctgcgtccaacccagccccccacctcgggtcc

SEQ ID NO: 701645 - DNA, 606 bp, Homo sapiens
aatgtgaagatatcagactttggctttgccaagatggtgccttctaaccaccctgtgggttgtagcccttcttaccgccaagtgaactgcttttcccacctcagccagacttactgtggcagctttgcttacgcttgcccagagatcttacgaggcttgccctacaaccctttcctgtttgacacctggagcatgggggtcatcctttacactctagtggtcgcccctctgccctttgatgacaccaatctcaaaaagctgctaagaaagactcagaaggaggtccctttcccagctaaccataccatctcccaggagtgcaagaacctgatcctccagatggtacgccaagcccctaagggggccccccttttggacatcatcaaggatttctggggggtcaagttccagcctgagcaacccccccatgagatcaggctgcttgaggccatgtgccagctccccaacccccctaaacagccccaatccttgcaaatttcgccctgaaaatggctgagggaggggggtaaaaaaggagcaaaacaggaggttttgggctaaaaatcttttttaccaaaaataaatttaagtttgatttagtttcca

SEQ ID NO: 701646 - DNA, 136 bp, Homo sapiens
aactattgaacagtgggtcttagtgtgtagtataactttgctgtatacaactaattttgacaagttttcatcctaagcctcaaatcatgtaataaataatttgcctgtatattttctttaattgtgtaaactgatt

SEQ ID NO: 701647 - DNA, 336 bp, Homo sapiens
agctgaatgctgatccgcgagtattggctccgtgaacaacgtgaggtctggcgggtctatttaccctggccaagatccgcaaggccggccgggatctgctgatggcttgtatgagaaggacccacggcgtctgtacgaaggcaacgccctgctgtggaggctggtccgcattgggtgtgctggatgagggcaagatgaagctggattacatcctgggacctgaagatagaggatttcttagagagacagcctgaagacccaggtcttcaagactgggcttggccaaagtccatccaccacgctcgctgtgatgaatccgcagcgccgtcgcctacg

SEQ ID NO: 701648 - DNA, 395 bp, Homo sapiens
  misc_feature (297)..(297): n is a, c, g, or t
ggtatgagggtgggagtggcttgttttgttgctggcttagttagtatctggtgggggaggctgtggagtagctgtgggtatagtagggcctttatttaatgttagtggataggggctctaggccttttaggagtagttatgctggggctgagattagggacttacttttgtagggggtttagggttagggagaggataaaggggtctttgggggagatgggtgggggcccactttgtagaaggagtccatggatagcaagaccactcagggcacatccagggctttgatgatcattntggccacagtggtcttcccagaggcactgccgcctcccaagccgatggcgaaggcctctatggattgcgtgccgtgttcattgtaccagggcggccgc

SEQ ID NO: 701649 - DNA, 280 bp, Homo sapiens
tctagaggatccctgctggaactcttatgatccagagacagtttatttttttagagacagatcttgctctgtctccgaggctggagggcagtggtgcaatttcggctcacggcaacgtctgcctcctgggctcaaacaattcttctgcctcagcctctcaagtagctgggaatacaggagcccatcaccatgcctggctgatttttggattttagtagagatgggtttcatcatgttggccaggctggtctcgaactcctgacctcaagtgatctgccca

SEQ ID NO: 701650 - DNA, 105 bp, Homo sapiens
gcccacctgaagttgaatttttaaatcactaacaagcaaacaaaaacagaaacttctcaggaaattagatcgactggagaagaaaaaaaaagaaaaaagatagaa

SEQ ID NO: 701651 - DNA, 305 bp, Homo sapiens
agaattcactaatgaaataatgtgagtctggggttttctttgtgagaaagcatttgataatgaattcaatttctttaacagatataaaatctattacaatttcttattagtttttatttatgtttcttcatctgcatcctaataattttgcatgttgtgtttttattattagtcaattcaaactattttctctttccccatgtgatttattctttgccccgtggattatttggacatatatggcctaacttccaaatagggttttctaaatgtctaattgttatcaatttctaacataattccat

SEQ ID NO: 701652 - DNA, 925 bp, Homo sapiens
ttggcccctcggttcctgcctctgtccgccgctgtgcgaccccttctgtgtctcctggggatttccctctggcgttccttgtaccgtcactatttcttggctattggtttcctcttatcggcatatgggtcctcctactgtgttgtctgtgctcctttaccggggttatatctggttgtccccttgtcttctgacggcccctgttttacctcgtccacgcttcagatgcgctcgttttgtaacccccggcccatctgttgctcgcccaagtcttcgccgttctaacatcggccgtcctggacccttagctctcagacatcgctcttcttacgtaggtacccccctcccctgtacccaagcccccgagtcaacgcgtctagcgcaggcgttcgcttattgtattcctagcgcacgctctagccttagcacgtttactcaatcctctggatacagggtgagtcatctaactcttaactacgccctgaatcggcgcactgcgaggcagtagccctattacaatgcttcatatgaagtcaccctagcgcatcattctactatcgaccattactaactaagtggctcctttaacctctccacccttatcactgaccacaagaacacctctgattactcctgccatcatgacccttggcacataatatgattgatctccacactagcagagaccagaccgtaccccgcttcgaccgttgcacgaaggggagtccgaacgttagtctcaggcttcaacatgcgaatacgcgcgcaggccccagtcgccctattcgtgtcatagccgaatacacaaacattattataataaacaccctcaccactacgatcttcctcggaacaacatatgacgcactctcccctgactcatacacaacatattttgtcaccacgaccctattgcctacctccg

SEQ ID NO: 701653 - DNA, 231 bp, Homo sapiens
atcagatcaaggagctcatccagtcgcgaccgatctggacgtctgcaggtagcctgaaacgaagcgatgccttttcttcggcctcgtcgcggctcttcacgagcttttctaattcttcccccattgctgtgttttactggtggtccaggcacaacttgtgataacgggcggcgtatttgttgacatcctgcaggtgatgcaccgcggccgaattcgcgcccaggaaagctg

SEQ ID NO: 701654 - DNA, 872 bp, Homo sapiens
caactgcttcgatcccgccggaggaggagaccccattctatactgaagacctattctgattgatcggtcaccctgaagtttatatccttatcctaccaggacttcggaactaatcgtcccatacttgtaactgtagcgttactccggagataaaaagaaccatattggatacaataggtagtggctatgagacttatgactattcaagttggttttccttagtggctttatcgttgtgagcacaccaatatattgtgcagtaggaagtagacgtagaacacacgagccatagttgtcacctccgatagccagtaatcgatcgaataatcccccaccggacagtcaaagtattctaggcggactcgccacagtccaacggaatgcaatatcgaaatagatctgctgcaagtgtcttctgtagacccctaggatacactacttcactatattcaccgaaggtggcctgagtggcatggtatcatgctactcgcatgactagacatcgcgcgtacacgaacgtactacgttgtagcccacttccattatgtccgatcaataagagctgtgttcgccatcataggaggttcattcactgatttccctaatttctcaggtaaaccgtagagcaagcgtacgccaaaatgcatttcacttatcatgttgatcggggtaacagctaaggtgggcccaagaacactttgtcggctatacgggaatgcccgacgttagttcgggactacccgatggataaccacattgaagatcctattattggaggcaatcattcctaagaagcggaataaccatctcagtggaaaacttcggtaaagaaagccaaagtgaagacccaacgggaggatggggcccccaag

SEQ ID NO: 701655 - DNA, 638 bp, Homo sapiens
  misc_feature (220)..(220): n is a, c, g, or t
  misc_feature (325)..(325): n is a, c, g, or t
agcggagcgtcagagatcagaggaagaggaacgggcggagctgctttgcggccggtcagaggagacagcgcagttcgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgncagagctgccccaggtccggccgggagcagggacaagacgggaccgccggagcccccggactcctttggatgggcctggcgctggcgctggcgctggcgctggcnctggcgctggttctgtctgactctcgggttctctggcgctccggcagaggctcacacctctttctcccacaaggacatcctgccaggtaacatcgcattagtgtcccggactcccgacgatgtctttggactgggggaaccctcacctgacccaatcatgaaaaggtctattcaacagccatcaacctcgggctgacagaaggaagcgcaatgtggctcgcgtgggctccgtggcacatcaagctgtgcaatcatgctgacgatagcaacaactggcgtgtgccaatccattgtccactcatatgagggatga

SEQ ID NO: 701656 - DNA, 293 bp, Homo sapiens
  misc_feature (9)..(9): n is a, c, g, or t
  misc_feature (55)..(55): n is a, c, g, or t
  misc_feature (152)..(152): n is a, c, g, or t
  misc_feature (267)..(267): n is a, c, g, or t
aagaaagtnacctacaaagacttggaagctacctctgcagcattcctggtattcnttgaaaatctcctgtttcagaaccaagttgctccagccttaccttgagaactggcatgagtgtagtttgaaatttagatgtcttttattttttcctntttactaataaagctcataaggtattttcatattctagttataaaactgaaaagtctgcaagtagtgatccaggaaggtaggaaattattccctgggagacaggaaagcacacanggtagtaattcagtttttgattctct

SEQ ID NO: 701657 - DNA, 549 bp, Homo sapiens
  misc_feature (220)..(220): n is a, c, g, or t
  misc_feature (325)..(325): n is a, c, g, or t
  misc_feature (337)..(340): n is a, c, g, or t
  misc_feature (343)..(345): n is a, c, g, or t
  misc_feature (349)..(349): n is a, c, g, or t
  misc_feature (351)..(351): n is a, c, g, or t
  misc_feature (353)..(353): n is a, c, g, or t
  misc_feature (364)..(364): n is a, c, g, or t
  misc_feature (375)..(375): n is a, c, g, or t
  misc_feature (403)..(403): n is a, c, g, or t
  misc_feature (426)..(426): n is a, c, g, or t
  misc_feature (431)..(431): n is a, c, g, or t
  misc_feature (438)..(438): n is a, c, g, or t
  misc_feature (443)..(443): n is a, c, g, or t
  misc_feature (445)..(445): n is a, c, g, or t
  misc_feature (454)..(454): n is a, c, g, or t
  misc_feature (458)..(458): n is a, c, g, or t
  misc_feature (462)..(463): n is a, c, g, or t
  misc_feature (488)..(488): n is a, c, g, or t
  misc_feature (515)..(515): n is a, c, g, or t
agcggagcgtcagagatcagaggaagaggaacgggcggagctgctttgcggccggtcagaggagacagcgcagttcgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgncagagctgccccaggtccggccgggagcagggacaagacgggaccgccggagcccccggactcctttggatgggcctggcgctggcgctggcgctggcgctggcnctggcgctgggnnnngcnnngcantntntacgcttagangccctattaantcatactaccagaaatatagagtggagnaaatttcaatgaagcgtatccgnaatgncaatacngcaanancagaatacngctngggnnctgcctcctaaagataaagtcaaanttgagcaaaactcgtgaggataactanagataaagaccctgctacaactaaataaaagtgc

SEQ ID NO: 701658 - DNA, 150 bp, Homo sapiens
ggactttgtcttgttctcgtctctctctctctatacacacgcacacgcacacgtgactgtaacagtgcctggtgcacaattaggggtcggcctattgttggctaattgaggttgaatttattcttgtccggacctgtttacaaggagagt

SEQ ID NO: 701659 - DNA, 825 bp, Homo sapiens
tccatgccagagggcatgtcctgtgtccgactatctgggtagattccagttccgcgcagctctaggtctgaaactgcctctgtaacacgttctgatccactgtgggtgatacttaagtgctggcatgattaacagatggaatttggtgtgtaccaaagagacgcgaatgtgatgatgagacgcagtgattcttgcttacatagtgacctagagagttaatcttaattgctagattgtgacgtccgtgtccttggtagggatagactttcttcagattccatgtgctctcttaaatggcaaattacagttaaagaatagtatggctccattcccctcacttattctccagttaatgtgcttgtcagttccatttcaagagagcagtgatgtcccaggttcgattcagttttgactgtgcgcactattgccaaatggtcttgagcaaagattctgcactggaacgtagacgttgggaacagtactacctagctagaggttatgtgtgggctcttactccccgttttcacctctttgctttcccaattcaagaacagcaagtgagcgctgtctggtattcgaatcattagcagaacaaggagggagtggtggccgagttgtccttctttgcagtagggacatgctgtgatgtgtcggtttgtacagctattctttgtggtgccgcctgaagattggtccacaggtagatgtacgggctgcagatctgtgtaaacctgaacattgttctggcggagcggcggtgagggaaccaagggcctgctgggcctacctgggtgacctgcactcccagcggttggaccttttcac

SEQ ID NO: 701660 - DNA, 728 bp, Homo sapiens
  misc_feature (42)..(42): n is a, c, g, or t
  misc_feature (58)..(58): n is a, c, g, or t
  misc_feature (108)..(108): n is a, c, g, or t
  misc_feature (141)..(141): n is a, c, g, or t
  misc_feature (146)..(146): n is a, c, g, or t
  misc_feature (230)..(230): n is a, c, g, or t
  misc_feature (344)..(344): n is a, c, g, or t
  misc_feature (355)..(355): n is a, c, g, or t
  misc_feature (361)..(362): n is a, c, g, or t
  misc_feature (365)..(365): n is a, c, g, or t
  misc_feature (367)..(367): n is a, c, g, or t
  misc_feature (379)..(379): n is a, c, g, or t
  misc_feature (384)..(384): n is a, c, g, or t
  misc_feature (391)..(391): n is a, c, g, or t
  misc_feature (409)..(410): n is a, c, g, or t
  misc_feature (412)..(412): n is a, c, g, or t
  misc_feature (414)..(414): n is a, c, g, or t
  misc_feature (421)..(421): n is a, c, g, or t
  misc_feature (424)..(424): n is a, c, g, or t
  misc_feature (436)..(436): n is a, c, g, or t
  misc_feature (449)..(450): n is a, c, g, or t
  misc_feature (463)..(463): n is a, c, g, or t
  misc_feature (473)..(473): n is a, c, g, or t
  misc_feature (483)..(483): n is a, c, g, or t
  misc_feature (490)..(490): n is a, c, g, or t
  misc_feature (502)..(503): n is a, c, g, or t
  misc_feature (505)..(505): n is a, c, g, or t
  misc_feature (514)..(514): n is a, c, g, or t
  misc_feature (536)..(536): n is a, c, g, or t
  misc_feature (547)..(547): n is a, c, g, or t
  misc_feature (553)..(553): n is a, c, g, or t
  misc_feature (562)..(562): n is a, c, g, or t
  misc_feature (693)..(693): n is a, c, g, or t
gcacgagggtggagggcgtcactgggtttcggcgtctggcangcggttcagctgtcgntccctagcagccggccttcgggtcgggcgtctccgccggtactgccgctncagttctcccggtgtggccacgagtcgggttgnactgntgtgatccatcctcatctcctaaagatgcatcctgacttatctccacacttgcacactgaagaatgcaacgtcttgattaactngcttaaggaatgtcacaaaaatcacaacattctgaaattttttggttattgtaatgatgttgatcgggagttgagaaaatgcctgaagaatgagtacgtagaaaacaggaccangagcagggagnatggcnntgnantgcgaaagaaanttttnaatcctncagaggaatccgaacaannantngtatttncantcgatgcctggntgagagaagaccnnaagactctgggtngatacctganagaatcctgncttattnggtctccataanncntttgatggnaagtgacctgtgagagattgancatggagaatntgaaancctggatcngagtattgtgggcaggcgttaagactggctcccttaccagaaacctgacttacatgttaatcctttgctacaacaagtatatccgaggaactatctcctcaataaattattaaataataatcacacttacntccattacttggccggcgttttcaccggcgggctg

SEQ ID NO: 701661 - DNA, 143 bp, Homo sapiens
aactcaaggtagaaaacttactcattataaaggacaggaaaccattatccatcatagagcaaaaaaatcaacagcaaacttatttctttgctataaaactcattaggtacatatgtgcattaaggcttgggtacagaccgtcg

SEQ ID NO: 701662 - DNA, 260 bp, Homo sapiens
  misc_feature (3)..(3): n is a, c, g, or t
  misc_feature (40)..(40): n is a, c, g, or t
  misc_feature (200)..(200): n is a, c, g, or t
  misc_feature (226)..(226): n is a, c, g, or t
  misc_feature (248)..(248): n is a, c, g, or t
ctngtcatatatggagcgtccggccagagttggaagcgtnagtcagttcgaaattcattttatagcaattgacaatgtttctatctgaacctgagagaataaaaggtagttttgaattagacaaaatagacctaaaagttcaaacaaatggtggaaggattgtaaaaatcgtgcaaaaaattccatgtgtcgttatattnactaaattcaaaaaggtactacatgntttttctgtaaataaaaaattnaaataaaaacac

SEQ ID NO: 701663 - DNA, 115 bp, Homo sapiens
acttctcataccgagacatgtaatatgcctgcgtaactgtatacaccaattccgctctcatgaggtgaagttcctacatccgagttatcctgagagaagcaccagctataggtac

SEQ ID NO: 701664 - DNA, 259 bp, Homo sapiens
gggcaaaggaatttttttcatgaataagttcaaggaaaggttctttgcccaaatgtgcccgtaggccaaatttgttttacgttacacaaacattttagtgtagcaaagagtaacaaagcagttttgttgccagcatattttgcctttagccacaaaggggtttttttcttttttaaaataaaacgaatgggaatggtcggttttacactgaaacattcctttcccagggacgagcaggaaacaaatgccttccttttat

SEQ ID NO: 701665 - DNA, 593 bp, Homo sapiens
cgggaggcggaggttgcagtgagccgacattgtgccactgcactccagcctgggtgacagggcgagactccatctcaataaataaataaataaataaataaataaataaaaaaaaaaaaaaaaaaaaaaaaaaaaactgtgtgtgcggcgcgcgccccgcggccccccgaaaaagctcttctaaaccccatcgcggtggggcggcccggggcccccaaggagaggaagagggaaacgatggggccaaaacgcgtggttccctaagagagagaaccgcggggccagagaaaaaggggcggggacatctcccccccaaataaaaacagcgcccgcgggggccacacgcgagaggcgttccgtgaacaaaaacccagaaggggagtcccggaaggccccactaagcgggggacctatcaccacacgggggctcccaaaggggagagccgctcggaaatcttcccaaaattaaaacgccccgagcccccggggggaggcccccaacgccaagcaaacaaacgccagccaccaaacacacaaacacacacaacacaccgagacacagaacacaacacaccacaaaaccccagaacaca

SEQ ID NO: 701666 - DNA, 170 bp, Homo sapiens
  misc_feature (4)..(4): n is a, c, g, or t
  misc_feature (7)..(7): n is a, c, g, or t
  misc_feature (21)..(21): n is a, c, g, or t
  misc_feature (44)..(45): n is a, c, g, or t
  misc_feature (47)..(47): n is a, c, g, or t
  misc_feature (49)..(49): n is a, c, g, or t
  misc_feature (54)..(54): n is a, c, g, or t
  misc_feature (72)..(72): n is a, c, g, or t
  misc_feature (90)..(90): n is a, c, g, or t
aagnccncatggagatttggnggacactggttaaagaatttatnncntngtatngtatactatgttcatggngcagatactacaacattntggcattttagactcgttgagtttcttgggcaactccaagggcgttggggtcataaggagactataactctacagattgt

SEQ ID NO: 701667 - DNA, 143 bp, Homo sapiens
tgacaacacagaggagggggcagccagagggggctgaagaaaatggcaacagcgacacgaagaagaaggccaagcgagactagcggtcatccagacccctgcccacctagactgtttcctgagccctccgcctcctctgtgct

SEQ ID NO: 701668 - DNA, 572 bp, Homo sapiens
tctttttattatgatcttttggtaaatttgtattcatatgttgcatctggatttttttctactataccttttagaaagtaggaacttaaaaaaaaaaaaaaagaaaaaaagaaaagaaagttccagagaaagaaaggggtgatatgaaaaagtcatgatgtggaaaataggtccttcaaagagggcaaattaaaaggaattggggttacttttctgaaatggggaaagggctaagagaagtggcagcataatttttaaaactaggctaagaatcaacagctggttatttctagttcaaggtgcgtctttggccttagacaaatccaatggatgatgatgatgatcgatgatacggatatttctaaaatgtgacactaatatttatagaggactaatggttaccatttacatgggcgtggtcttatttaacttcataatcatattatgggggggaatacttaaattagctccattttccagaatagaaacgtgtatataattttcctcagatgaacaacggggctataaaattgtgtcctacttacgtgcttcaggggggaaccttgacctgt

SEQ ID NO: 701669 - DNA, 735 bp, Homo sapiens
ctggtttagataagacgaggtggtttgagaagcaccagagcacatgcaagcaggtctggctgcagatgcctgggctgctcccatcgacgatgcagatctacaagaagcacctggtgcctggtgccagctggcctgctgctgcctgcaccgccgggccaaaaggaggcctcctatgacccagtgtgtactgagaggctagatgaagctgcagggcagtgtgtgtgctgggtgtgtgccctgtggcattttggaggcctccagctgcatccccccttccccgcagtgagaactcctacgtgtccagcactggcagagcccacagtggggctgctccatggcagcccctggcagcgccatcatggatgccatgtgcccatgtgcatgcaggagcatgctgcagagatggccccaaccagccctgtggagagtgactgagagcctaggctggactctctgctgccctgctgctcctggcacttgactccaagcttgccctctgtgacccaggcacccctcatgtggagtgccggcttgtcctcatgggtggacactggcgaggacgaatacgatccttggtgggatgttggcccacgggatccctggaaccagaaggcctgtgggaaggactttgccctttggaggatcttgcatcatccgtcgtcagagccaccgcagattattcatcaaagccttgccgacagaagttgtccagaagctgccctgtacaggttgtga

SEQ ID NO: 701670 - DNA, 206 bp, Homo sapiens
ccgaatggcccatgaatgggctgttgccaggccctagcaggtcatacctcgtacccatgatccagaaactgtggggcagcaccatccgtctacttacctcccttcgacccaagcacaaccaggagaactagagagacctggggtagtaaatagtgagacgggtacttaggtcgcacatacagacacctgggcatatggccgccatt

SEQ ID NO: 701671 - DNA, 136 bp, Homo sapiens
gtaacgtcatcacatttcctcctttacctttcagtgcagttacttttcacataaggctgtggttcaaactttctgggagcacggactgtcagttctctgggaaggtggtcagcgcatcctgtcgggctagtcgggg

SEQ ID NO: 701672 - DNA, 402 bp, Homo sapiens
tgtcatagctgactctagaggataaacggactcggccaaaggctgcagtgagccaggattgtgccattgcactccagcctgggcaacaagaccgaaactctgtcttaaaaaaataagaataaaaataaaaacaaaaagtaaataaaaaaacaaaaagtggacaaaggatgtgaacagacacctttcaaaagacgacatacaagcagccaacaaacatatgaaaaaatgcttattatcgctaatcatcaaagaaatgcaaatcaaaaccacaatgagataccaccccatgccagtcagaatagctttcgttaaaaagtcaaaaaagaacagatgatggcgaggctgaagagaaaatgaggcacttaaacaactgttgatgggaaagtaaactactccaactgt

SEQ ID NO: 701673 - DNA, 447 bp, Homo sapiens
ctggagccggttttctcggactctacgacaggagcacatatatataatgatagattgtaggcgtttttacattatcaaggtctgaacctcgtgattatggtatggttaatactacaaatgtattttcatcagttatttagttagaaatgtcctagagacttagattgtaccaagtaatcccttttgcaacatcctgggaccatattctctccaactcttgcagcacttaaaagaaatggctctatctttgggattgcaccaaatcaagaaataaactaacatatgagtgaatagagaagcttgtctcattctgggcatattttcaattttcataagtttgtgaagatgataaaatgaaacactgaaagtaatacttactaagaaaatgatacttaggtcaaactgtattcagtgaaaattggtattaagtgactatgggatgtggtt

SEQ ID NO: 701674 - DNA, 938 bp, Homo sapiens
ggcgtgcaccctggtattctaactgtagggctaacccgcaacgtgatactttgacatgcagtcgctgtgactgtcatccccttttggtcctaggacgtgccgccattcgcttactcctccgtgatgcacgtcaggttcccgagattacccgtctagacaacatgcttcgacgacttgcgttcactcagaggctgcattgaaacggattgtcgtacttactagggcgtctctacatgccgattcacgtgaaacattatatgcaatggacacaagtgcgcggttgagtgagggtgcgcatggacgctactgcaactgctccgagatatatgtgttcagcagctttgaggactaagtctgccctagtccattaatttgcatgcgcaacaacaattgggtatgcctagttgcatggacagccttttacacaactcggatagacgtgactcatgaggggacatccgagtgtccctctacaagtagttccgcaatatggacgaaaagtgagccctagaggaaccaccaaagtcattccgaatactcgtagtgttcccccaacggcacataacgcacgtactatagtacccttggaaccatacgacacgtctacgcttgggttggcgaaccaataggtagcacagaaaggcagagttgagtttagtttggtatcacgccaaaacggctgtagcacacctccagcagaggggctccccagacccacttaacttcctggtaagggaaccgaggccaccaggaggatatcgcactgaccctacaagtggtgctttgtcacaagtacgcatagttggcccgcccaaaaccaatttgcgccgtacccatacgacacgtcaagtcacaaggggagacgctcgagacaacagagtggcacccccgatcaatgcgcaacaaccagggataagacggcgcaatgggaaagaaca

SEQ ID NO: 701675 - DNA, 451 bp, Homo sapiens
  misc_feature (150)..(150): n is a, c, g, or t
  misc_feature (287)..(287): n is a, c, g, or t
  misc_feature (313)..(313): n is a, c, g, or t
  misc_feature (405)..(405): n is a, c, g, or t
  misc_feature (438)..(438): n is a, c, g, or t
cgtggtgaggacggaatgagtcaggttcagagggaacagtgatgagagatgagggtggagatgggagctgggtcgtctaaatccaggtaaacagctcggactttgtcctgactggcagtgcaggagtcagcgcagagggtttaagcagtngtagtagagggaggtcaggtctgcccacgggaggtgggtggtttcccgagatgcccgacataggaggcccttttgagacagtgtggtttgacggacaacgtcccatgcgtggttgtccatactttgcccccacctgncctggccatgcctggaattgaatccntgcccagcaggagcaggtccaagtgcgggacagcgaagggttttagatttacgctatttgcaccaaagtacaagagcaggtcttcaatcagnggagccttagggggctgcccagtagtccagggncagatgcccagac

SEQ ID NO: 701676 - DNA, 970 bp, Homo sapiens
  misc_feature (477)..(477): n is a, c, g, or t
gagacgcccacaagcttcagtgtccgaatactgcctactggtcgcacacctcacctggatggacatctgactaggcgctcgcagaagcaggtgtaccgaggacatcggtgaagagatgcgtgcacgaaatgccattggagagagattacaccacgggtgtgcagtcgttcgcgctatggagcaaagcggggtgcctggcaatgtcctacatgcagtgactggcgcaagctaggagaacggaccgacgtagggcatcaatccgcacaagtttctgcgaggaccttcttctctcgtgatctaacgacgacggaccaatagcgaacgagacgatgtacctgactcccgctggaggtcaggtacgatggagattgactgtgacgcgcgtccggtgcacgctcgctggaatcccacaacgaactagagggctaaccgttcgcgtgagggagcgaccgacgtggcttggtggcgcctagcagntcgcgaagagactcttcatcacatagcgcttgcgcgtgtctagccctctctacaaagtgacagtccaaggacctcagtggactcagggaacaaggccaggagcgtggcggacaccaagatgaatgagagcagcagtcgctcccacgccgtcttcaagcatcatcttcacccagaagtcgccatgacgcagagaccaatatcaccacggacgaaggtgagcaaaatcagcctggtggacctggctgggatgcgagcgggctgactccacgggagccaagggcactgcgcctcaacggagtggggccaacgatcaacaagtcgctgaccagaccttggggcaagcggtcatctcccgtccctggcctgcaaatggactccggaagccaagaaggaaacaccgtgaaacaaaacatgtacaggggattaaggtaccgggctgcggcgaaaaagagtgtactgcacatggccaacagggaaaaagatgagagcggac

SEQ ID NO: 701677 - DNA, 216 bp, Homo sapiens
tagcatatcagttaccaaacatcttcatacattgcatgacctctgtattgaggattactatccatgtagtatcaaacaaatcccaccactatctatattcagatagacgtatgaagtggatcgacaggatccaggtcatatcacataagtcaaactttttggttgtctgataatagactgtctgacatctgtgggacagctaccagagggattatg

SEQ ID NO: 701678 - DNA, 180 bp, Homo sapiens
caggaggttttgggcctttgaaccccctttccccccccccccccctggtggtgttgccccagggtctttacgggagcattggccccttagcccaaaaaagctggaagcccccccaaaacaggagcaaatggggttttataaatttttttttttaaaaaaagctctgggggcctgggtcca

SEQ ID NO: 701679 - DNA, 155 bp, Homo sapiens
ccttttttttattaaaccccgggcttgggggttaggtaaaaaattttgtagttttcagaccagaattaaaattttgtgaaaattccggcttaaaaaatgtttattgtaattttgtgggagggccttttaaaaaaattttcatcccttttccccca

SEQ ID NO: 701680 - DNA, 442 bp, Homo sapiens
  misc_feature (31)..(31): n is a, c, g, or t
  misc_feature (67)..(67): n is a, c, g, or t
  misc_feature (108)..(108): n is a, c, g, or t
accccccacgttccaaccacccaattcatgnctccagctcgacgtgtattcaccactgcggtgcatncctccctgtacaagctccttggacacgtgagctccgtgctnacctcccaatctcgcaaacatggagcctggtttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701681 - DNA, 150 bp, Homo sapiens
  misc_feature (27)..(27): n is a, c, g, or t
  misc_feature (49)..(49): n is a, c, g, or t
acttggggggagggggtgtggcaacgngccccccgcagaggcacgcatntttgaccaaagccctcattgtggtccgaggacagccttttccccaggctcagagcattgctcatccgtgccaaactgggtaggtggatttgagcggaaaga

SEQ ID NO: 701682 - DNA, 532 bp, Homo sapiens
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagctcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtgtagtcaccagtgtcggtgcatgcctccctctcgacaagtgtcacgtcgacagcctcgagtcaccaagctgacatccctacagtctcgacatgctag

SEQ ID NO: 701683 - DNA, 2213 bp, Homo sapiens
agtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttccttcttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgagataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctggctttctttctttctttctttctttctttctttctttctttctttctttctttctttcttgctttctttcttgctttctttcttgctttctttctttcttgctttctttcttctctctctctcttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtaggggcactattgttccctccatgccagctttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaagggggtgtgccaggcctgaactgagctaagcacctgccccgggctccacacttccatctttcttttgtcttcatttcacctctgtgtttaaagcactgtgtgacatagctccttagagatataacctattgtctgctcattgtc

SEQ ID NO: 701684 - DNA, 571 bp, Homo sapiens
  misc_feature (213)..(213): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (231)..(231): n is a, c, g, or t
  misc_feature (306)..(306): n is a, c, g, or t
cgctgctgctctggcgttctagaggatcccgacatgacccaagcatgcatgcatgctgcaggtcgacgtgtattcaccactgcggtgcatgcctccctgtacaagttccgtcgacacgtgagcaccgtgctgacctccaaatatcgttaagctggagcctggtcgactttagaggatcctccagtacccgagcatgcatgcatgcctccagcncnacntntattcaccacngccatgcacaccttcctatacatgctccttgaacacaggagcaccgcgctcatgacccaagcatgcatacatgcntgcaggtcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701685 - DNA, 144 bp, Homo sapiens
tgccgccaagtctccgacctcacaatagaggcctgcttgctgtgctgcgctctgagctcctgctggaggcttcttctccaacccagctcactcacctctctgcctgtgactggagcatcccttcccacctctcccccacttctt

SEQ ID NO: 701686 - DNA, 129 bp, Homo sapiens
tgagctgcccagttcacaaaactaccttgaactatcccttagaatgccctcacaacctcaccgcaggcccaggctctccgtgtcctctccatcccctccggcctcccttcccctgcacccacacaaccc

SEQ ID NO: 701687 - DNA, 298 bp, Homo sapiens
gtggtacctagatgatcccggctatcacattatccataaagtctgagaggaacacaaaaagaaacttatcctttaaaaccaagcttcattgttttcggttttgagccacacggcacacaatgagagaatacgttctcgcttccttcgagactttacctgtttgcaagagcctttgttagtggtgcatagtgtactagttcccaagcatttagttgatggtacaacactacatggttaataggcacaacgaaacactacccttcttggtgatggaacacctccagtaacaatcaccagt

SEQ ID NO: 701688 - DNA, 1604 bp, Homo sapiens
taccacctgctgcctgtcgcctgcctgccatttttgatgtgcacggaatgagtcctggttcttgtggacatgctggatgacatgtgtgttggttgacttgaagactaaacttatacacaacatgtgacacacgctactatctttgctgaacctactcattcctcccatgctgtgatgaattgtgccaatcttgttgccttactgtaaccatgatgccaggacttgtgtcttccctaatcgtcaccatgcgcaatatctttgcatacgatctctacgatctacacacacgcggctctgctccacactcgctccaaaaggcccttttattcagaccattgcacagggaattcaatcacagggtctccgggactggaacgctcctccactggctgtgccctgcttggcaaccataccaatgaattactatcttgcatccattctgaacatcaacggtgtggttgggctctcttgcgttttgggcacacccttacattgggggaacactctatattttgggaaccccttccaaacgaactcccagggacgtggttttccccagggctctttcccttctggggaccacccaccttaagggcgctttttctctcggacccttcttgtttccaagcgccttaccaagaagttggagcgcaagcccttggcctattccaacctagggcaacagtgcgaaacgacagcatgggcccccgttggtggcttatgcacaaaggttaagacgagcaacacctttatgtggaccgccattgggagacttgtgggtgctgccgttaaacgggcgcgaatagataaaagacgcgccagttgtactaacctacccaaccaaggctcttgtgcacaccacgtgacacccacctgggtccacggcccttttcctgggtcgggcacacttgtggcgcagctcaggaccccacaacctcagacttgggcttggtgcccacccctggcgcacaaacttttcctcccaagcgggtgccgctcacacgtcggcaaattgggcccaagcccaagtgactttgtgggtactgcaccaggatgtccaacacgaacttgtcacagccccgaggcgctgtgcaccaggctccaacaccacctttctaaaccctcttcgtggcaaaaacagggctgtgtcctcaagtgaaagaggatacacgcaacgcggtggtctgtcgccaacagcttacacgcccaatgggaacccaactggtgtttgcccacagtcaaaagacttgcggcccactggcgccgatcacacgcacacggcaacgtatctctggcgacaacgtaccaaccgcgtgggagctagtcaccccacagagcacaggcggctaagccggcctaaaatcagggggcgcacaaaacgcctaacacacggtgaactcatccgctggaggacccgctgtggctgcagcacaccgcagaaacaaatagagccctacagggagacgtgggaccatcagtagcccggcgacttgggtgcagctggtgtaacacgcacagggctcgcgaacacaatcggtcgcaaccgcaacacaacacgcgctgtcctcagcatcgcgagcgcaggggaccatacgacccacacg

SEQ ID NO: 701689 - DNA, 648 bp, Homo sapiens
  misc_feature (31)..(31): n is a, c, g, or t
  misc_feature (67)..(67): n is a, c, g, or t
  misc_feature (108)..(108): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (297)..(297): n is a, c, g, or t
  misc_feature (308)..(308): n is a, c, g, or t
  misc_feature (383)..(383): n is a, c, g, or t
accccccacgttccaaccacccaattcatgnctccagctcgacgtgtattcaccactgcggtgcatncctccctgtacaagctccttggacacgtgagctccgtgctnacctcccaatctcgcaaacatggagcctggtcgacgtgtattcaccactggcggtgcatgcctccctgtacaagttccgtcgacacgtgagcaccgtgctgacctccaaatatcgttaagctggagcctggtcgactttagaggatcctccagtacccgagcatgcatgcatgcctccagcncnacntntattcaccacngccatgcacaccttcctatacatgctccttgaacacaggagcaccgcgctcatgacccaagcatgcatacatgcntgcaggtcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701690 - DNA, 543 bp, Homo sapiens
tgcctgcaccaggttgtgtagatgctgccctgtgttttttgtagaagctttacagtggtagcttttgtatttaggtctgtcatccatctttctctttttaacagctttattgagataaaattaatatgataaactatacatgcttaaagtataaaatttgataagttttgacatatgtatacatttgtgaaattgtcactatagtcaggatagtaaacatattcattgtccccagaatttcctcatgcgccattgggattctttccttccactctatcctttccctccttctctaagcaactgctgatctcttttctgtatgatccatcttgctttaatttttgtgtgtgatgtgaggtggggtcaggatgcatttttctccatatggatatgcaattattctgccatcatttgttgaaaggactctcttctccattcaattccattggaacctttgttataaattaattaaacatgtctgcaggcttatttctgttttttctgttccattggtttattttctatcctgtgttaacaccgcgc

SEQ ID NO: 701691 - DNA, 242 bp, Homo sapiens
aagacggcggacattcagactgagcgtgcctaccaaagcagccgaccatctttcaaaacaaggaagagggtcccgcctggggagaaacttggcaaggaagaagcttccgcggtacttcaagaaccatcgggtcttgggcttcaagaacccaaggggggctattaaggggcacctacattgcacaggaaatgccccttacactggtaatgtgcccattcgagggcggatctctctggcgtggt

SEQ ID NO: 701692 - DNA, 347 bp, Homo sapiens
tccaccacgccggggcagacgtcccgggacaagctccgtcaacacgggagaaccgcgatgacgaccagagatcgcaaacatggagccttcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701693 - DNA, 855 bp, Homo sapiens
  misc_feature (60)..(60): n is a, c, g, or t
  misc_feature (188)..(188): n is a, c, g, or t
  misc_feature (215)..(215): n is a, c, g, or t
  misc_feature (346)..(346): n is a, c, g, or t
  misc_feature (390)..(390): n is a, c, g, or t
tattagaaagtagggctataaaaagagtatgccacaaacagagtttggttgttggcagcnaagccccaagctgcctctgctgccatgtgctaccatatcaagcgagttgcccgggaatcccctgctgacatcggtctgtctcacatgcgtgatatttggaaggtagttttggtgtgtatttgtgttgntcattatagtaatgacatgcatttacnacagttttgtaggagagcgactctcagctgtggtttagagacatagccctttggatctccaggtatctcaaaggctgtaaaacttctcaagtcaaaactagttttaattttactgcttgagagatgcagtntgaaacatatgacagcaatgagtgtctatttctgtagcaactcnagcacctgcttttttaggggaagatttataataaaggcacataactatagggcttttaaccttgatttaaaaagaaaaaaaaagactttcctgttcattatcatatctagctctggggagatagacaggttagtgatgatctgcaccattttacagatgagatccctgaggtggcttgtggctttggtccaagaagccatttatttttgattgctggcttcacatggctcctcccttggctggctccttcttatccctaatcccctatctttgttgcttgtctgttacctatcaaaagaagccatgcctgatttctctattggaggttaaactgcttttcccacctctggtttcccttcaactccttatttatttcattatcgcattagccactagttttatttcttgggttttcaaatggtaattattatttaattttattgattagtctgtctccagcattag

SEQ ID NO: 701694 - DNA, 282 bp, Homo sapiens
catagcatctgatgctggcagtatcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701695 - DNA, 231 bp, Homo sapiens
  misc_feature (216)..(216): n is a, c, g, or t
ttatcgcaaggtccaagagggacacgtgcagccttgctggtcccacagcctggcggcacgcctcactctcttcccaagggctcatgctctatgatgctcgattggcacacgctagttctatgccgcatagcggagctcctcctcgacatacctctgtgccctgcccatatgcaaccggtactcgagctcgaacctcgctaaatctctagtcatagnctccttccctgctgt

SEQ ID NO: 701696 - DNA, 312 bp, Homo sapiens
tctagaggatcccgagcacggagcatcgcatcgtacatctgtgtcagtatcgttcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagtcgattcactggtaccgagcgcatgtata

SEQ ID NO: 701697 - DNA, 313 bp, Homo sapiens
  misc_feature (18)..(18): n is a, c, g, or t
  misc_feature (23)..(23): n is a, c, g, or t
  misc_feature (27)..(27): n is a, c, g, or t
  misc_feature (30)..(30): n is a, c, g, or t
  misc_feature (34)..(35): n is a, c, g, or t
ctgcatgccctccgggtngactntgangantccnnacctaccaagcatgcattggtgcctgcaggtcgacgtgtattcaccactgcggtgcatgcctccctgtacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacactcctaatctcgttaaactggagcctgctcgatctatagaggatcctgctataacccgtttccgagtttatagta

SEQ ID NO: 701698 - DNA, 189 bp, Homo sapiens
tcggacgcatttatgccagcttatagaagcaggtgcaacagcatttagagtgttctgtgctccacttgactgcctcattgaatctttggaaaatcgatgcaacgagctgagctgacgtggtcttgagaggcctgacagtgcgccggttgccagcggttcaagtgctgagaagcctgatgcccctcagag

SEQ ID NO: 701699 - DNA, 306 bp, Homo sapiens
cacgacatctagaggaaacccgaccatggcccaagcatgcatcccgcccccctttaggtcgacgtgtattcaccactgcggtgcatgcctccctgtacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacactcctaatctcgttaaactggagcctgctcgatctatagaggatcctgctataacccgtttccgagtttatagta

SEQ ID NO: 701700 - DNA, 458 bp, Homo sapiens
acaattaggtcaagtggctaattgcacccggagacaggtcttgcggtgcaatacgctacacagtgcattattcacccgagactactagctcccaaagtaaggagatagggattggaaatacagcactgaatgtatgtgtggttattgcaagcacctgtgattttaatagtcgctgccccccccacccccgcagaaacttgtagtgtggtggccttcctttggtctttatgcatacgtaaattgcttacctccttctgtaatatttattctacagcattctctttccagtagggtatacttttccctacttagaccctgtttcttcagaatttatttattttcttctggaacccctggctattataaaggccatatattcctccactgtttacctgtatctacaacttctcagcctcttcagtaagcaacatggtccatcaacttgaacagcttactgg

SEQ ID NO: 701701 - DNA, 511 bp, Homo sapiens
accagaggtctctctcttccctgtcaacctctggggcctttggcgtaatgggcagatacagtgcatcagcttctctaactctgcagcactggggcttctgtcttgattgcgtctgcttttcaggcacagttttcttcttgaagaaagcgtgcttgtgctctagcttcctgtcctctctaggtgtcctcagcctttctcggggtcttctttttcctcctgcctctgacatcggtatcctcctcaggactcatgggagctgtctaggggcttctcagagccatgagagctgaggaccatcgttgcaacgatgtgtcctcagttgtagtctgtgggagaccgacatccatgggctctgaaaggtccttgatgagaccaatatcagatgagtgcagctggagacatgagatcgagtgtctcaaggaggagctgtcttcatgatgaagaccatgatgaggaagtacatggctacaagccagattgcagcctgggttgcggtggggagatgcccaat

SEQ ID NO: 701702 - DNA, 598 bp, Homo sapiens
atttggtggtattcgtaaggtcacagactactcctcaagggggtccctgatccccattcctcctgactgggagaaacctcctagcagtgatcgacagaccacctcatacagagagctccaactggcatctggtgggtgccgctctgggacaaagcttccagaggaaggaacaggcagcaatctttgctgttctgcagcctctgctggtgatacccaggcaaacaggatctggagtggacctccagaaaactccaacagacctgcagcagaggggcctgattgttagaaggaaaactaataaacagaaaggaatagtaagaacatcaacaaaaagcacgtccacaccaaaaccccatccgaaggtcaaccaatgtcaaagaccaaagttagatacatccacaaagatggggagaaaccagcgcaaaaaaggctgacaattgcaagaccagaatgtctcttctcctccaaaggttcacaactcaacaacaagggaacaaaactggacagagaatgagtttgacaaattgacagaaggaggcttcaaaaggtgggtataacaaactcctctgacgaatacccccgaataccaccaatcagg

SEQ ID NO: 701703 - DNA, 290 bp, Homo sapiens
  misc_feature (1)..(1): n is a, c, g, or t
  misc_feature (42)..(43): n is a, c, g, or t
  misc_feature (164)..(164): n is a, c, g, or t
naaaataatgttaaaaacagaatgttgtggggggagaaaacnngctcttttctctcgctccgccggtggggtggttgcctgttgctcccctaacaacggcggtgtggacacacttctcttggggccaactagacacgggggctgggggcgaacaacaccctaantgtcgccttccccccgggagaccacaagcgggggcgcggccggcggtgggggtgggcaccccccccttgagtgtgggggagttaataccccgccagatttttacacggggagcgaccagccccacc

SEQ ID NO: 701704 - DNA, 249 bp, Homo sapiens
cgtaccccgatatttgtggttctggccctggctctggactctagagacatgctagctacagcagattacatgactgagagggactaggggagagcggcctttcatggcttcaggaagcagctagctttttgacttacgatacactcactcgctcgcctgctgcagcctccccgggcacctcaggcataaaacgggagctcatgtgcctagacaccctggaccacagacccgttaggagctgtccgagga

SEQ ID NO: 701705 - DNA, 332 bp, Homo sapiens
  misc_feature (27)..(27): n is a, c, g, or t
  misc_feature (47)..(47): n is a, c, g, or t
  misc_feature (84)..(84): n is a, c, g, or t
  misc_feature (113)..(113): n is a, c, g, or t
  misc_feature (123)..(123): n is a, c, g, or t
  misc_feature (128)..(128): n is a, c, g, or t
  misc_feature (148)..(148): n is a, c, g, or t
  misc_feature (160)..(160): n is a, c, g, or t
cccaacctcactctacttggcttctgnctttcaccctgtgatgtggnctgctctgaccttccccttcccattatgattggaagntccctgaggcctccccagaagcagatgcnccatgctttnctggncaacctgcagaaccatgagnccaattaaaccncttttctttgtaaattacccagtctcaggtatttctttaatagcagtgtgagaatggactaatacaatattgattaataaaattatattgacttatgaatgcccctacttgaagaataacagaaattgattttcagggtggcagctggtagaactcttgatttatatggtca

SEQ ID NO: 701706 - DNA, 1393 bp, Homo sapiens
  misc_feature (195)..(195): n is a, c, g, or t
agcggcgtttggccggtcaccatgtagctgggacttctattggtttgctttctctttggggcacctccttggagctcattccccagcagtgaaaggcggactgtatcccgtgtgacctgcttggcttgcttacgagtgccggtggtgctgctcttgttcggatctgctggtctggtcctctctgtcctcggtggnccggaagtgtgtccgtggccctggcgagcgtgagtgagctcagctgacgcttggctgtgacagaagcattgtaactcgacttgcctactccgcgccgtgcggagacatctggttcccctcgccggtcacgctgacgcatgggcagcgtcccaagacgtgtaatggccgaggggttgcgcacaaactacgcgtttagcggaagggccgatggggttctatttctgcatcgtagctaatttcctaccggaaagcccctaggccattgtgcttacgatgctcctttgtgacttcgaggaagggcgctagggctccccactgggaaaccaccgcgctctttgcaatgtgacccctagcgatcgcgtttctccccactttcgcgaaggaggcaacgcccagaagtcctctgcctttcccgggaataccgttgggtacgagtcctcaccacagctagcactttacacacgtgtaagcctctatgtatgtcccaactatggacgcatcttgcgctccggttgcttctctggtaaaacccttctgctggtaaacccgctcacggtgtgcctggtttgcgcgcagttactttggccctgggtggaaccccccgggggggaaaaaccgtttcattctcctagggcgcctgcggaaaatcgcccgggaaacgcgtccatgcggggaattgcggggcccccgccacaacgttttctgccgcacctttggcttcactacttttagaaactttcccagcacaaagatatttctccccttgtccccgtgggggaaggaaactaaaagagcgcttgtggttggcgtccaaggggattgcaggacagggggacttggtttgaaaaccttatgtttggggccctggaaaaggaacgccccaatgacagactttaaggccttccttgaggccccaacacgaagccttgtgggcgaaccggggttcatatcccccttagggatcccccacaaccttcacctagagccacccaaaatgttttccttacacagggtctatctttttccaggaaagccggttaggaaagagggttgttgggggacacgttgaattttggggcttagagcttcttcactcaacatatgggtaaccttgtcgcataacgggttgcggctgtggccaggaacaggctaatggatcccttatagatggggttcgttccccttgtggcatgggaaa

SEQ ID NO: 701707 - DNA, 333 bp, Homo sapiens
gatggacagtatacaggtgcttgctgctgagtgtttggggcacagatggaatcgtagtgggttgaagctgtcctcctgttgggctgaattgcttttgggtggagccataaggtccaggtggagtcatgggtgtcagacatgcaaaaaacctggaaggatatttcaaaaggccaatctgtaatagtagtgttattcacaggagcaattggtatagttgcatatcttataaccttcggaataatgtctgcagctaagtaggattcaggctcttctcctccccgcaccctgatgtccccctaacagctttacaaagagtggtgagttttgggcaag

SEQ ID NO: 701708 - DNA, 443 bp, Homo sapiens
caaaggccttaagctaaggtccatatactacttgggcaacactggttatgtggcgtagagtagaattactagcttagcagaaaacatgtctcctgcaacataggattcaccaccttcttgtttcctctacattatatgaaatcatggttagtgtcagccccaaattagtgctataccatatcccaaataatataaaacggcttctgacatactcaggtaggatagattcttcctctgtaggatgtatgtgaacagcaactatctggaggaacaggcgtcatatgaggtacgtgtatagagaaaactaatgactcacacagaattagcctatcagcttggctacgatactgccatccctagatccacatcagttcaacactccatcggatgatgttagactgtttactacgcatcaccaggtgtctaaatgcaatcgatctaaa

SEQ ID NO: 701709 - DNA, 917 bp, Homo sapiens
cttttaccaaggtcttacagggatatgttacgtgctttccaggtatctcacttggtgctgtattaaaaaaagctccatttgaaaatctacgtgtacagaagcacatgtctttaatgtcttcagacaaaaaagccttacattaatttaatgtttgcactctgcaggtgcaacttaccagggagggcctgaggaaagagaaggggagggggctattaattatttttagcacaaagtgtgccttggtctgtgtgcaaacatgtagaatatgctctttaatttagtaaaatatttttttaacaaggtagagaatgctctggttatggtaatcataaacttccggaaattctggtaatttgttgtcccatacttatcagaagtgtgttctaccaacttattgttggttggaaagtgtggattctttttttccttcccaacctctctttgcacaaaaacagaaaggggtttctgctaatgaatggagcagacatctaatattttatatggcctttggagctgtgtaccttactattcgggatactgtgacaattggttttaattcatgtaactgtgatacaacatggtgatgtgtatcaatgttagtcaaagcatatatgtaatactggtcggggatgtgtggctcaataggtcctgtgggggaggaaatacattggcagggaccccagcttgttaaacactcaggcgagagatggaacattaaaagtaacttagacaggcctaactaccactggacagggctacaaaaaacttattgggcaaacaaactgaaaggactccaaaaggggggccagtgtacaaacgaaggaaaacgcgtgacgcatacaaactagaacaagcgggcacagcagtgcgcaatacaccagaaatcaagaagcccaatgggcacgagtgacgcacaa

SEQ ID NO: 701710 - DNA, 391 bp, Homo sapiens
  misc_feature (160)..(160): n is a, c, g, or t
  misc_feature (176)..(176): n is a, c, g, or t
  misc_feature (366)..(366): n is a, c, g, or t
agacacacacgccagagacagtgtctcactctctcacccagggtggaatgcagtggcataatcatggctcactgtagcctcaacctctcctgctcaagcgaaatgcccacctaagctccccaagcagctgagactacaggcacgggccaccatgcctggntttttttttgtatttncttgtagagatgggtttcgccgtgtcacccaggctggtctcaaactcctcagctcaagcgctccacttgcctgggcctcccaaagtgctaggattacaggcatgaaccacagcgcctggccttgcaggtattattttcgaagctcagttaggtggggaacagagcagctggtagcctacagctaattttncccaatactaaggcagtattcttct

SEQ ID NO: 701711 - DNA, 143 bp, Homo sapiens
  misc_feature (123)..(123): n is a, c, g, or t
tgtgtgcactgtacaccgacgaagtgcgcctcacgcacaactactggggcgtgctgctgtcgctgatctgtgtcgggctttccgttcgcgttcctgctgatgctgtcgtacatcagcggcatngacccgatgctcgcgcgcgc

SEQ ID NO: 701712 - DNA, 100 bp, Homo sapiens
aaaattttgggttttttttttttaattgtctagttttaaatttggcccttttgtttaaaaaatgaatgtttccccaataaactatgaatgtttccggtta

SEQ ID NO: 701713 - DNA, 154 bp, Homo sapiens
gtgtggaaagtaggaagaatgcttttgaacaggatatgaaccactgacttattaaaaattgctgatctgctgtacgtgccagctgaaactacatccatgtctccataaggcatccctcaaaggcccaggcgctgccagggggtttgtcctggta

SEQ ID NO: 701714 - DNA, 531 bp, Homo sapiens
tttcccctctttccaagcttacctttagcggtttcccttgcctcttgggcaggaactgcacactcagctttttctctcttcatcatctttgcacacactttctcccgcccgagtggcagattacagataagcctgttctacatttggaccagactggctggtcccatttttgtactgggcctgttacttacggcctagatttaggaaagtcagcctcatctgcaaagcagggtaataatttccaacccatgaggttgttgtatggacccagttgagaatgtatgaaaacatgcaacaactatcaagattgttaaaatgtaagttattcactgtgtgagcattattctgctaaatgtttgcatgtatgtatgtgtgtgtgcgggagtgttaccccccgacagcctctcttggcctttttcatcccccgtttttttgtaagcggtggtgttcccattcttgttaaccaattcttgtccttcctatgtttccgccattttgctttggctaatccaattcttctgtcaactttgt

SEQ ID NO: 701715 - DNA, 874 bp, Homo sapiens
agcggagtgtggcatctgtgaagagtgcgtgtggtaacctccctcacgcggcggtggctgccgtgacccataccaggtttcagactggcaccggcggaggcgtgctacatggcagcagactcgtgggtcggagttgggccgcttctaagaaccgagactactgccttgtgagacggcgcgagacatacttgagtccctttgctaccaacggcgcggaacagaggcatagcctgggaccagaacctgttccacgcaccgtcgtgtctgcggtctgttcggcatcagacctcgaagatctggtggaaagtctgcgcctcgtggcctgacgatgcttcgcggaggtcatggtgaccggggagcgagcaggtagtgacatctacctgtgctttggacctacaagaccactgagcaaacgaaggtagctaggtagacattgcccaggtcgcgggctattgacatggataggctgcatgataggggcactggacaaagcatgggctaggtggtgtacccttcgatcgtagtggaatgggttgatggttgacaacgtgaccgcattgttggggacagcgcactgttgccttttcgaatcccaagcttctcaacttcgtgccttattccccacaaggctgggctagtagatagcgaggcctctgtggcgccggtacttggagcgatcgagtctgctgggaggcacttagcggggaacacaaacccgatgtttccagatgtgctccggcccgggatgtctgttgcgcacgtatgttgggccttgcgctccgtggcccgtacatgcctgactgcttcttgcttcgctcggccctcgtgatggcctgtcctctccggcgtgttggtccacctgtggagaacccgg

SEQ ID NO: 701716 - DNA, 495 bp, Homo sapiens
  misc_feature (19)..(19): n is a, c, g, or t
  misc_feature (73)..(74): n is a, c, g, or t
tgcagtgttctggccttgntccctgtattctgttgcgctgattcggtcgtgaaggaaggtgctgccaggccgnntcacctgtatcgccttggctttgggaggtggggctgagtgggcatctgggttggatctcaggcaggtggcagttcctctgattcatggttgtcagtttcctgttgcctggccctcgctcctcgcccagtaggtgtggtgggacaaggttctgggagctggggtagaatttggactcttaacgggaagtgcctcgtgctgccgcagacacatctggatgggtgctgagctttccttcccaagcctggtcctgatcggggtggggtacaggcaggagcagcccggccttgtcagccgttgaaagtgtggtatctgctgggttgccagtaagctcgcttcgaggtcttgagaggcagtgcaggggaggctgagtatgaaccgtgtccagccagtacttatgtctctcttcatctttctgctcca

SEQ ID NO: 701717 - DNA, 746 bp, Homo sapiens
agcggaggaaatggcgtgaaccccggaggcggagcttgcagtgagccgagttcgcgccactgcactccagcctgggcgacagagcgagaccctgtatcaaaaaaaaaaacaaaaaaaacaaaacaaaacaaaaaaaaaaatttacttttccctttcgggaccagcctgtgggcaacacggtgaaatcccggtctcttacaaaaaatacaaaatttagcccatcgtgttggcgcacgccttgttagtcccagcttcctttggggcgctgaggcaagaaaattcgctcggccccaggaagtgtcaaggcttgcagttgagccgtgtttggcattcacttgcacttccagccttgggcttaccaagttgagacccttgtcttcacaaacagaacaaaaccaaaatttccccatgtggaaacaaccagtttcatgaattcctattttccaaagctcttcaacaagactacaaacctgaattgcacacgatggcattacatttcaagttcctagtcgtgacgcactgtggtgagttgcccattacccctgttttcccgcgaggggaccccagcgagcgacccttcaccattattcacttgccctggttgagaagcccccgtgcggggacaccgggatcccgaagcagtggcacgcggaacgctcccgcaagccggccccggaaaagccgactgtgggcacggcgtggcgcccaaggctgcgctacagtcgggtcgacagcgcggccgcaaa

SEQ ID NO: 701718 - DNA, 901 bp, Homo sapiens
ggtatgtctcactgtgatgtttgcatcggggttagtccgagtaacgtcggggcattccggataggccgagcaaagtgtgtgggaagaaagttagatttacgccgatgaatatgatagtgaaatggatttggcgtagttggtctatggtgtacctgagaataggggaaaatcagtgaactgaagcctcctatgatggcaagatagcagctcctattgactagggacatacgtgggaagtgggctacatatgtagatatcgtgtcgtgtagtacgatgtctagtgatgagattgctcatacggatgccatgtcagagccagctacggtgaaaagaaagatgagctcctagggctcagagcgctggacagatcatgttcaatatagcttccggggagtgtgggagagtcagcataaatacttgtgacgccggtggggaataggcgagtcgattatggtcagcggacgagttgacaaatagtgactacggagatggacttacgtgtaatgccttacggtaaaatataatggtggtgtgtcatcacgagtaaactcctatgaaggccaatctgagtatagagctaacaacacatactattgtatcagaaacgaggtgcattatcaacaccgggagatacgtagacgtaacagtaatgcggagaagtgagacccggcaaaaccagggtggactaacgagctaccacactcagggcagacagaaggaaaagagacacgtgtcgacatacaaaaaggcgcatcctcaacgcaacgggacaaaacaaaagggcagggagggtaagcccagacccacacaccccaagaaccaaaggcacagcaagagacacaaacagaggccgaacccacaacaccgagaggacatacaaacagtggcagacgaccggaaa

SEQ ID NO: 701719 - DNA, 2265 bp, Homo sapiens
  misc_feature (999)..(999): n is a, c, g, or t
gtagagaacattggtggatccccaggggtccaggtagtcagctctatagatgagtgcgggtgagcgcccacgagtccttgtgcttgccctgcatgtctgcgtgtgcttgggaccacggtgtgtcaacaatacggacaggtggccgtgcgcgtccgtaccgctggaaacggctgtgacgcaaggaccagaaaagcagcagcgagaaacagctaacaaggatgctataatagcgttctgggaaaactgaacgaatattcggtcactactaatttgtcagggacacgactgcggtgtgcatcccctttgagacgaggaaactagcactaggcatttactcgccaggtacaactactaggcacacgaaccacatgaacggcaagcacggcctacgctcacagcgcacacggcgtacttcagagcaacacactgcaaccactcgcaccactggctctacttgccttaggaacaccacgtatacatacaccaggcactcggactcttgcggaacactggcgatacaggcaccccacacacacggtcctgccaacacaaaatcgcctgagcatcctcctttcacaataacacacgcgacaacaacgtcactccaagactacagcaggctcgcccacccgggctgacacggcaactcctcgccgggccagcctgggcgcaaccacacgtcatcttcacatcccgaacagcgccacacaagggaactccactcggcaccccccacacccggatgccgggacacaacacaacaacactaggaccagaacaacttcacggctaatgactaacctgatccaacaccaggcctcttgtcctgttaactacacctggcacctacacctggcaaccagtctgacccctcacctagctgacaacactcactccgtccactcgtccccctacacgtcactagatccctccgtccacgcctcctagaccgaccctcttcaccaacgagctctctaccccacactctcactgcaacgngagccagcgaccctagaccccgacacactcctctgaacgcctacaactacacaacctcgcacacgctacacgctacacaacattagtaatactgcacgccactacacatactcacacagcgcacacgactcaaaccaaccagcacaacatacttatctattctgtttgctacccccacgtgcacctactaggcccaaccacgatcgctagcccccctcactcgcctcacgcaacgacacgcacgacccgtacctcgctccagccacacccacctacaacacacacacgacccatacaaccacaccaccctcacaccccacccctcccacccgcccactcccacccacctcacacccccctccagcctcccccaccacctcctcccacctcgccagccgtacaaccacctacaatcctacgatcccttcattccaatatcaactatccttacaacaagatactatcatagcatctaagccgctcgatttcaaaaacataaagacataacattcgcaacttcacatccatctacgcaccattacacgaacacttcctcagacaaccacaaccccatcacaccaatacacaacacctaccaccacgaccaccactacaactactccctcccccctcccatccatccaacccatctcaccaccctccgcgcattcacccaacataccagactcacatcgctcaataaactacgacatataagcccgcatgacactaaagcaatcgcgaagaagaaccaaacacgcacgagcatcgaccacagcaggattaccaagtacctcgctcatactaacgatctcgcacactctcacacaaccatgagagtcactaatcatactctcaagatcatgacaatctcctgacacatcaacacatcggtgccaagcttccccagatactgcatactgcttaactgctcagtccagctcgacctcacccatcaagcaaatcaatatactcaaaccacaacatacccacgtgccgccactagactaatcacctaacatatctattactactactctatgaactatccaactgacacgctacgataccttatcatgcacagctctgccgcacctccctacaccccgccacacacctcctcctcaccctcctccgacaacatcacaatcaagacactcactcactatcacacctctagttatgtctactacactcagtactctgccacaatctcctactcaacccacacaccgacaccacaccaatcccacctacacaacacac

SEQ ID NO: 701720 - DNA, 684 bp, Homo sapiens
cagccataaaaaaagaatgagatcctgccatttgcaacaacatggatgaaactggagaacactgtgttaggtgaaataagccaggaacagaaagacgaacttcacacgatctcactcatttgtggaagctaaaaattaaaacaattgaactcatggaaatagagagtaaaggatagttgccagatgctgggtagggtagtgaggtggtgggggagaaatagggatggttaatgggtacaaaaaaaccagaatgaatagtcgggtgcagtggctcacacctgtaatcccacacttggggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagtgaggtatgatagtagctatgtagtaatgccactgtactccagctggggcagcagagcaagactctgtctcttaaacaaacaaaaaaaccttccttggttcttccttccctacctgtgaaataaaccccaaatcatagattcatcataatctggtgcagcctatcttctagcttctctccatgttgttctctctacatttagct

SEQ ID NO: 701721 - DNA, 413 bp, Homo sapiens
gctctgctttaccggagccgagtagtaaacggaacgctagtctaaacgaaccactgactccactcgtatccagagtgttaaccggggggcctactagccatcaccgagaccctctccttccttagcataaaaaagtatatataaaaaaatgataatcaccactacaatgtaaccacacatctatagatgacagtatagccgaatgtatggagtctggaggcaaactgggttcacctgctggctctgccataaactagctgtggagccttgggaaaaaaactacaaaagctctctgggcccctctatattcatttgtaaaatagagatacttaaaattcctacaacatagcatggataaagactaaactaggttcttacatgtaacagtacacagaataatagcttagcacata

SEQ ID NO: 701722 - DNA, 496 bp, Homo sapiens
atcatggcttggggtatcactctccgtcgggctgcgttaactcttcccatagcccgctcttttacactgtatctaccgattcgtgtcataatgctcgtgatgtgacttgactagacaccgtcatccttagtagcatcagcacctgctccattatccagtagttccaaggtaactgtttttccattcactgattcaatcagggctgtgacactggccctgagaattggggaggctccttggcgaatatttgcataaactaccagagggctggggaatttgctggtgtccttgttcgttttggaagtcactgtaattggaggcagggtagcattggacgcacgggacgtgacagtcagggtcaaggtttgtgagcttgcttgcagactgtatttccaagtgccaaccttagcaatgcctgggatttggaggtaggccattttggtgtttttgtccactacaaagccaccttgcttctgtcactgggatcccagagaag

SEQ ID NO: 701723 - DNA, 372 bp, Homo sapiens
  misc_feature (4)..(4): n is a, c, g, or t
cttntggtcaccgtggtcccgggcccttttttgaaaaggggcatccccagcccggagggtgatggaccaatgcgagggcctgagcccgagggtgcggacagtaaaccgtttatttctgtgtggacccagaccccgtggggcatgacagacagttttaaccccatgagcgctggggacggagctgtgcctggacagcttttcggtgtgtggtggggccccgctgggccggctgtccccgccagcttaggggctaacagggtcccctgggagaaaacctggaaaccgtttaatgaagcaggtgacttaggggggtttttagaaacccaaagaaatggcccttaaataagcaaatattaaacccaaaaaaggcga

SEQ ID NO: 701724 - DNA, 211 bp, Homo sapiens
tgttaggccttctttctcttgtcctttctgtccagggcaggcaatttgcaagtagcatagaaacctgacctggattactccgggtcatgcaactccagcatccacgtcagcgcactttcaatctgtttgaacaaaacggaaaccgtttcaatcagcaggctgcaccaatcggggcatgtccttgcatcccaaccatcggcagggtcggtca

SEQ ID NO: 701725 - DNA, 401 bp, Homo sapiens
cacaagggtttccacactgaatctagactgcccggactaagtttggctatataccagggcagaaatcaacaaccttactagtgcaatgagcacactgagtgtctaggacagactccatggcacaacaacatatgaaaaatatttgggaccacagtatgtcgcaggcattagtaatctgaaaaagtgctcaagctcccccctcctggaagcctgtgaattcctcaggaagtagaagcgaagaagatggcccagctccccaagaaagcctcagccattcactgcccccagctcttctccccaggtgtgttggggccttggcctcccctgctgaaggtggggattgcccatccatctgcttacgattccctgctgtcgtcttagcaagaagtaaaatgagacat

SEQ ID NO: 701726 - DNA, 757 bp, Homo sapiens
gccacgtgtgcgcctggcttcagccccagactcgtcagcctcccgtcgcccatgtcccgacgccgaggcagttcggccgcgcccccgtgcctcccttttgcgcagcccttcggcgctgagcccgaggccccgatgtgggctcctcctcgactcgttcggccatcgaagagcgtgtaagcacgctgcactggttgaaaggtctgaagatagttcatcttccgtgatgacacagagagtatcaggtaatgcacccagaacagaagtaaactcctcacccgaagaatccggagaacaagtcaggatagcgcagactaagattctcccagcaccgagtccgacccaacgcatttaacagcacgccatggtgacaacaaacatcgactcgttcccaggggcatcaccggtgcggctgtcgactgtcctttgacacgctcaagcatgcagagcccaaaggcgataccccacgaacgacgaaaattgcacggcgcacatgtcaacgcacaaacgccacctgaattccacaacgaaccgcacctgccttcagccgataacgacacaataacgttctcgcattctgacgcaagcccgcaacctgcatgggaactcacgacctaactcgaacgtaacacccctttctccgcaattcactcccaacctctgggtttccaattgggctacgcaccacattggggcttatcccgttcacaccgaacgaattaacattgctgagggacaccaacgggaaagactccattgc

SEQ ID NO: 701727 - DNA, 484 bp, Homo sapiens
gaaaaggaaaagctctcaaaccaacaacctaaccttctaccttaagttattagaaaaagaacagcctaaacccaaagataggagaaggaatgaagtaataaagtttagagcagaaataaatgaaatagaagatggaaaaaacagacctgtaactaccaaggagattgaatcagagaccaaaaacttggcaggaaagaaaagcagaagatcagatgccttcactggtgaatcaccaaacatttgaagaatcaataccaatcctgctcatattcttccaaaacattgaggaaagaatacctccaaactcactctgtgaggccagcattactgataccaaaggcagacaaagcaccagaggaaaatagaccaatgttcctgataaatacagatgcaaaagttctcaacaaaatactaataaggagaatttgacagcatcataaaaaggattacacaccatgatcaagtgagatttattcctggaatg

SEQ ID NO: 701728 - DNA, 291 bp, Homo sapiens
cccaataacttgaatgaccgcattccttccgctacaatggactgattcaccgcaagactgtgggctgttgagcctggcagcctgacttgcaaatggtgtcagtggtggtcattaaagctggagatcctggccacgtggaatgcctgccaccgtcctatgtagctggaccacacatcaacaacgaatgctcgctggcactgctcatgcagcatcatgacacattgatcctgcaatgaacaatgtacctgcccctgacactgctgcattgtgcatgccatcctgctgtgtgtg

SEQ ID NO: 701729 - DNA, 227 bp, Homo sapiens
ccccccccttttttggtccccttcctcccctgggcagagtcattttcaggggttaacccttctgatttgccctgatttgtttgttccctgagctttttaaaaaccctgtgaaaattttttttccccccttggtcctcatgcatctaattgtgggggaatgtttgtccaaccccccctccaaacagcctggggttgtttagaaaaataaacaaaaaagactgggtgga

SEQ ID NO: 701730 - DNA, 404 bp, Homo sapiens
  misc_feature (1)..(1): n is a, c, g, or t
nacccatcccgccacccacagcaattctgccaccctacaggcctgattttgtgttttctgacttttttatttattaatcttaagggtctataaagcgtttccatttttccccagctaaaaatgtaaaaaagactgcattgacatggttaatgcaggaccctcagttctttaaggatggactaaatatgtgttattattgcctacaggtgtcttgaccttgatggagcttatgttgagaaataaagtttatactttctattttcatctaattccattttttccacaaactttttggagtccccttgtatttccagaatacttgtgaatggctttttcaaattaatttagcctaaatattatcccaatttattaaccttaattggagaatgttgaaaatcttgtct

SEQ ID NO: 701731 - DNA, 920 bp, Homo sapiens
ctcctacgaggcttatcctggcaatggggtagtcactgccatcccttccacacacacacacagacacacacacacaaaaaaaatcccttccttgtggagattcttgggcatctcctgcctccctcactctcacggtaattaagtgtcttaattggctgttgcctggggaacatggagagctgcgtgcgagggaaggactgactcatcagtggggcggtgagacgggagagatgacggtgcccatcggtgtcgtatattgccctgcaagagctgcggatgtattcatcctccgcaacctcccgactcgctgttcgtcatccgttaccctttgggcgatccttttggctcatggatgcgacgaaacatgaagcgcccagggttggacgacctgaaacgcggagtattaagaccaggtggcctgctcctttgtacctgggctctagcacaggtggggtaactcccctatctcgaagccactatgctccgtgcttgcttgtcccagatcttagggactagggagcctgcgaagagagggaatgagtgctgccatggcgtgcttggggatcacgaccacgcttgtagctacttgatgaacccctatgattacactttgccaaggcatgggcgtagctaagactacgactcgtccatgttgaagtgggctgccttagacggcgcaacgtccacaagaagcacgttgcaatggtaacggcaggcctggacccatcaacattcagttccagcgtccaacagatggactacctgggaccagttgtgctcccaacctcaatgttgcccagggtggggaataaggggagctagaaacgaggccaatgcccctttccaggggtggtcaatgaccgcgaaaggggatttccgggaatgtggttagcttggtggccaattttgttgttacatcc

SEQ ID NO: 701732 - DNA, 332 bp, Homo sapiens
ggtatcacgcatctgtagcccagattgccaacctggagtaccgtggtagcgaactatggatcaatgcaagcaccaactcccaggttctagccaaactgccgcctaagcctcccaaagtgcagggaaaacaggtgtagaaccaaacgtgacccggccttagatagtaagaattatcacaaaagagaatactttgagtacctagtaacagttatttttgagtaagacaagtttcatgtacctacataggtatagtatgcataagctgtaaaactctagtaacgaatatacaaatagatttgaagagtatagctttagtgagggtttatagcggg

SEQ ID NO: 701733 - DNA, 105 bp, Homo sapiens
aggatcccctcccaagtctgaggaattgtacactttaatattatgtgaccaagaaagttatacccagaatctcgaatttcctcaccttcaaatatggggcagttt

SEQ ID NO: 701734 - DNA, 347 bp, Homo sapiens
cacgaggcgtacggaccgcggcttcagcttcagctcccgcatcagctcgtggaacgcgtcctcgggaaaggcgccgtcgcgcctgtagcgcaccgagacgtcgatgatgttgctggccggcatgtgctcgtcgatccaccggaaggccaccagcaccaccagcgtcgccaccgtgccgatcagcgccaggccgaagaaggagacgccgtatagcgtgccgagcgccgaggtgacccacagcgaggcggccgtcgtcagcccgtgcaccgacaggccctggcgggagatcaccccgccgcagaggaagccgatgcccgtcaggatgccgtgcgccatccgcaccggat

SEQ ID NO: 701735 - DNA, 309 bp, Homo sapiens
  misc_feature (19)..(19): n is a, c, g, or t
  misc_feature (105)..(105): n is a, c, g, or t
  misc_feature (305)..(305): n is a, c, g, or t
cgcccggagcggcagcacnttcggctggaccgcgccgctgttgcgctcgtgcttctcgctcgggaactgcgggaagcgcgggttctcgcggtactcggcaagcgnggcgtcgatcgcgtcggggcgaccctccatcttgtcgtggtcctgcgtctggctgatcttgtagcgctacgactccgcctcgaacggatcgtccggaccggtgcgaccgggcgcgggcgacgggccgccggcaaggccggggcgcgcgagcttgtccttgatcgcttccttctctgcaagggagagcttctggaccttcncgca

SEQ ID NO: 701736 - DNA, 345 bp, Homo sapiens
agagcatacccctgctttttaaaccatctatttaattgccattgtaatcctcacggataggatcaattttgcacttccctttttcacactttttttccttttactaagaaaataaagtaataaagtgactgccgagatggccgaaaagctgacactagtccatgaattattaatgtgctatgagtcagaaatagagtaagagcaacataatcgtcactgataccaaggtatgatcttatgaatcaaaacacctagcgtgtagtattattagccctgcctacttatctagctcatatagacagatgatcaatgctattattatcctcttctggcttgacaacaata

SEQ ID NO: 701737 - DNA, 306 bp, Homo sapiens
accggacacggaaggtataggtagcacggcccgggttctccgttctcttcctgcaggctatgcttggatgatctacggaatctgaccttggaggcggtgcggagtttggtttggtggccctgtctgtgaggaccaaatattgtctctatttcacagatgaggaaactgaagccaattgaagtagacacctgccccagaccatcaagctggcatgggaattttgtctcccctcagacgcttcctcctatagccttacacgctgcctcaaatgctggcgggagatagggacgctgtccagtggccttt

SEQ ID NO: 701738 - DNA, 463 bp, Homo sapiens
gaaaacaaagaaaagggcggggggtggtggctcgcgcctgtgatcccagtacttgggagggcggaggaggcacatcgcctcaggttaggagtttgaccaaccgggccaacatgacgaaagccggtctctactaaaaatacaaaaattagccaggggtgggggcgggtgcctgtaatcccggctatacagaaggacgaggggggagatcacttgagcctaagcagtcgcggctgcagtgaacaagatcgcgccactgcactccacccgtgggtaacggaacaagaccctgtctcaaaaaaaaaaaggaattccattcccaatatgatagccaggggaatctggagcaaactggaagggggatcagatggggtaaccttgcccaaaagggtctagcatcttccctcctacggttataataaattcccaatcccggaaggtggcgccatgttttggggggcccctg

SEQ ID NO: 701739 - DNA, 949 bp, Homo sapiens
gtgtagtgttgggctctatcgtgtcgagatggggtattcatgtattagttctgttgctagtgatagctacatgtagtattcacaagtaggttgttaggctgaatgcccttggattatgtttcatacctggtagacagcttagtgttaatctggctgcataattccttggagtatcggcctcagtcagttccttgaggtgaaacgatgagctgagagtctaggacttcccgtgggatgttattgaaccttggtataggaaagtgcccatcatatgtcccttggctgtgtatgcttagtattcatatgtgtatacgttgcgtgcctgatatgtacatgtaactggccatcaagatgagagatactggaggtgttccttgatctgtatatacaattaacattatttgtacatatgtgaaatgaaaattatgccatagcaagattgcttaaaatagcatacactctatatttagattgttaaaaatgactagtgttgcattggactattatgaatgtaatgcatgttaggaaaatttcacagtcggatatttgctgatcagctgacctttgtcatctttcttgctattttattccctttcacaaatattttattcctatatagtttattgacaataatttcaggttttgtaaagatgccgggtatttatatttttatagacaaataataagacaatagggagcatatgggttgactttcaggtacataaatacctctaacatatggtattatggttgaactgggtttcatctgatatagtacatggcatggtacggtagatgatttcacagaagtttgttcatcagactcctgtgctactttcccaatgtggcactaaaatgaaacttcagtttattttcttcttagattttactcgtagataacatccctcggggtgttacttagcacaagaagaaacacaaaacaaaatag

SEQ ID NO: 701740 - DNA, 163 bp, Homo sapiens
ggtcacgcccattcccgcatcgtggcctggtcggaccgtcgtgcactccgagcgtttctgtccggtccctctgggtccgtctggttttcggaggctttccctggaaaagccagactttgtggtactcctttttaccctaagtgatggaggaattaagaaggcc

SEQ ID NO: 701741 - DNA, 133 bp, Homo sapiens
gacggcgctcgtggatcggagcacaccatgagtagccacggtcttcgcctgatccaggggtcttcgcctgatagccacagtcttcgcctgatagccgagagtcttcgcctgatagccacagtcttcgcctgat

SEQ ID NO: 701742 - DNA, 186 bp, Homo sapiens
tggctattttggtacttttagtagagaggggatttcaccacgtgggccaggcgggtctccaactccttggcctcaagtattctacctggctggcctcccaaaatgctgggactacaggcgcgagtcaccacgcctggctgctctacctacttttttttttccaagtcataaaacagtagtagaggg

SEQ ID NO: 701743 - DNA, 234 bp, Homo sapiens
atgtcttattctgcctagtaaagtcaaattacgaacgcacgcacagtcgcatcataatcctctctcagggacttcaaactctactcccactaatagctttttgatgacttcttgcatgcctcgctaatctcgccttaccccccactattaacctactggtataactctctgtgctattatccacgttctcctgatcaaatatcactctcctacttcacaggattcaacatacta

SEQ ID NO: 701744 - DNA, 518 bp, Homo sapiens
  misc_feature (467)..(467): n is a, c, g, or t
  misc_feature (485)..(485): n is a, c, g, or t
  misc_feature (490)..(490): n is a, c, g, or t
cgcagtgtcacggggggaatgttttctgtgtacctagagaacagtaaaaaggttgtaggcatttccagtgagcacttggagcctatccccccccccaagaacacaagggtaaaagtgatcctgggcgaggatcgggaacccacgggcgtcctactgagcattttgtgaggatggcattgtccgtatggaccttgatgagcagctcaagatcctcaacctccgctttctggggaagctcctggaagcctaaagcaggcagggccggtggattttgtgggatgaagagtgatcctccttccttccctggcccttggttgtgacacaaaatcctcctgcagggctagggggattgttttggatttccttttgtttttcctttaagttttccattttttccccccctggggctcattggaatttgagtaaagtttgggggagggtcccccccttcctgtacctcctccccncagcttgcttttgttgtnccgtntttcaataaaaaaaagctgtttggttta

SEQ ID NO: 701745 - DNA, 212 bp, Homo sapiens
  misc_feature (44)..(44): n is a, c, g, or t
gttcccttgtctctttttttttattttaatgaagatctctttantgagcatgtaaaactttttatatcagccttccgccatcaaattccactggttgtgtctgtttttttttttttggggaaacacgagtttggcttggtcccccagttggcagggtgctgaaatcgggcccagggcaccccagcggggttaccagagcgagactcaaaaaa

SEQ ID NO: 701746 - DNA, 481 bp, Homo sapiens
aaggatccctatggctactgctggaggtaggtggtagtttgtgtaaatatttttagttgggtgatgaggaatagtgtaaggagtatgggggtattatggtgggcatatggtagtatttaagttggggcctttttaattcttagagcgagaaagctataatcactgtgcccgctcataaggggatggccatggctaggtttatagatagttgggtggttggggtaaatgagtgaggcaggagtccgaggaggttagttgtggcaataaaaattattaaggatactagtataagagatcaggttcgtcctttaatgttggtgtatggctatcatttggtttgaagggtaggttgattagtcctttgttggggtggtgattaagtcgggtgttgatgagatattttggggggggggatcactagagggggaaatagaatgatcagtactcccagccaggtagcccacaggttacgagctcgaat

SEQ ID NO: 701747 - DNA, 182 bp, Homo sapiens
atcaataggccctttggaatttcctttttgtttttttttctttgctgggggggtgagggggaacaaaataccatttgtataaagtccagtttgtgtccctcaaaatatgccctgtatgggtacacaaaaacagcttgatgaacaaatccccccatgggtcattaaagaacaaagcttcccga

SEQ ID NO: 701748 - DNA, 222 bp, Homo sapiens
aacgaagtttaactaatgctatactattccccagtatttggtcaaatttctgtgccagccatcgcggtcacacgattaacgcgcgaatgtcaatagaagccggcgtaaacagtgttttagatcaccccctccccaatatagctgaaactcacctgagcttgtattaaaactccagtgtgacacaagattgactataaattggtaccgtagctcgaagttctc

SEQ ID NO: 701749 - DNA, 562 bp, Homo sapiens
  misc_feature (440)..(440): n is a, c, g, or t
tctcagaggtctgatggtttaaaagtggcagttgcccttcatgtgctcactatctctctcctgcgcgcatagaagacatgcttgtgtctcctcctccttctgccaggattgtaagtttcctgaggcctccccagccatgtggaactgtgagtcaattaaacctcttttatttatctatctacttatttatttatttatttatttttattttttgagatggagtctctgtctcccaggctggagtacagtggcacaatctcagctcactggaactttcgcctcctgggttcaagtgattctcctgtctccggctcccgcatagctgggactacaggtgtacaccaccacacccggcttttgtatttttagtagagatgaggtttcaccatgtaggccaggatgatctcgatctcttgaccttgtgattttcccaccttggnctcccaaagtgcagggattacaggcgtgagccactggactgggctgagagcacattttttattgccgaatagaccaagtctggttgagaaactgatggcgtttaatgtgggaagtggccagt

SEQ ID NO: 701750 - DNA, 117 bp, Homo sapiens
ggaggagaaaggactaagtgcagggtcagtactccagcgcctctcatcagacaatgaattctgacactggctgtaaggttttctgtgcagtaatacagatccttaagacattgcccc

SEQ ID NO: 701751 - DNA, 385 bp, Homo sapiens
agccacccagtaaaacacaagacccctccctctccctccttactgcctttggcacaattacccagtcctgataatttcagactcctactctctctataaatcagtataccctcttagttatgcaaaatgatccttgctttagattcagggtcccttcatcttgaactattatgataagcacctaaccgttcttacaggctctattttcaacctctcagatccatcctctacagaataacctatctcaaacacaaagctaggtcatgttataccccagctataaaatggttaccctttgtctacaggatgaagtccagtcttctttgttatggtctgcaagacttcttgtgatataacccttgttcatgtctccatcctcatctcc

SEQ ID NO: 701752 - DNA, 1024 bp, Homo sapiens
gtctcttattattggtggtggttagtgatctaccgcgtgcgcagcggttgttcctttggtggtgtccgcctcaatatgattatatccctctcttatcttaggtggggggtttttttttttctgggggggccgcctcgcttgttttatataatgatggggggcccctcccggacgcagttttgttgtgttttctttcctccctcctcatcgcggttgttttggtgggctcccccccttctgtttttcaccccctgttttttggagagagtttgtgttgggtacacatttttcgcctccaggtctgtttgttgatgccatcttttttttttgccggcgccgcctgtggttgttgctctcccgcttgggggtcgttcttcatcactttgtagttcgcccccacaatagagtgggtgttttctgttgtggggtggggcgcctcactcaacagtgttttgttgggtgttgatatacattcgccacggatagttgttacttattattttgtgggtgcctcgtcgcgcgtgttcctacctctctttgtctccctgagagggacctctctggagagagagaaggtgtgttgctccttatacctcacctggtggtagaaaaagaatacaacgtggtgatagagaggcccctctgtttatatcgcgctgtttgaaaacacaaagacacacacagtggggtcccctacggtgggagcaccacttatttttcctcttcgcagagaacctaatatgtggttgttgtggaggaggaggccccccctcccccctttattctttcgcaccgctgtggtgggccctcaagatttggtgatattttgtgcgccggttaaaacaactgtgagccccccctctttgccacccccgcgtgaactcctccctcctcgctccttggtgactaccgctggctacaccccctcttttcgccgccccgtttaagccccccccgggggggtttttttataaaaatgtggggttttaaaaaagcccccccctatataccccgggtgtgttta

SEQ ID NO: 701753 - DNA, 808 bp, Homo sapiens
gccgccagctagccccgccagcctgggcagtgaggggcttagcacctggaccagcagctgctgtgctcgatttctcactgggccttagctgccttcctgcggggcagggctggggacctgcagcccgccatgcctgagcctcccccctcccctccgtgggttcctgcgcagtccgagcctccccaacgagtgttgccacctgctcagggcacccagtcccatcgaccacccaagggctgaggagtgcctttggagcagggcacgggactggcaggcagctctacctgcagcccctgtgcaggatccactgggtgaaagccagctgggctcctgagtctggtggggacttggagaacctttatgtctagctaagggattgtaaatacaccaattggcactctgtatctagctcaaggtttgtaaacacaccaatcagcaccttgtgtctagctcagggtttgtgaatgcaccaatagacactctgtatctagctactctggtggggacttggaaaacctttttgtcaacactctgtatctagttaatctggtggggacatggagaacctttgtgtctagctcaagggattgtaaacgcaccaatcagcaccctgtcaaaacagaccactcggtctaccagtcagcaggatgtgggtggggccagatgagaataaaaagcaggctgcccgagcaagagtgacaaccactcgggtccctttcacaccgggatgctttgtttggtcggcctttgcaaaaaatttgctgtgctcaaaaaaaaaaaaggggggcggcaaaaaacctcgaggggc

SEQ ID NO: 701754 - DNA, 937 bp, Homo sapiens
ggcagctgcgggactcagaggcgaagctggaggggctcaggaaggacgaagaaccacccttgagagaagaggcagcagcagcggggcagagagggaaggaccccaccaattgccactttgtgccaggaaacaatgctgctagcgacattcaagctgtgcgctggagctcctacagaccattgtgcgcaaactatgaagggtgctgacggccaaacagtgcctgtgattggccatcaggccaggagctgaaacgggagggcccctgggtgggggcccccaacccttagccacgttggtattaacacccaggttcggcgcggggggaagctctacatactcgtcccaccggctggaaagggaagactcctctacgaggtcgaacccacggggagcgtgggccttaatctacaaagcagggggggaggaggccttggcaagaaggggctgtgggctttcctttagcacccaaagaggggtggaaaaggacaggcgatgtccagcacgcgaccatcggggcccaacggtcggttgacgaagagtgggtccccaagattgtgggcaatggtgtcccagggctggaagtccgggtggcccacgcccaatggaggagggctcttatggaagagctccgtggcagccctatggacaagcaagtgggggagtgaaccccaagttgtcaaggagcatcagggtcctggcagaagcatcggaaaggattccttcattactcacggaggtggtgccgagccacgaggaacctggtggggccccggcattgtaagcgtgcgctgtcccagacccgaggccccactgtgtcggttggtatgccaagatttggaaatcctgcaaaggttcaccggggcgcggcccattgtggggcaccggggtggacccctaaaacacattggcaccatccccgggggcccaacacaaagtg

SEQ ID NO: 701755 - DNA, 131 bp, Homo sapiens
gtgttacatgccaataccctggtgcaatgatgtcttcaatgtatattccattcatgctcactgatagcctctttcctccctgtcgccaccgaggtcgcacgcgtagattctccgccgcagccgcggccgct

SEQ ID NO: 701756 - DNA, 329 bp, Homo sapiens
tagctgaaggcacgcctctagttacagaggaacaggtgacaacagtcaactgaggaacaaaaaaataattaaacaggcctaagaagaaatcacaacccatacgacacctatcctgctctgttatttcttcactctgctggggggacacagtacattacaaccaaacaaacaaagcagaactaacatattgggaccatggcagagaaacgcaggagaggagcaaaatgaaaattagttaacaaattgttcctcctccctctgggataccaccaccaattagtactgtgtgtgtaaatttggtttatctatcattcatgcttagcttaatg

SEQ ID NO: 701757 - DNA, 674 bp, Homo sapiens
  misc_feature (92)..(92): n is a, c, g, or t
  misc_feature (227)..(227): n is a, c, g, or t
cgcagctgagagtatatatcataacccaaattgttagggaccgaaaaggttaatgatgatgtgcctttggcccccctatagaaaagtggccngggtgttcaaatttctcccttttggtcctttgggttgggttcaacctggtaagaaataataaccaaacacggtctttgggtggttcccgtaagagaattaaagcttttgtttaatggtagtttctcctgaggganctaaggaaatagaaattctggagagaagtctgttggatttctcacagggaatagctattagctcatctaagcaaatgaaagagttaatagtatatgtataaaccacatgtgtgtaattggaacttcttaggattctaagatttttaaaatcttgtttaaaaactgtattatcaccttaatataaaaatcttagcgcttgagcgtacttacccaactgtggttttctttagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcag

SEQ ID NO: 701758 - DNA, 363 bp, Homo sapiens
ttgtggtcgttctgaggatccccgtgcgttgcacggtgccaggggtgccgctcatgcatgcaattggcagtcacggcgttggcggcgcggatcgtggcttggcgtgtggtgcgtgtaggaccatgcactgcccgatggcttcggctcggatcagtccgagattgtctaccggggcgcgggctccatccgggacgccggtggggccttcgtgcccgagtgagcagcgctgaagaggaacgatatgtccgagcacagagtagagaacaactggcagctttgtaaaaacaccatgaagaagacatcgttcatcatgagaaggagattgcagcgtctgcagaaagaaattgagcgccgtcgcctacg

SEQ ID NO: 701759 - DNA, 197 bp, Homo sapiens
aggatcccggtcctttgctatacggcttcaggctgtacacccccagaactgctgtgatgactctgttggacattagtagtatatggaggagccatgcctgagatcattttcaatcgtgaacatccaggatttgtgatgaattacaagagttctctgtgtgtatgagggaaaactgtggattactcgttctacctata

SEQ ID NO: 701760 - DNA, 871 bp, Homo sapiens
agcgggaaggtcttcttaagcaccaatataagcaccttaaatgatacatagaaaagaatgacataacgtttgtggtcttgttctcttaaatatgaatatagctagttagcctaaaatttacacaaaatgtattcaagatcaaattagtgaacaaagcaatggttcatatggctaatttaaaagcaattcaatttaccaatattaaaataattataaaatgtaaaagaaatttcagaggagtgatgaaaatttttgttcagtaattattcttaaactgcattcttaggtttattacaataagaaatagtaagccaggattggccatgggcaaggtgaactggtcttcggtgggagagatatgagttagagatcaaggagtaggcagtcatcatttgtaactattgtgtgtctggctatacagaaaatgtttctggaaaaattccttaagtgtcatctgagtatagagagtaagagactggaggccagacgcgaggaggctcacgcctgtaaaaacccagcactaaaaaaaaccaaaaaaacaaaaacatcagatagacaggaaaagaacgaagaaccagtggctagaaaaaatcagaatgggaaatacccgtaatcgaaaacgaaaagaaagaagccaagagagtaaaggtccaggcagcaagatgctacacatccagtaaggtcgccaggcatcgattagagaaaggccggggagcgggttagaacatcgatatgacgtgagaagcataaggctgtccaagtgaaatcaagtgagagactcaagggacaagtaaagaatggcattatgtgagttcggtcaaagagagcggttgtcaggattacccaggcagacggaattcaaggcggagac

SEQ ID NO: 701761 - DNA, 242 bp, Homo sapiens
gttctatgaggatccccgcgctgtaccagttgcgcaggtcgcgtggcagccgaaaagtagcaacaaccgctagacgggctcgtcacaccctttgccatcactaaaaatcactagagcagtcagacgggacccagctatgaccaagaggaggggaggacagacgcatgaaaagcacatatccatgcgaatgaagatgtaatttgggacgagccatcagcccgcaaatcttacagtctcaagtt

SEQ ID NO: 701762 - DNA, 274 bp, Homo sapiens
gatgccacgatggggatggtgggctgggaagacgggtcccatctcagtgtgagggggcttggtcagaccctcatgctgcacatggcaggtgtatctctgatcctgtccagaagtgaccaccacagacgcccacttctggaaggttccatcccctgcaggcctggtctccacaagctccgtgtcctgggtctggtcctccccatcccgctgccaggtcagttgtgatctccgcagggtagaagctcagtgcccagcaactcaggatgcttcttga

SEQ ID NO: 701763 - DNA, 808 bp, Homo sapiens
  misc_feature (13)..(13): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (765)..(766): n is a, c, g, or t
  misc_feature (795)..(796): n is a, c, g, or t
atcacttattctntcaccgtgggcgggggagggtgcttctctccntgnacttanatgacttcgcgctacactatgtacctggctgggactcaatccacaaagacccaaaccttcaggaagacctaccccatcatcatgagattgtagaaggctattcatctgagagactaaatccactggccagggaggatggaccattaaagattctctcactggataaatgacagatagaatatattaatctgaacatacactcttgtctttcagcaatgactgatccaactatctcttatactacattgaatgaccctccactgaaaagaactcattatgcctaagcgtgactaccatacaattctaggactagccacgatggttaaagagggatcgggacatgctatcaaccattttagaagtctcaagattccaaatgatgaacgaattgctcccactttcagaacacaaaatttttaaatatgagatacttaaaccctaacactcaattcgcaaaatgttaagtattaattaagacaacctgggcaagaacctgttgaatattcaccccgaactaattaaaacaagggggatgtttcttaacccctttattcacacttaaataatagcaagtgaaaaaccttctggagaggggaacaaggggatttattattcacacttttcagggtggggaaaagtcaaatttttaataacttgccttaaaacccgaaaaaaagttcccttggcttaatacccctccacttccccctnnggaaaaaataagcggaaaataaaaaaaanngccccgtttttg

SEQ ID NO: 701764 - DNA, 893 bp, Homo sapiens
agccagattcatcatcaatgactgggtgaagacacacacgagaaaggtatgatcagcatacttgcttgggaaaggagccgtggaccagctgagcacggctggtgctggtgaatgccctctagcttcaagcggccagtggaagactcccttccccgactccagcaccctaccgccgcctcttccagcaaatcagacggcagcacatgtctctgtgcccatgatggctcagaccaacgagttcaactatactgagttcagcacgcccgatggccattactacgacatcctggaactgcccgtaccacggtggatcacccgtcagcatgttcattgctgccccgttatgaaacaagaggtgcctctctctgcccgtcaccaagcattctgagtgcccagctcatcagcgcactggaaaggcaacatgaccatggctgccccggtctcctggttctgcccaatgttctccctgggagactgtaagtcgacctcaggaagcccctagagaacctgggtaatgaccgacatgtacagacagttccaaggctgacttcacgagtctttcagaccaagagcctctccacgtcgcgcaggcgcctcgcagaacacgtgacgatcgcacggtgaacgcgagtggcacggtggcctcctcatccacagctgtcatagctctcagccccagcatggcccccgaggagatcaatcatggacagagcccttccctcttcgctggtccggctaccacccccaacagagaacgcgccctcttcactggcgccacgtcgctcggaaccctcgcccctgacggcaacgacgcccctcatctgggcacaccaccggcgcatgcatcgcgacccgacacacacccgcacgcacacgaatctaagcgtcccgca

SEQ ID NO: 701765 - DNA, 165 bp, Homo sapiens
cctttttccctttccttttcacttttgcatgtttttaatgatcattcgatatggtaaccgttttcagccctgagccttggaaaggagggctgtaacgccttcagtcagtttttggggatgaaacttttaaatgctttgtatattttttcaattagattttttttc

SEQ ID NO: 701766 - DNA, 313 bp, Homo sapiens
  misc_feature (159)..(159): n is a, c, g, or t
  misc_feature (162)..(162): n is a, c, g, or t
  misc_feature (172)..(173): n is a, c, g, or t
  misc_feature (180)..(180): n is a, c, g, or t
  misc_feature (189)..(189): n is a, c, g, or t
  misc_feature (195)..(195): n is a, c, g, or t
  misc_feature (200)..(200): n is a, c, g, or t
  misc_feature (209)..(209): n is a, c, g, or t
  misc_feature (231)..(231): n is a, c, g, or t
  misc_feature (253)..(253): n is a, c, g, or t
ctgatttccccgtcaaagtcaagctcattccaaattgcgtgcaccagagtggtcccttcagagagtcagttgcatgtgctaagtcccatagcccctcccagcttcttatcctacttggcctgtgtgaaattgctcatcccgaattcttgtttccttctncantgacttcacnntcttcantggctccangctgcngcatnctctctttnccttctacatgggtagtagaangaaactaccaagtgggactgtngctgagccctgaagctcagtctttgagaccctctcctctccagctgcgtttcacttccga

SEQ ID NO: 701767 - DNA, 181 bp, Homo sapiens
ctagggaccgttacgtggtgttacagtccatgaggttgcgggtttgatccctggcctgctcattgggttaaggatctgttgttgctgagagctgtggtgtaggttgcagacacggcttggatcctgcattgctgtggctctggtgtaggccggtggctacagctccaattctacccctagc

SEQ ID NO: 701768 - DNA, 781 bp, Homo sapiens
tccctttttttaaaaagggaaaaaaaaaaaaaagggtgtttgggcttttaaaactaaaaaaaaattcacccaattaataattttccctttcctcccattatttaacattaacacgagctacaacaacacccttatgttgtatataatatataaagtggggagtggtgggctgtggtatttattatctcatcaaaaaaaataacgacgccccggcggcacttatagagaagggaataacctccccacctctcccttccatcgtagacacgtggcagctttccactctacgggggttcaaccaccaatttcttactgtctgagttgtgttccccaccacagggggcacgctaattcacatatttccctcctataattacacggcggggtgtttctgggctttacaaggcaaacagctaaactctctgggcagggcgtagatgcgtcttcctcactggctaggctgtggtctccaacgccgagtgtgttatccctaaccggggccattataatgattgggccgcgccccgggcctttacaacttcaggggcccgtgagggaacagtattgcctcgtcgatttctcgtgcaagccattcctcttacctccctctccggggtgtctccgtggaaccccacctctgcggtcttcgccgctcccccattttctttttctcgcgcagcccctttcccgacggccctccttttccccccccgcttgcctccctccggctccctctcccccggccaagctccccgggctcctccccgccgcccgctctcgc

SEQ ID NO: 701769 - DNA, 157 bp, Homo sapiens
ttatgggagctgtgtgttctgtgacctcctagtcccattgtactgtccaccctgtccccagatccctattccctccacaataacagaaacactcccatggggactctggggagaggctgaggacaaatacctgctgtcaccccacagagagagcgtt

SEQ ID NO: 701770 - DNA, 661 bp, Homo sapiens
ggtagcacattcgggcaatcccagcactaggcttcactcctccacagtctgtaaagatacataaactctaaagactgtggaggagtgaagccatgtgtatggagtttatgtatctttacaggaataagcagcatctttaaaggtcacgcatcttatgtggtagcacattcgggcaatcccagcactaggaaaagagagagggggaggtcaggagtttcaaaggtctcagtctatacaacacgaccaaacctcaaggggaaagttacccatccttaaaggaacagagctttttctagcacaacactgtcacacggaagtgaaggcttcacacccagctgtggagtaaattcagatgagccacaaacggaggactcagaggactggggggtggggtggaggggtgggggtggggcttcagcagacatcgccttcaggggtttcctcagctgcaggatattctgcatttttcagggggatctatgcctgagatggacaagtatggtcacgttgcctaacctggatcaactgtggaaggccagtccaactccaggttagagcctgtttcctaggaaacccagctgtgatgaaaactcagaatcaaggacccctatggtcccaaaactctttaagagattatttgtgctgggggtggtagtcccag

SEQ ID NO: 701771 - DNA, 173 bp, Homo sapiens
atgctgcccacccagcatgcatccagctgtctgctgcttcccagtgccgcgtgcatgcctgtctctccatcccagcccagcatcatgcacattggttgcatgcctgcacacactgtgtggcatccgtcgtcagcagtctgcagcttgccagtgccatgcgactgcgttgtgcc

SEQ ID NO: 701772 - DNA, 672 bp, Homo sapiens
gcatccactcatcgcgggagaaattataatgtccctccctcttccctccccaatattgtatagaccccttttatctgttcacaccccaagaatttggtacaaccacagagtgtgcaccccctaaaaatatactttctcccgcgcataagatatggttacaccccccttaaacaccatgtattcattaggacatacgtactttactcaaacacactcggtgcctcccccacaacataagtggttataagataaactcctctgagtgtccataacccacgcccccaatgttgcggcgccccccccccccctcccccccagcaaaactctggtggatatacataaacgccttaagtagttaacattctgtgaaagaaaacaatagtctttttcgccaagaataacgtctctatgcaatatcacaactcgtgtattatgaaaattctacaaggtgcccccataaattttggatttatgtttaccctaccttacccgcgaagtattgacatctttttgctacgaaagaacaacttggggtgcccgcatgatgagggcgatgcaagataatacacgtttgctacaactatgtggagctcgttgataactcgagtatgaacaattaaaaaaaacggtgtataatcaggcagctgccggccccacaatagacaaagaaac

SEQ ID NO: 701773 - DNA, 89 bp, Homo sapiens
aaggaagatagagccaggtcagttgggaccgtccgtggggccagtccaccccatccaggtgtgtcatcaggcaaaaggaagttgtttag

SEQ ID NO: 701774 - DNA, 334 bp, Homo sapiens
  misc_feature (33)..(33): n is a, c, g, or t
aggccttggggttggcaggggcccaactggggntgggccctgggtttttagaaactcgctggcccccccgtggggccctgggcccggccgggcagctggtgggctgttgggggttctggctggggccagggggttcccggttttggtcccgggcagcagggtggggtgttgtgtttattgctgggggggggggggcggccccccttgggcagagcccggggttttgggggccctgggtgggtttcccgctgaggggggggtggggggggggccggggttgggacgatggtcggttcccttattggggccctttaacctggtcctcccccgggga

SEQ ID NO: 701775 - DNA, 970 bp, Homo sapiens
  misc_feature (800)..(800): n is a, c, g, or t
  misc_feature (822)..(824): n is a, c, g, or t
  misc_feature (839)..(840): n is a, c, g, or t
  misc_feature (851)..(851): n is a, c, g, or t
  misc_feature (856)..(856): n is a, c, g, or t
  misc_feature (943)..(943): n is a, c, g, or t
  misc_feature (970)..(970): n is a, c, g, or t
attaccgccatcaatcttaacgcaagaaagatgctggggctgagttcccccggacggcaatgttgggtaaacccattgttgaagtggtcagcccgccgattttttaccgaacagattgatgaaaaacgtcaggatgtggtggcgaactttaacggtctgagcgttagtggatcccccgggctgctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacattgggttgtacttgattgccagctacgtaacgcgctgcggtggtgtattactctcgaagatatgatcctgngtacctatttcatctatttccnnngtgaaacctatgcanntcattaacctnttgangtgaagaccaaacgccgctggcagagatgcatgcgggcgcaaggcccgaatgatatacgagcgttttaaggccgggttaacttggtngataatcattttctggcggtgaagaan

SEQ ID NO: 701776 - DNA, 1028 bp, Homo sapiens
  misc_feature (730)..(730): n is a, c, g, or t
  misc_feature (785)..(785): n is a, c, g, or t
  misc_feature (858)..(858): n is a, c, g, or t
  misc_feature (880)..(882): n is a, c, g, or t
  misc_feature (897)..(898): n is a, c, g, or t
  misc_feature (909)..(909): n is a, c, g, or t
  misc_feature (914)..(914): n is a, c, g, or t
  misc_feature (1001)..(1001): n is a, c, g, or t
  misc_feature (1028)..(1028): n is a, c, g, or t
attaccgccatcaatcttaacgcaagaaagatgctggggctgagttcccccggacggcaatgttgggtaaacccattgttgaagtggtcagcccgccgattttttaccgaacagattgatgaaaaacgtcaggatgtggtggcgaactttaacggtctgagcgttagtggatcccccgggctgctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacanaatatttgagcagggggtcagtacgcgtgctgacgagcccggtgaacatggcatngcttgggttgtacttgattgccagctacgtaacgcgctgcggtggtgtattactctcgaagatatgatcctgngtacctatttcatctatttccnnngtgaaacctatgcanntcattaacctnttgangtgaagaccaaacgccgctggcagagatgcatgcgggcgcaaggcccgaatgatatacgagcgttttaaggccgggttaacttggtngataatcattttctggcggtgaagaan

SEQ ID NO: 701777 - DNA, 228 bp, Homo sapiens
tcgagctcggccctactagagagagacgagatgtatcaagaaaagagacgagatgaaattgatggccccctaagatatgaagagacacctggctaagtgttaggagaagatggttaagtctacggaggctccagggtgggagttgttccctgtgctaagggagggttgactggtccacctggttcctgctccgcgcctccaactatatgcagatgccgagccaggagt

SEQ ID NO: 701778 - DNA, 327 bp, Homo sapiens
  misc_feature (8)..(8): n is a, c, g, or t
  misc_feature (81)..(81): n is a, c, g, or t
aattgggncccccttgaaaaaatgggccttttatggcccaaattgccaattggcacgcccagtaatccccagcactttgancggctgaggtgggaggattgcttgagccccaggagttcaagaccagccctggacaacagagtgaggccccatttctacaaaaaattagccacatgtggtgcatttgcctgtagtcccagctgcatgggagagtgaggtgagagggtcgcttgaacccagagggtagagactgcagtgagcccgtgtttgcaccccttgcactccagcctgtgtgacagaagtgagactgtgtctcttaaaaaaaaa

SEQ ID NO: 701779 - DNA, 619 bp, Homo sapiens
  misc_feature (18)..(18): n is a, c, g, or t
  misc_feature (412)..(412): n is a, c, g, or t
  misc_feature (516)..(516): n is a, c, g, or t
  misc_feature (572)..(572): n is a, c, g, or t
  misc_feature (584)..(584): n is a, c, g, or t
  misc_feature (595)..(595): n is a, c, g, or t
  misc_feature (610)..(610): n is a, c, g, or t
ctctagcaggatcccccnacatttgcaggatgatgggtacctggatttaaacaggttctatgagatgaggagtgaagaggaaaaggatgctggcttaggaaaggtgaaatatgattagctcctgtttctgacccaataagtgcaggatctctgtaaactgtaaaatgctcatttttatcaatgataagaggactctttgtagtttctaatgtactgcttcgagtaggaattggatgaaaactgcatcttgatagctcatgttctatcttatttgccaatcttctttcaccagtagcttggctgttcacataagtggccttagactttacagaatcaggagaatgagttattttgggtttaacaacttcaggtgatgggctggattttatcttgtgagtatctactgaagtantaagtttagattttatagtctctggaggtggacttcgcttatgcagcttatcttccatgacagaaactgcacttaaaggagaaatgtaagagacatacttctcnttttccatgttcaagtgatcatttcctgaagaagcatttgtaacacttgattgggntagatccacttnactacatcacngacccagctctgtcngatcttttt

SEQ ID NO: 701780 - DNA, 1712 bp, Homo sapiens
  misc_feature (463)..(463): n is a, c, g, or t
  misc_feature (1293)..(1293): n is a, c, g, or t
  misc_feature (1388)..(1388): n is a, c, g, or t
tggccttttggtgttatttttttaaaacaaaacttttgtgtggccgctatgtgtccagggcccggtcccccaggggcgtgtgggcgcggggcaggggcgccaagctgggtgtgggagaagacgcagatgggctggtcctggcggagaagccatacagtctggggccagtctgggacaagtgtggcgcaggagatatgcggaagacacgctgagacctctggtgtggcgccaggagcaaggggcgccaagaccccccccacaacccccacagtgtggccaaagcctgggtgtgggagacaacgccagatgcgctgagaacactgtccaggtctggagagctactccctctatagcagatgtgagctgagatcgcccggggagagaacctcagaaccgcctatgagatctgagagcgcgtctgagattgtgtgagatatacccaaaaggcgctctatactacccntcttatgagccgcgtagattaggcccccactctcactacctacatagacacgctcatccagcgtagaacacctctcgcgtgttatagagccaacgctacgtgtgttcacacatctctcatcagagcacaggatacttccgggacaaaggagaggaagcccccatatgtgagaaggggccacccacccaataaaaacccctctcacaaacgagaggggggcccactatcatcccgtgagagatacaccactgcgggcgatagtgagctagtgacaaaaaacgcgtcgcagaagaccccaagctggtggcacgacatctccatctctctgtagcacaccctgttgtcccccagactatgcacgatgtgtgtctgaaaacccaaccacaacgaatagttgttcgcgccccaataagcggtcgtttttgcgctcggcggacccccccaagaggcatagtggccccctgtgggggtgaaaacacccgctgttgtgaggggggagtaacccaatcacagagcgacaccgatgacccaccaccaccgcctcacgttgtattgcactggattcacacacacccaatccaacaagaaggacagcgggccgtccggacacggctggtagaaacacccccagcgtcaagaagactcaccaatctcacccaagttgacacaggaagggcaccgcaactgtcggaaagcaggcggccctataaacagtcacataacgcacactatgtggggccccactatgatgcaccgaagtgtgacactcccctgtggcaccaagtttactcccccccccttataaagacggtgggatgtcacttacaaanaatatcaactggtggcgtatacgcaccgagtagttacataaatcttccaaacggcctaccactcataaatgagcgtgcatatacacaaggtgttngtaacacaaaaacatcgggactcctggacgaactcacagagaagacagacaactgagctgcctcgatacatcacacgcggcagtgcaatcatcacccaccttcgttattatccccccccctagttcaaccacctaagcatatgtaattacgcccgcttgaggatcaactgtgtgttccatagccacaaacatcatgttgtgaggctccctctactcgctaacacagacagatcaaatgcagcagagcactaacgtgtactttactacacaacatgttgttgtagtggagcacatcactcgttgtgtgtcaacaacacaacacgt

SEQ ID NO: 701781 - DNA, 351 bp, Homo sapiens
  misc_feature (18)..(18): n is a, c, g, or t
ctctagcaggatcccccnacatttgcaggatgatgggtacctggatttaaacaggttctatgagatgaggagtgaagaggaaaaggatgctggcttaggaaaggtgaaatatgattagctcctgtttctgacccaataagtgcaggatctctgtaaactgtaaaatgctcatttttatcaatgataagaggactctttgtagtttctaatgtactgcttcgagtaggaattggatgaaaactgcatcttgatagctcatgttctatcttatttgccaatcttctttcaccagtagcttggctgttcacatgtactggcccgcacatccgtactggcccggggtaccgagct

SEQ ID NO: 701782 - DNA, 1444 bp, Homo sapiens
  misc_feature (631)..(631): n is a, c, g, or t
gacaagtcggtctttggcttctggcaaacttagccatgcattgaaggaagcacagctaggatatcaacatccagacgatggagcgcatggtcccgtccacagacgactagagtgacagcattctggacgttgatgcttaatagccgtggtctgtgagtaacaagggtaaggtttgacttgtttggaagatcccagattcagttgcatgtaaacagatggcacatggctatgtataatgctgtatgatggggccgggcgcggtggctcatgcctgtaatcgctagcacttagggatggcctgaggcaggcggatcagtctgatggtcaggagttcgtagaccaggccttgggctaagcatggtgaaagcccgtcgtctactataaaatacaaaaacttagctgggtgtggtagtagcgtgcctgtaatcctaggctacttaggaggctgaggcaggagaatcgcttgaacctgggtggcggaggttgcaatgagccgagatcgagccactgaactccagacctgggatgcaatgaaactgggagtgaaactccgtctcacagacaaataaaatgctgtatgaacaagatgagcattctgtcaggtgtcgggacacctgggcaaagacgaatncatgctgtctgtgaaaaggaagtttgcactgtaacatatgccatagcttggcccttgctttgtatgcaaccttagctgatggggaaaattccaaacataagtggcacaggcacaacacgcaggcagaggaggcaggggtctgtgctgtgcaagctcactggtttcttatgactatcattttcattgcaatgcatttgtctgacatcgggacaaaaggaacattttctaaatcagcttgatactcttccatacaaaaacacgctgaatcttcatcttctgcctcacattaattcatgtggcatgccaaaagttagactgaacttttctacatcttcaccttgcatcgatacaggcaaagtcttctctttaagatcttgctaagctataagggggatagtggctcacgcggaagacgcagaaccgggcgctgctctcgcgatcggcaactctcgacacatgccgcactcccactttctattgtcttacggcatacttccgagccttctagcaaggtccctggttgcatgtatctcctaagagcagagttcatatctctttacattccctgcttccttgctcctccatgcagggaccccagacaacctctgggctgttgaatagctctctgactgggtggcaaagcccttctcacataggcacccgtgttgcttaaagcaatacacgatgggtgcaccaaggtggaccacaagaaacgatgtacttgtcacaagcccaattctagcttcaaacctgtacctcatcaagctaaaggagcattccaggtattctgagggccctataccccctgggaga

SEQ ID NO: 701783 - DNA, 210 bp, Homo sapiens
ggggtgctggcggagaggatccaggatgcagcaagtcagtgctcaggacagcctttaaggcagagtcacggcacaggaagctcgccgcggcagttccagttccgggcggcggtcgcgacaccgggagctccggcctctcgagctccgtattcaagtcctggctccaccgcgcacctgccccgtgaccatggagacgacacgaacacaggg

SEQ ID NO: 701784 - DNA, 315 bp, Homo sapiens
  misc_feature (17)..(17): n is a, c, g, or t
ccctgccccgcgctganaggggggcctggccgcgcagccggatttttgacaacttaattgaccattgttaattttttaggaggcaaataattgaatttatttgaccctgtttttggagttaggttgattgacccttcgggaaaattgaatcccaataaatattctctctatatgaggaaggctggattatactcccattttggagtgaccagccccgagattttgttaccaagaatttttacaggatggaacagattcccattgattgggactgtgtgcgaatggatgcccaatgctttttggggtagagaaccc

SEQ ID NO: 701785 - DNA, 260 bp, Homo sapiens
ggatcccaatgcagcgactcggcagctgtttatgctcttcttataaaatctaatgatgtttgtctggagctctgtcatgtcgatggttcattgatatctcactgttctgttggcgggcagtcttgcaggttagaaagtacttgctagattagagggttcagaaactcagtcccttcaaaatgcttcagatcctaaagcttacaaattgtcctcagccttggtgaagaggatcttatcctggggattccgcggcattgggt

SEQ ID NO: 701786 - DNA, 288 bp, Homo sapiens
catatggcacggccaagaactgaactcaacatgtaccagatggatctaatagacctttacagaactttctacccaaaaacaacaaaatacacattcttttcattgccacatggcacatactctaaaattaaacacataattagacataaaagaatactcagcaagtgcaaaatagccaacatcctaccaaacacactgtcagactatatcacaataaaaatagaggtcaaaactaagaaaagagcccaaaaccatacaattacctggcttggccttgccatagtgcaa

SEQ ID NO: 701787 - DNA, 109 bp, Homo sapiens
tcattagcaccaaccaaagacataacagccaatagtattagtgaatcagagaaaggaaaagatcacatgactcagattatgacagcaatccgtgtgtgtgtgtgtgtgt

SEQ ID NO: 701788 - DNA, 556 bp, Homo sapiens
cttccagcactgtcccggtgagcgctctggctcggcttatgaactccccggaatacccggccacgtgggagattggcttcggggcgtctaccgctttgcccctgatagggatgacttccccgagggacttgatactaaatttgggactcttttctcgggagtttggctggcccggagacttgagtgaccttgacctcatggcacctcagcccggggtgtagcccagtagaccaatgggatcctgtgctggacccggatcttcccaagaaccgcctaccatctgtgaccccccccagatgtgccctgatggccgctgaagtttgattcagatgggcacttttcttccccttccctgcctagtttcctctttgttccttgagtccccgcccggattcccttctctggtcagcagacaggcttaagctaaagatattgcctctattctgtaaagattctgtacatagttccccagcttctcacgggggtgatttttgctcttgtcctgagaaataaccgtgctgttttaaaaaacctttgaaattaataccgcacccca

SEQ ID NO: 701789 - DNA, 307 bp, Homo sapiens
  misc_feature (64)..(64): n is a, c, g, or t
  misc_feature (159)..(159): n is a, c, g, or t
  misc_feature (296)..(296): n is a, c, g, or t
ctgtctcaaaaaaaaaaaaaaaattaggcaggcatccgtggttcacacctgtagtccccaattnctcaggaggctgaggtggagggattgcctgagccccagggttcaagactggcctgtgcaatatagcaagaccccatccctaaaaaataaaaaacncctatcagggtgggtgcatgccagtagcctcagctactcaggaggctgaagagagaggatcacttgagtccagcaggttgggacagcagtgagctatgattgtgtctctgtacttcagcctgagtgacagagcaagnccaatgactca

SEQ ID NO: 701790 - DNA, 956 bp, Homo sapiens
ggtccttgctcagtgaaatatcctcgctagtgaactcagatacgtactctcctctcctctcttcttgttgtacttggagcggcactaagccagacaggttccaggcatcgaaccgaatagtggtggtgagcgtcgagccccccagaaacgtgcttgtgtgctatccaccgtctgcctagtatttcggacatcgagggttcatcgagccaatagcgtgaagatagagatagtgcaggaagcgaaccaccgttagggtgcgcacaaagtccctaatgtggctgcgagggaattggaaaattctaagagggttgtccccgtaaaagattctgagaaaagaaggattcccgaatccctgaacgcaggcaggatagccaaagtggcttcgggagacaagccaggagaatagcatgtccttgggtaatctgatcactacatgttgctgaaaaaggaataagaacttactcattgcatctttgaagtaatcgtgcgtcctttgtgtaccctgatattcttagactgttactggacctacagtgtgttgtcccacatttgctttcgttgacaggcggttgaaattaaaaaatttcaggttatgcttggtggatgtcaacactagtgtgaaattgtgcgaatggtacgactaatttatggtacataagctaatcattcagataggtgcatgtgggtccgttaccagataaggggcaactctgtaaaagtcagatctgctggtgtctatcacaggtttcggattggaggattcctgcaatgtgtaccgggcccattaatgggctggaatggaaggcggccatgtacccccaactttaaaacacgattttgtaaaacagggttaaaccaaaaaatgtcccccgcgctcacattgcccaggcaaattagataaggtcaaaccccacatattcctatcaccctattgtcaaccttccccaacaccccaa

SEQ ID NO: 701791 - DNA, 194 bp, Homo sapiens
  misc_feature (17)..(17): n is a, c, g, or t
tcgagctcggtaccganttacgctcctagacggggtttcaccatgttggcagagatctcgacctcctgacctcaggtaatctgcctgccttggacgcccaaagttctgggattacaggcatgagccaccatgcccggcacagaaatttatagctgtaaatgaatatattataaacggaaataaaacttcacaat

SEQ ID NO: 701792 - DNA, 300 bp, Homo sapiens
gaccttgacaaagtggagcagcatgtggtgcacggaagaggaacggacactgttgagtacacaggaagggatccatccgcgctttccctcctcaacatcccctcattgctgttgattaccaactcactggacagccagtgctcattggtggcaccatggaacacctgtagttatgttcttacgtggcactgaacagggcatgattgagcaccttaggaacaacctgtcatgtagcgggccgtgcattgtcccgagcaaaatctcgcagtaattgatatttccaggatgtcttagacaaat

SEQ ID NO: 701793 - DNA, 2081 bp, Homo sapiens
  misc_feature (716)..(716): n is a, c, g, or t
  misc_feature (724)..(724): n is a, c, g, or t
  misc_feature (745)..(745): n is a, c, g, or t
tgcgatatgggcctcaggttgcgagagtggacttgcaatggaaagttctggtgggagccccgccgaacggagggtttgaacgacccgcccgaacaaccgggtttttctggagagtttctaaaattcggcgtttaaccccgctcaggagtttagctggggaattgttctttctgaaggtgagtgaacacaccccatcttgggctgttaaatacctcagggaaatctcgatttcatagtgattaaataattggggtaaaattgtagcttataagccatactacttggaggattcttctactaaattgtatttaaagtggcaagttgtatagttttcacttgaagttaatcataaataatgggaatggtgctcccacgaaggtttatttttcacattttttgcttatacatctctgagttcctataatacacgtgctataagctatgcacccggaatataaatgtttggaatcccaggataatggtttttatctgctaagagggagttatagttattatctaatgagttttgattgggttgcactttttgttgccaatgtttattccaccttgcccgttatgaaatatgaatatgttttaatcaactagtgtggcttaaataacccaacacatttgtgtataaaaaaaaaagcccacgatttcattgtttgttgaatatttcttaagcatctggcccctaaagagaccgcttcttaccnagcctgtnaactatgcatgatggaaattnttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaa

SEQ ID NO: 701794 - DNA, 2027 bp, Homo sapiens
  misc_feature (716)..(716): n is a, c, g, or t
  misc_feature (724)..(724): n is a, c, g, or t
  misc_feature (745)..(745): n is a, c, g, or t
tgcgatatgggcctcaggttgcgagagtggacttgcaatggaaagttctggtgggagccccgccgaacggagggtttgaacgacccgcccgaacaaccgggtttttctggagagtttctaaaattcggcgtttaaccccgctcaggagtttagctggggaattgttctttctgaaggtgagtgaacacaccccatcttgggctgttaaatacctcagggaaatctcgatttcatagtgattaaataattggggtaaaattgtagcttataagccatactacttggaggattcttctactaaattgtatttaaagtggcaagttgtatagttttcacttgaagttaatcataaataatgggaatggtgctcccacgaaggtttatttttcacattttttgcttatacatctctgagttcctataatacacgtgctataagctatgcacccggaatataaatgtttggaatcccaggataatggtttttatctgctaagagggagttatagttattatctaatgagttttgattgggttgcactttttgttgccaatgtttattccaccttgcccgttatgaaatatgaatatgttttaatcaactagtgtggcttaaataacccaacacatttgtgtataaaaaaaaaagcccacgatttcattgtttgttgaatatttcttaagcatctggcccctaaagagaccgcttcttaccnagcctgtnaactatgcatgatggaaattnttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgtggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaa

SEQ ID NO: 701795 - DNA, 755 bp, Homo sapiens
  misc_feature (331)..(332): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (373)..(373): n is a, c, g, or t
  misc_feature (434)..(434): n is a, c, g, or t
  misc_feature (464)..(464): n is a, c, g, or t
  misc_feature (481)..(481): n is a, c, g, or t
  misc_feature (512)..(512): n is a, c, g, or t
  misc_feature (568)..(568): n is a, c, g, or t
  misc_feature (573)..(573): n is a, c, g, or t
  misc_feature (593)..(593): n is a, c, g, or t
  misc_feature (612)..(612): n is a, c, g, or t
ggggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccnntgatggcccncnancttnccatccagacatgccgagctcgnctccgggaacttgtcatctccaacgaacaaaaggagcttttgccactgactcggccgtgtnctgacacgctccagaacgcaggtgctgggngcccgttctgcctgggnaccccgggaacctctcctgccggaagccggnacggcagggatgggccccaacttcgccctgcccacttgacttcaccaaatcccttncctgngagactaaacctggtgctcnaggagcgaaggactgtgancttgtggctgtaagagccagagctagtctctggccaccagctgggaagtcacctggtccacccacccccagtctaaggttcttcaagcgtggaggtttgagatggtgcctccactttcaagggggaaaggctctgatcctgaa

SEQ ID NO: 701796 - DNA, 2366 bp, Homo sapiens
  misc_feature (716)..(716): n is a, c, g, or t
  misc_feature (724)..(724): n is a, c, g, or t
  misc_feature (745)..(745): n is a, c, g, or t
tgcgatatgggcctcaggttgcgagagtggacttgcaatggaaagttctggtgggagccccgccgaacggagggtttgaacgacccgcccgaacaaccgggtttttctggagagtttctaaaattcggcgtttaaccccgctcaggagtttagctggggaattgttctttctgaaggtgagtgaacacaccccatcttgggctgttaaatacctcagggaaatctcgatttcatagtgattaaataattggggtaaaattgtagcttataagccatactacttggaggattcttctactaaattgtatttaaagtggcaagttgtatagttttcacttgaagttaatcataaataatgggaatggtgctcccacgaaggtttatttttcacattttttgcttatacatctctgagttcctataatacacgtgctataagctatgcacccggaatataaatgtttggaatcccaggataatggtttttatctgctaagagggagttatagttattatctaatgagttttgattgggttgcactttttgttgccaatgtttattccaccttgcccgttatgaaatatgaatatgttttaatcaactagtgtggcttaaataacccaacacatttgtgtataaaaaaaaaagcccacgatttcattgtttgttgaatatttcttaagcatctggcccctaaagagaccgcttcttaccnagcctgtnaactatgcatgatggaaattnttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaaaaaaaaaaaagaggataaaaaaatttgtttgggggggctggggccctggaaaaacttttttaaccccatttgtgtggggggcgcgggggcccccataggtacgcggaacactggggcaaagagcggtccccaagagaaaacacggggacagaacatgagcgcgcgggatctcccacccatataaaaaaccgcggggggaaccgaacggtttcggaacaccatcccaaagggatcacgagagaccaaacgggggtctatcacaggggtctcacaggacgcgaatga

SEQ ID NO: 701797 - DNA, 683 bp, Homo sapiens
  misc_feature (478)..(478): n is a, c, g, or t
  misc_feature (539)..(539): n is a, c, g, or t
ggggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggacccctgatggccccacagcttccatcaggtaagcctcgaagtcggggcagaggttgaacaccaggcaaggatgctgcgggacctcggagctcccgattgcctcgcgtaactcttcccgtacttttcctctaattcagacatgccgagctcgnctccgggaacttgtcatctccaacgaacaaaaggagcttttgccactgactcggccgtgtnctgacacgctccaggtgagtatctacctctacttggtagacgcgagggttaaaccgggcaagtccctggagtttggcagaccgtttttgaaacatttggcacctcactcggtatacgggaactgactgccagagatgggccaag

SEQ ID NO: 701798 - DNA, 789 bp, Homo sapiens
  misc_feature (407)..(407): n is a, c, g, or t
  misc_feature (468)..(468): n is a, c, g, or t
  misc_feature (498)..(498): n is a, c, g, or t
  misc_feature (515)..(515): n is a, c, g, or t
  misc_feature (546)..(546): n is a, c, g, or t
  misc_feature (602)..(602): n is a, c, g, or t
  misc_feature (607)..(607): n is a, c, g, or t
  misc_feature (627)..(627): n is a, c, g, or t
  misc_feature (646)..(646): n is a, c, g, or t
ggggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaaccacccccctttttgaaattggggccccccccaaacccttttttttccccccccccatttccaagacatgccgagctcgnctccgggaacttgtcatctccaacgaacaaaaggagcttttgccactgactcggccgtgtnctgacacgctccagaacgcaggtgctgggngcccgttctgcctgggnaccccgggaacctctcctgccggaagccggnacggcagggatgggccccaacttcgccctgcccacttgacttcaccaaatcccttncctgngagactaaacctggtgctcnaggagcgaaggactgtgancttgtggctgtaagagccagagctagtctctggccaccagctgggaagtcacctggtccacccacccccagtctaaggttcttcaagcgtggaggtttgagatggtgcctccactttcaagggggaaaggctctgatcctgaa

SEQ ID NO: 701799 - DNA, 207 bp, Homo sapiens
ttttttttccaggggggttttttttcccatccaactcccttttgtttcccggccctttgccatcctgaaccaagccttggttttaccccggcggggcaagttttttgaaacttttcttgctgtttggggggggccccccaatggggtccccctgggtaagggggcctttcccaatgcctttgggtgttaatgattttggatttggga

SEQ ID NO: 701800 - DNA, 286 bp, Homo sapiens
gggtgatctagcggatccttcttatttccggtgccttaacatggaaagggaagatcatatctgctaccacaaaaacacacttaagctcatagcccacagacaatataaagcaattacacaatcaagtctgcaaagcaattcagctggtaacataaaaacaggatcaaaatctcacatatcactactaaccctgaatgtaaatggtctaaatgacccacttaaaaggcagctggataaaaagaaaagtcccaactgtctgctatcttcaagagacccatctcaccta

SEQ ID NO: 701801 - DNA, 218 bp, Homo sapiens
aacactcggcgaagtgccacggtatcgctctgatgccctgtctggagggcagagatgtggtcacagatcactacagactcaacctcctcggttcaggtgatcctcccacctcagcctcccaagtagctaggaccacaggcacacgccaccacatccagctagtttttgtatttttagtagaaatggggtttcatcatgttgcccaggctggtctcaaa

SEQ ID NO: 701802 - DNA, 216 bp, Homo sapiens
tgagcccgaggaggtgctcctactacaagagtgggatggggcatgctggagtagttgggggcagctgggaacactaccgttaataggcgtaggtagagacgaagagggactcgctggcagcagccccagcctgaccgctcggagtgtacttatccttgacaggcaatgcatgttggccaagtggctctgcttgacatactccatcctgctgcatgc

SEQ ID NO: 701803 - DNA, 678 bp, Homo sapiens
ctagattatagtgaggagttcagttttggatgtgtggggtgcatgtagaccatccatgtgacatttactgtgggttactagatacagaatctgatgtctggggaggctgagattacaggcacctgccacctcgcctgggtgatttttgtatttttagtagagagaaagggtttcatgttggccaggctggtctccaactcctgacctcaagtgatccgccagctttggccacccaaagtgctgggattaccggcgttagccaccatgcccggcgaaagattttgtattttatttcaagaggagaaggaagctattgaagtgttgtaggcagggaaatgacatccaaagtaatgacaacagtcatagtttaaatatgctgctatcacgttttcagtaaatgtgattggttttttgtcttaactgggtttctgctgcatcatttctcaatcatttttactcccttcagaatttcttggctctttgtgccagtaattactacaatggctgtatatttcataggaatatcaagggtttcatggttcaaacaggagatccaacaggtaagttattccattaaccaagatctaaggaactgaatgtatagtatgaagaagtgggtgaaagaagaggaattaatacgtggagttttggttgagtccgtcggttataagtctgtct

SEQ ID NO: 701804 - DNA, 1015 bp, Homo sapiens
  misc_feature (25)..(25): n is a, c, g, or t
  misc_feature (86)..(86): n is a, c, g, or t
  misc_feature (392)..(392): n is a, c, g, or t
  misc_feature (433)..(433): n is a, c, g, or t
  misc_feature (435)..(435): n is a, c, g, or t
  misc_feature (466)..(466): n is a, c, g, or t
  misc_feature (605)..(605): n is a, c, g, or t
  misc_feature (620)..(620): n is a, c, g, or t
  misc_feature (709)..(709): n is a, c, g, or t
  misc_feature (711)..(711): n is a, c, g, or t
  misc_feature (740)..(740): n is a, c, g, or t
  misc_feature (769)..(769): n is a, c, g, or t
  misc_feature (877)..(877): n is a, c, g, or t
  misc_feature (906)..(907): n is a, c, g, or t
  misc_feature (1010)..(1010): n is a, c, g, or t
agccatcacaacaaaattcacattnagaggatccagaggactgttttagaaaattctaaagcatatttaattaggttttaacagtnagggagatcttaatataacaaagcacttaaaaagtaaagactactactgaaaattaagtacagtactataaagaactagaaatgaactgcacgcgtagtgtaaacttaaagcagagcttcatgaaaatataatacacttctatgaatgtataagtagcaaacatcattggcttacaaaaaactgaaactaaaggaatttccaatcaaaacacaagcacagtggctttaattcaatatagagctatgataagtatataaagagaacctgaatacttacgtacttgtaatatgattttatgctgtaanaatagtacaaaacacatcaactctaatgcatagatgaagananatgaaaacacgataacaaaggaaagcctttntctatataagaaaatagccaagtactccagtactgtataggctcgtaattactgatccagtaaaattctacgtcctccagcttgagcagtattataggattaacaaatataacatttaatagcctaaaatatgaaactnaacagtggatcagtncattacagtaattgcagaaaatatacacagtaatgtactgaataatactgatggcataggagtatgtactacttcatcatccagctgtntncaatacctggtcatatctaaagcagagtncatacataatggacatctgtagccttctntcaacatttcttcataacacgttctatgtaaaagatgtacacatggcaagaaatgagcaacaacacgggatgtgtgaatattctccaaacatattggacaattctgtngggacacattttcaatacacttgtatatnnccttgaagattcatagctaggcataagtcacattcaaacaatggaaaaatcttcctttggaccatactacaattccacagttttacagtaatatgcttctatntttgt

SEQ ID NO: 701805 - DNA, 94 bp, Homo sapiens
agctttcccccccgggttaaaaaaaaaattttttttttttatgccttcatagggtgcccgtttcaaagggccccataaataaaatgttttccca

SEQ ID NO: 701806 - DNA, 110 bp, Homo sapiens
gatgagatcttcctactgtgtgacaaggtgcagaaagaggacattgaggtgtatttcacgggaccaggctgggaggcccgaggctccttttcgcaagctgatgtgcaccg

SEQ ID NO: 701807 - DNA, 227 bp, Homo sapiens
ctggctaagaaataccaatgaatgcctaaggcacgcctttgcccaaacccatggagttacagccctgtatcaagtatctcaaactcccaaacaaaacccataacaatcacaaacccccacctatggtcttgtctcaaagaagagccgagtgtgttaggagccatttagtagccgaagagagaagaccccaaagcgctgtggaaacctctgtggggctgaccagcagc

SEQ ID NO: 701808 - DNA, 269 bp, Homo sapiens
gcacggcgcagcatgttacgaacaggtgcacatgaggaagaacatggagaggatcggggccacgctgtccagagaggcgataggatgccagtctcgcagataaggactgtcagcagcagcgcccacgtgggctccccgttggccttcccgtggccaaacacctgcagggagaagggcaggaggatggggcagatgacaccacccttttaggagagaagctgcaggctggtcaggtctagcccagattaatcttaaagacacagaccagc

SEQ ID NO: 701809 - DNA, 169 bp, Homo sapiens
tcagtgacactcagcagaggtaggattcatctcacccggtggtgcccgagccgtaagatcctggatcttcacggcatggcgtgtgctgtcagctccagctgcacctgatgtggctcaggccacgtgtgccacagaggatcagctggctggtcaccttaggtagctggcc

SEQ ID NO: 701810 - DNA, 766 bp, Homo sapiens
ggctgcgcggggctccctccttaccgcaggagctcctcatcgagtaaacccaggtggtgtcttttccacgtggtagaagctggctaagcctgccacttccacagttccagcccaagggaaagtccaaggtaagtagatatttctttaagggggatgacctggtaagttgcgcacttcattggtcatctcatccatggcttgaacctagtcatgtgaccacatcagtcaagaaggctggctgcgatcgtatagtctccagctgtcagccatgtagagtgtccctggtatccagtgggggatgggttccaggatgctacctcagaaaattgaaaatgtgcaaagtgctcaagttgcattgatataaaagatgggcagtagtagttgtgcatataacctgtgcagtacccatcgtggatactttgtaatcatctttagattacttataatatctagtacaagtgaatgctatataaatagttgtgatactgtattattcagtacagatgcgactgatagtaggcctaactacattttctatccacagttggttgaatctgctcctacagaagcccatggaaagcccaggggccaaactgtgtgtgtgtgtgtgtattcagctaaaatttggggggaacggattattactaaagatgagtaggactagtgagacgatggctcatgggctcttattagattttaaaatctaggctgggcgtgtgcatcacgctgttatccagtatttgggcgcaggtggggacacctgagt

SEQ ID NO: 701811 - DNA, 302 bp, Homo sapiens
  misc_feature (27)..(27): n is a, c, g, or t
aaacatcctcaatcctcacttagtagntatcagtctttttaaactttagccattttaaatagatatcactttttctatttttatttttatattgaaattggattttttgtcgcccaaactgaattgcagtggcaacaatgttagtattaactgcaacctctgcctcccaggttaaagcgattctcctgcctcagcttatcccagtagctggaactaacaggtgcccgccaccacacctaatctatttttttgtatatttttatgtaaaaacgggttttcatctgttttaacccaggacggtt

SEQ ID NO: 701812 - DNA, 223 bp, Homo sapiens
tagcaacatgattgaatcaacacaaaacaccacagacataattattagcagtcatccctctactagatattaaccgaaactcaacaagcaatcgtatttagcatgtacccctaaacttgtcctcagaaccccctaacaaacccgcgtcctaatactaactacctgaactcctacccctcacaatcatggcaaagccaacgccacttatccagaggaccgtagg

SEQ ID NO: 701813 - DNA, 224 bp, Homo sapiens
gacagcttcctgcggtcaggagcttcgagagtccagcccgggcacatggtcgaaactcgtctctactgaataatacaattaagcttgggtgtggtggcacacgcctgcaatcccagctacttgggaggcggagacaggcgaatcacgaggtcagcgagttctgagaccagcctggccaacttggtgaaaccccatctctactgatatatacaaaaattagctgg

SEQ ID NO: 701814 - DNA, 393 bp, Homo sapiens
  misc_feature (324)..(324): n is a, c, g, or t
  misc_feature (327)..(327): n is a, c, g, or t
  misc_feature (330)..(330): n is a, c, g, or t
  misc_feature (368)..(368): n is a, c, g, or t
tttgatttttagaaaaccagccaagagccacaatgaccaaaaaagaaaatgaatagaaaagaaaagtatgaagagacgtatttttaaaatgatagggttaggctgggtgcgggtggctcatgcttataatccaagcactttggaaggccgaggcaggaggatcgcttgatctcaggagttcgagaccaacctgggcaacatagggaaacccccatctctataaaaagtacaaaaattagccaggtgtggtggcatgcagctgtagtcccagccacctgtggggctgaggaaggaggatcgcttgaacctggaaggctgaggctncantgngcagagatcgcaccactgcaacaatccagcctgcatgncaaaagtgagaccctgtctcaaaac

SEQ ID NO: 701815 - DNA, 213 bp, Homo sapiens
  misc_feature (28)..(29): n is a, c, g, or t
  misc_feature (182)..(182): n is a, c, g, or t
agcgccacattaacggagaggttgtatnntgtctctaggtgcgacgtggcgggcggcacgagggcagatctgagccagcctgtcctctcctcaagggccgactaggagacgcagcccagagtccccggggtgcccagccaccctgcatcacggcccgcagcagcagcgggaggggagcgctnctggacatcattccttctccggtggcgtggt

SEQ ID NO: 701816 - DNA, 398 bp, Homo sapiens
  misc_feature (52)..(52): n is a, c, g, or t
acaggactttagtgtcactgtctctcattcttattctctcctccagatttanctcctccattcaccacacagtcttatagggtcaccaatgagctccacattgctaaattggtgaatacttctcagtacctcactttagttgacccattagcagcatgtgacctattggctttcacatggcccatcaccctcttctcaaaaactggctttatttggtctccaggatatccctctggatttcctaactcaatgagagctcctccttagtctcctgcactgtttttcctcatatactatctctaagcactgagagaaccccaaagttctcctctgacatcttctctatttgaatgcacttcctcagctatctcctctagttcaacagctttaaatttact

SEQ ID NO: 701817 - DNA, 824 bp, Homo sapiens
agcggagtggcctcgcgtggtctgcccagtgtgagccgcggggccgcgagccaccgctcaccccgcgtcggggcgtggggctggcgggtggagcctcatgccccgccccagcggctggtgccctgcccgcgccgctgccggctcctcctcccatccttccgtcctccttcgccttccgtcggctcggtcccttgcttccttgcttcgcctccgcgcctcgcgcctatgggacagagccccgcgcatcccgcagcaccacctgaggatccaggaaacctggcccgagcgatcggacacgagcgatccacggacgcctgcgcaccaggcaaagcaactagaacgaactcgccttaacgcgagcgcaaaacgtgcggcaacacctagagcctgaaagcaactggcgccccattgggcttgcgatcgcacagctgctcctccttgccttagccacccacagtacacaagactttctaagttacacaccaacttaacaaaaccaacgattgcccctgctcataagagacgcaagcgacccagtggacaccaagagaacgacgggcgactacaggaaaccaaggccaaagaagcccagagccgcagcaagagacagcaaagcacccaaacagacacagcacaggagagcgcatccgttaacaaggcacgagctatcccagcgcatcgaagcgttagccgcccaagtatagcgtaccccgggcgaccgacaaggcgcggacccagaccaagagaacaaacgtacgcgaacaagcgggtaccaaacccgggcgcgtgacggctcggaccacaggggcacgaccagccccctg

SEQ ID NO: 701818 - DNA, 800 bp, Homo sapiens
  misc_feature (2)..(2): n is a, c, g, or t
  misc_feature (71)..(71): n is a, c, g, or t
  misc_feature (110)..(110): n is a, c, g, or t
  misc_feature (129)..(129): n is a, c, g, or t
  misc_feature (135)..(135): n is a, c, g, or t
  misc_feature (139)..(140): n is a, c, g, or t
  misc_feature (145)..(145): n is a, c, g, or t
  misc_feature (177)..(179): n is a, c, g, or t
  misc_feature (181)..(182): n is a, c, g, or t
  misc_feature (188)..(188): n is a, c, g, or t
  misc_feature (223)..(223): n is a, c, g, or t
  misc_feature (232)..(232): n is a, c, g, or t
  misc_feature (237)..(237): n is a, c, g, or t
  misc_feature (239)..(239): n is a, c, g, or t
  misc_feature (245)..(245): n is a, c, g, or t
  misc_feature (247)..(247): n is a, c, g, or t
  misc_feature (252)..(254): n is a, c, g, or t
  misc_feature (277)..(277): n is a, c, g, or t
  misc_feature (280)..(280): n is a, c, g, or t
  misc_feature (301)..(301): n is a, c, g, or t
  misc_feature (307)..(307): n is a, c, g, or t
  misc_feature (313)..(313): n is a, c, g, or t
  misc_feature (341)..(341): n is a, c, g, or t
  misc_feature (349)..(349): n is a, c, g, or t
  misc_feature (357)..(357): n is a, c, g, or t
  misc_feature (376)..(376): n is a, c, g, or t
  misc_feature (412)..(412): n is a, c, g, or t
  misc_feature (459)..(459): n is a, c, g, or t
  misc_feature (463)..(463): n is a, c, g, or t
  misc_feature (470)..(470): n is a, c, g, or t
  misc_feature (519)..(519): n is a, c, g, or t
  misc_feature (546)..(546): n is a, c, g, or t
  misc_feature (562)..(562): n is a, c, g, or t
  misc_feature (565)..(565): n is a, c, g, or t
  misc_feature (589)..(589): n is a, c, g, or t
  misc_feature (610)..(610): n is a, c, g, or t
  misc_feature (639)..(639): n is a, c, g, or t
  misc_feature (646)..(646): n is a, c, g, or t
  misc_feature (685)..(685): n is a, c, g, or t
  misc_feature (687)..(687): n is a, c, g, or t
  misc_feature (719)..(719): n is a, c, g, or t
  misc_feature (723)..(724): n is a, c, g, or t
  misc_feature (726)..(726): n is a, c, g, or t
  misc_feature (774)..(774): n is a, c, g, or t
tnaaaaccccagctcaaaatacgacactaacatgatgaacatgcatgagctttgaaaagtgctctgtagtnttatgatgatctagaagagcactgtccaatagaactttntgtgatgatgaaaagtttnttcttntgannttttnaatagggttaccactaatcttgcgtgggtctnnngnncttggnatgttgcttgtgtgtttggggggctgggttttgantgttaactnttttnanttttantnttaannngttacttgtgggtggtgggtgcngtncgggacagttcagcgctaggnttatgntgtgtnctcctgttacacatactcttggtctctnctactctnccttcatnacacctgtgacatcttgcnatttttttttgtttgtgtcattatctgatgtattcntcctgggctctgagctccaaatgaacaaatgctttgtctactttgcnatanctgtgtncccagtgcttggcatgggacctggtgcagagtaaatacatcataaatantttgtgaatgaatgaatgaatgaatgnccatgattaataaaanganatagctgctcagtctggtgctganaatggtggtagtgatcaaaanggttaaaccacaggtcattaaatgaaaanagctaanttagtgcttacaggaaccatacactccctgtgtataaanangccggtgtgtgtgtacaggtgtgtgtgtgcanaagnntnatgtgtttgccaaggtttgccctttgtgtagtcatgtgtcgcactgtntgctcatgtgtttttgtgtctggata

SEQ ID NO: 701819 - DNA, 199 bp, Homo sapiens
aacagagacctgtctctaagaaaaaaaattttgaataggctgggtgtggcggctcacgcctgtaatcccagcactgtgggaggctgaggtgggagatctcttgagccctggaattcaagaccagtctagtctgggaaacacagcaagacccgccttgctgggcgcggtggctcacgcctgtaatccctagcactttggg

SEQ ID NO: 701820 - DNA, 231 bp, Homo sapiens
  misc_feature (34)..(34): n is a, c, g, or t
  misc_feature (38)..(38): n is a, c, g, or t
  misc_feature (41)..(41): n is a, c, g, or t
  misc_feature (79)..(79): n is a, c, g, or t
  misc_feature (175)..(175): n is a, c, g, or t
  misc_feature (197)..(197): n is a, c, g, or t
  misc_feature (224)..(224): n is a, c, g, or t
ctgagtctcttgctgggcgggcgcgtttccggtncacntcngcctgtgggttcgcgaccggggggtgggggcccaggcntattggcgggagcggaccccgattccgactgggaaccggagaacgggagctgcaggaggtggagaggtacggcttctcccgggccccagcttgaancagggcctcgtgcccggcgctncaggcgcgccccttggcccgggtgtcntgcgctc

SEQ ID NO: 701821 - DNA, 124 bp, Homo sapiens
ctgcacgcttacatatcttaacaagcttgagatgcaagcagattgaagagtcaaatctgaccaagatgttgatgtggataagagaattctctgctccccacctctaagttgcccgccaatcgaa

SEQ ID NO: 701822 - DNA, 1068 bp, Homo sapiens
gcttcaggcgtttgtaaagtgaggtctggctctgcctcctccgtttattttttttttattctgtttctgttatctagtattttatttttggaaatggagtctcgctctgtcgcccaggctggattgcaggtgtcacaatcgtacaggctcattgcaacctcgcgtcctcccaggttacaagagattctcctgcctcagcctacccgagttagctgggattacaggcgtgtgccaccatgccgtggcctaaatttgtggctattcttaagtaacagatggggtttcgccatgttacgccagactggtgtctcagacactccctggacctcagtgtaagatctctccccaccccgggttttccacaaatggttctggggattaataagcgctgtagacgccaccatggcccggtactacttctccagttcttagaagcccatcctctggatttcccaccaggaagtttacttttccctccgtgaccttgttacacacttgtgctctcttatacacactgtggtctgacagggtgtgggcagcccataatgcggggcttatactacaaagagcgtcgtgttcgggccttttaggttcccctatctatatcactctgcccggtgtctctactctcttgaacgctctgtggcgaagttttgccgatagccccacggcgggcctttccataggcgacgctgtgctacgtggcgtcttgcagcagccctgtgtggcctacaaaagccccccgtggggggtcctcccagggcacgaccacgggcgtggggaaaccttgctgaaggcaccctttggccttaacgccccagcggaagcacatgttttccccccttctctattttgagggccaagggcacactacccttggcagggtgtggccctcccccccaaagtagatttgtgacagaacatcgttgggaccacgtagcagcgtattcgtggcgccccttcaagagaaggcacatattctcaaagaggccccccattagatggcctcggggtagaaaacactaacgccaaacactgcaaatcttcccgtgggtattttccacccaa

SEQ ID NO: 701823 - DNA, 179 bp, Homo sapiens
actggatggaaatcattgttgatgataaacatatggacgagggtgaatttgtaaatgatcacaatttttaatcaaacatactagcttataaaagattttaagatatggttttacatgaagaggcttttaaagacaaggtacagtagaaattttaaagcaaatataatatatatatgtcg

SEQ ID NO: 701824 - DNA, 275 bp, Homo sapiens
ggatacacaggatacacacgcacttaatttttaaggaaaacgttatgtcttatacaccatgatcctgggtaatagcttttccaaactttgggaaaaatccttaaaaagggttccacatgtcacctgaaactttacaaatttaaccatcatccaagaagggatggttctaccactcttaccaaggacactaaaaaggaaaacaccattaaaaaggtaaggaaactgtctccaagggcatttttttttacaatccctttcctcccacagtaaggtaa

SEQ ID NO: 701825 - DNA, 114 bp, Homo sapiens
  misc_feature (48)..(48): n is a, c, g, or t
tgtggtctctgcggagagccgcgcgcgcccgtgtatatctggcctatntttgttgagaagtggtgggtttgagacttatttctgttatgtctccatctattgatgagggtctta

SEQ ID NO: 701826 - DNA, 162 bp, Homo sapiens
tgaacctaaaccacactatttgattcacttctgtgtttatggaaacttttatgttctgatcaatgcaaatatgcctactgtaacagctggcaatgcccatgtctccacaaggcctgagaatatgatcacaatggcagtacatctcaacacaagctgaagagg

SEQ ID NO: 701827 - DNA, 88 bp, Homo sapiens
ccattcccgtggagtatggaatatcaaacctccatcaatatatctggaggcctatgaggaataaagcagaggacagtggtacctgcaa

SEQ ID NO: 701828 - DNA, 568 bp, Homo sapiens
  misc_feature (11)..(12): n is a, c, g, or t
  misc_feature (15)..(15): n is a, c, g, or t
  misc_feature (40)..(40): n is a, c, g, or t
  misc_feature (66)..(66): n is a, c, g, or t
  misc_feature (95)..(95): n is a, c, g, or t
  misc_feature (112)..(112): n is a, c, g, or t
  misc_feature (530)..(530): n is a, c, g, or t
aggagaggctnnagncccgcacgccgcgcgcacagagctntcagcgccgctcccagccacagcctnccgcgcctcgctcaggtcccaacatggcnaaaattctccagccctncagagactgagcggtgcatcgagtccctgattgcttgtcttccagaagtatgctggaaaggatggttataactacactctctccaagacagagttcctaagcttcatgaatacagaactagctgccttcacaaagaaccagaaggaccctggtgtccttgaccgcatgatgaaggaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcaccactaaccacctcatgcaggccccacctgccnatagtaataaagccatgtcacttttttaaaacatgata

SEQ ID NO: 701829 - DNA, 271 bp, Homo sapiens
tctataggatccccttttaattggaaatgatctctaactagaaatggatctcgacacagggatgaagcagctgattgcaaataaagatgtaacaaaagccaagctctctggaaatgcagggagttcaatacagaaaccatttccccattccattccaaacacgtttcctcctcactcttccttggttattgggccgttgcttgctatgatccaaccctgtggccgacatctgtgactaagagagagagaaaagcaagcttcctcctaaatg

SEQ ID NO: 701830 - DNA, 514 bp, Homo sapiens
  misc_feature (11)..(12): n is a, c, g, or t
  misc_feature (15)..(15): n is a, c, g, or t
  misc_feature (40)..(40): n is a, c, g, or t
  misc_feature (66)..(66): n is a, c, g, or t
  misc_feature (95)..(95): n is a, c, g, or t
  misc_feature (476)..(476): n is a, c, g, or t
aggagaggctnnagncccgcacgccgcgcgcacagagctntcagcgccgctcccagccacagcctnccgcgcctcgctcaggtcccaacatggcnaatttcagaagcatgctggaaaggatggttataactacactctctccaagacagagttcctaagcttcatgaatacagaactagctgccttcacaaagaaccagaaggaccctggtgtccttgaccgcatgatgaaggaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcaccactaaccacctcatgcaggccccacctgccnatagtaataaagccatgtcacttttttaaaacatgata

SEQ ID NO: 701831 - DNA, 507 bp, Homo sapiens
  misc_feature (469)..(469): n is a, c, g, or t
gcgtcccgcgccgtcgactcgggtccagcaggggtaagatctgcagccctagagagactgagcggtgcatgcattcactgatgtgatgtctacgggaattatgctgcagaggatggttataactacactctctccaagacagagttcctaagcttcatgaatacagaactagctgccttcacaaagaaccagaaggaccctggtgtccttgaccgcatgatgaaggaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcaccactaaccacctcatgcaggccccacctgccnatagtaataaagccatgtcacttttttaaaacatgata

SEQ ID NO: 701832 - DNA, 318 bp, Homo sapiens
tgagaaactgaataaagtgaccttgttcaaaacaaaacaattagaaataacaattaatttcccagtagtgaatacatacaaagttaaaactatatttcttcaataaccacgtagaacaggacttaggtttgggaatcatatgccctgtgcttccaatttttagctcttgctacctctgtagttatggtcccagtgcaagttaacttaccctcttttgagaccttcttctccttctatcaaaaagagatcactaattcaacaaaccttgcagttgtggaggtgaggattaacaatagtatttataaagcacttaccagt

SEQ ID NO: 701833 - DNA, 529 bp, Homo sapiens
  misc_feature (73)..(73): n is a, c, g, or t
  misc_feature (491)..(491): n is a, c, g, or t
actcctgcgctgtgtgctgctcgggctcccggtttttctatctcttccacgatgtcgtaattctccagccctncagagactgagcggtgcatcgagtccctgattgcttgtcttccagaagtatgctggaaaggatggttataactacactctctccaagacagagttcctaagcttcatgaatacagaactagctgccttcacaaagaaccagaaggaccctggtgtccttgaccgcatgatgaaggaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcaccactaaccacctcatgcaggccccacctgccnatagtaataaagccatgtcacttttttaaaacatgata

SEQ ID NO: 701834 - DNA, 619 bp, Homo sapiens
cacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctggcactgacatggaccccggagccggcagaccttccaccccggttggctggttcccctgcttcagctttccttcttcaaatgggcgcccacttagtggccggcccgggcaaggccccggggtggtcaaattgcggctttttccggcccagcgccagcgttgcatcggaagaacatcctcaggggcctgcgttgggggctcccgccacagaaccacatgctcctggaacacaaaatggagcgcccagggcccagcctcaggcgagtgggacccgtgctgccaccacctgagg

SEQ ID NO: 701835 - DNA, 374 bp, Homo sapiens
  misc_feature (43)..(43): n is a, c, g, or t
  misc_feature (51)..(51): n is a, c, g, or t
  misc_feature (81)..(81): n is a, c, g, or t
  misc_feature (120)..(120): n is a, c, g, or t
  misc_feature (320)..(320): n is a, c, g, or t
cgccctccagggggggtcataatcctcgtcagggggcttcaanctctctcncggttaatagctttttgatggcttttagcnagcctcgctaacgtggccttaccccccactattaacctnctgggagaactctctgtggtagtaaccaggttctcctggtgaagtatcactctcctacttcgggggctcaacgtactggtcacagccctatactccctctgcatatttaccccaacacaatgggggtcactccccccccacattaacaacataaaaccctcattcacacggggaaaccccctcagggtcatacacctatnccccattctcctcctatccctcaaccccggcatcattaccgggttttcctctta

SEQ ID NO: 701836 - DNA, 1009 bp, Homo sapiens
  misc_feature (193)..(193): n is a, c, g, or t
  misc_feature (423)..(423): n is a, c, g, or t
gccgcgatgaggcctcagcgagtggcctgtccgagacgccgagacgtgagggtgcccctcgtctcaccatgcagagaggccgttccggcgtctcgaaccgcggcaccgttcgcaggaaaactggcgagtgagccaggcgcgcagtcactgggcacgatgtccctcccaggagtcctctgctcgctgttcctgntgatgagcatgacaggcagaagattccacgacagcaagcgatctgggctactgtcctagtgagatcggtctcagtctggcatgccctgcatgtgctgtcagaaggttggcgccgggcgtgccattgacgggtgctcatggtcatctgctctgaccaggcatcatgatagccctagcaaaggcacatggtgcaccacagcggtgtgtccctgacgcctgtggcgacatgangggtgcccgattcgtgccgccgtcttgaggccataggacacttgctctcgagtcagtggtagccttagtcctctagacgtgcagtgaagtctcggagtcacgtaccgtgcaccctagcttgccgctcctgttggcttgctcttgttggcatttgatgggcacatggcgctgccactctttgggagccactcgcgttgcttatcctggggtttggcctcgtgaccttctctcttatgccacatgaactacggatccctgtgatgctcctagatcccgggggctgcagcgtccactgttggctggttggacgtccttgcatcccttcgacgcaagcgcattgctggacgcggtcgtggtggctctgtgcaccggcactgagacagcatctgcgtgcctttccatctcacacgcgagcgacagggcgtccttctgcagctttgtggtgctgatgcccgatccactcgcccgagttcaatggagatccagaaaacgtcatcaacggcgagcccgaccctagacatgtggaactgcttggggtcgtctttccaaggcagtgaaacttcccgtcctcccacgtgaaattcca

SEQ ID NO: 701837 - DNA, 435 bp, Homo sapiens
  misc_feature (97)..(97): n is a, c, g, or t
  misc_feature (117)..(117): n is a, c, g, or t
  misc_feature (131)..(132): n is a, c, g, or t
  misc_feature (135)..(135): n is a, c, g, or t
  misc_feature (155)..(155): n is a, c, g, or t
gggagaacaagcaaaggccatttattcagagggctgcttgtatcaggggagtcagccacccatacatgtcttagggggggggaaaaaaaaaaaaggnccttggggctttttttgggnccccccccccaaannaancccccccgtgttttagctangtcttcagtttaatttgatatccggtaccacctcctaccccatttctacccatcttaggttcattggctgggacgcctgtgacaaaagacagattaacaagagaaaggtacacaaatttatttaatatgtgttatgtgacacaggagccttcaaaaggaaatgaagttctgaagaaacagctaaacctgaatggtttttgtcgtagatttgagaagaatgaagcattgtgggaaaatatgacaaagtaaagaaaaagaatgagagaaatgtaataaatcg

SEQ ID NO: 701838 - DNA, 309 bp, Homo sapiens
gcgcggtaccgagtgggttgagcggtggacgacggtatttttatcaacatagtggcgagaggcatagtcaaccactgtcggggagtacgaaaattactctgttcatcattttgtcaggcttgatccctagcgcgcattgcttcctcgtatgttcgacacacctcattcgcgggcccatccgcccgtatatgcccaccgttgatccagagtgcccggtcgtaatcggacacaaaatctaaatcgtgggtagcgacgattaactgttgggggaggcgatcgaacaagcgtccaagtgcagggacccactcg

SEQ ID NO: 701839 - DNA, 271 bp, Homo sapiens
  misc_feature (267)..(268): n is a, c, g, or t
ccggtcccctttgggggggccacaacccatcaatggtgccagcagcggcatggtctggtttctcctttggccggccggggctgggtcacatcagcagttcttgcagcatttgcaatgcagctggcatttcattgggtgtccctccaatcacttcgtgtcaaactcacagcaagcacatcagcctctgtgctcatgaggtgcatgcaagggcgcagcggctctctcaacacatggcatgctcatggcaccacttctcacaaactcagnnggg

SEQ ID NO: 701840 - DNA, 474 bp, Homo sapiens
atttggtagctagtttctctttgcaagactgcaaggagcgcgcagaatggatgggagtcagtgataaggatgtgattgtttgttcaactggatcctctctcttgctcttcgacataaatggtctccgtctgcagacatttcagtactgcccagaagaaatcttgagactctgtgtggaccctgttcatgtcattgtcacctgtaacaatggctctttggatgtgtacgtgtgggaggagagaagcccactgcttaggaggtgttatcgactacgaaaaaggggatatctgccactgtctggcttcattatcaaaacattatgtgatgaatcaagcataattttagtgatgactagtagtcccattccctgctttctgatggcatataccttgaaagtctgctcttgaaaactgagtgggttgtgtgtccttttccttaatgataataaagatatatttgcaagcacaaaaaaaa

SEQ ID NO: 701841 - DNA, 146 bp, Homo sapiens
attatccccagagatccccatacagagtagcttagaccacaggtgtcaccaccaccctcagctagcctttgtatttttagtacagacggggtttcaccatgttgccaaggctggtcttaaactcctgacctcaggtgatccacctg

SEQ ID NO: 701842 - DNA, 392 bp, Homo sapiens
tccctcctgggaaatgttttgcccttctgttcatctgtgaactgttttttgtttttaattactctgtaccccctccgaatcagggcttttacccctggtgatgcaaaaccccaaaggggcctaccttagcccccgtcctaaccaaacgagcaaacctgcagggggtttggaaatggacttggtccccccaaaagggtgtgcgccgttgggggaaaaactgcgtcccagccaaaaggacaaagtgtgggtgattctggagacgccagtttccgagattgttttgcatattcatttgcccattgttgtttgggttggacatgcgtgtgggcttcagtgtgaggcttttaatatgtatatcctgttatcaataaaacaattatccaagtggttta

SEQ ID NO: 701843 - DNA, 512 bp, Homo sapiens
  misc_feature (172)..(172): n is a, c, g, or t
cttaaaaaaaaaaaaggggtgggggggggggggcgcaaaataaaaaaaaaaaaaaaaaaaaaaaaaaacccccccccccccccccccccccacaaaaagtggttttttttggaaaaaacaccaacaaaaaaaagggttgtttttttttttttagaaagaaaaaaaaccgtgnaaaaaaattattttttttttaaaacccccccccccccttaaatttttttccccccccgggggggggaaaaaaaaaaattttttttttttttttaaaaaaaaataaaaaaaaccccccccccccccaattgtgggggggggaaaaaaaaattttttttccccccccccccccttggaaaaacacccccttttcccccttttttttccccccccctttttttaaaaagggggaaaattgggttttttcccccccttttaaaaatccctttttacccaattaaaggggggggccctttgggaaaacccccaattccccccagtttgtggcacagggtatggag

SEQ ID NO: 701844 - DNA, 323 bp, Homo sapiens
gggaagccgtgggcgcgcccgttctggtcgttgtccacaaagaggtgtttttttcccagaaatgggggcacttcccacagtgtgggcccccccccgaggagaattatccggagaattttaatatttttgcccccgaaagaaaaaaaaaaatttaagtattaataccccaagggccaagccggacttataaattaaaaatataaatatttaaagtttttattttttaccccccagcctttctggacctgcctttttggggataaaccattcattttttcccacccccggcccttttgttttttaaattaactttttaaaaggga

SEQ ID NO: 701845 - DNA, 126 bp, Homo sapiens
caatttctacacctattggactgaaagtgcttggacaatggaatggttttagaatatgacagaagaacacaaaccaagtagctgtgggttgaacctggcacgtgagctgtgctgcaggcgcctgtt

SEQ ID NO: 701846 - DNA, 369 bp, Homo sapiens
  misc_feature (369)..(369): n is a, c, g, or t
aataatcttataaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaatggggcccgaatttgggcttaattggccaatttcccctaaaggggggccgtttaaaattcaatggcccgggttttaaaacggtgggactgggaaaaccctgggggtccccaaattaaaccccttggaagaaaatccccttttcccaagtgggggaaaaaccaaaaggccccgaccggagggcctttccaaaaggtggccaaccttaatgggcaagggaaattggaagccgtatttttggttccgcggtttttggn

SEQ ID NO: 701847 - DNA, 782 bp, Homo sapiens
agcggggttctcttcctgtcttagtggctccggagaaggcgttggggatgccaacgatgaggctgctgtcatctgtggtgttggctctatgagctgtcgactcaagtcagagagaaggatgccaggctatttggcttccatagtcagtgctcgaacatgatactgcccgtgcgacgtggacagagacctagaccgttgccagtagcaacatcgtacaattgttgtggtcagatcgtagctagcacttagtacgttggaatctatactgatagattcgcttcccgtccagatagacttgtgcgcaattgtgtgctggaagttgctcaactgagtcaagatggggacctggaattgtcgcctgtatacgcaagatgtctctaccacactttgtggtctctgcagctcctctcaataggctaggttaattgctaacttcaggactcaggcaactatttactgtaggtcatggcccgagcgaggatagcggcccagtctgtgagttggctgcttaccaagtgcacgctgtcactgtggcatggaatcctaggacacagctgggagttgtgacgaggcggattcttccgccctcattttcctggatctgggctagacccttggcgagtcatgacgccattctcctccatacggtagtccctcctgtctcattgtggtactcacagacatgaggaaatatgacagctcccaggaatgaagaaagaactgattcggaggttacaccagccctgcctctcccaaagaagtccaggtcgtctaccaaggaa

SEQ ID NO: 701848 - DNA, 375 bp, Homo sapiens
cattgagccccggtgagctacttacatgaaagaagactttactaaaataatcactgcacaaaatgtaaagggtggggttatgcatgtgatattaattttcctcaataatgtttttcttgtactgttctagaactaattacagtttccacggtaaatttgttttcaaaatgccgaattgcgaaactcttgctgggcttcacgtttcttaatacctttaatagtttctctgcgttgcagtcagtaagtttccttgtcatgacacagacgatcacttaaggaagcccaggttatccctgttttcaatgcgatcagtaatcaccttgtgctcatgaatcacattggactgatgcatctaggttccagccttgatgttcg

SEQ ID NO: 701849 - DNA, 223 bp, Homo sapiens
  misc_feature (42)..(42): n is a, c, g, or t
  misc_feature (44)..(44): n is a, c, g, or t
  misc_feature (54)..(56): n is a, c, g, or t
  misc_feature (97)..(97): n is a, c, g, or t
  misc_feature (99)..(99): n is a, c, g, or t
  misc_feature (136)..(136): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (170)..(172): n is a, c, g, or t
  misc_feature (176)..(176): n is a, c, g, or t
  misc_feature (196)..(196): n is a, c, g, or t
cacttgtagaaaccagtacacttttagattagacagtatctncntttaatattnnnatttgttttcctttagtttgaaaagttgtataatacttaantnactgtagcaaagttttatatgtggtagcatacctttncttatcctattacaaaactntncngaatttcctnnnggtnttaaaaaaaaaaactttttncttagaagcatgaattatttttatttt

SEQ ID NO: 701850 - DNA, 160 bp, Homo sapiens
atgtctgtattcggcgagtagcgtatgatggcagtgaggggcgcatatgatctagctattatatctgagtatagtagcggctactgtaaaacggtactctagaatatagtagatgcgaaattaaagcgctgatatgatcggcgcagatctgtcatgatga

SEQ ID NO: 701851 - DNA, 254 bp, Homo sapiens
cacgtaagacagacgcgttgcagtgagcgagactgggccactgcattccagtctggatgagagagcaagactctgtctcacaaaaaaaaaaaaaaaaaaaaaaaaaaaaaatgggcggctgaaaatccccaatttttttttaaaaaaaaagaaaaaaccatcatttaaaggcccgggtgcatggggctcacacctttaattcccgagcctttaggaaaagccggagtgggtgagactcaatggagcgtcaggat

SEQ ID NO: 701852 - DNA, 193 bp, Homo sapiens
  misc_feature (64)..(64): n is a, c, g, or t
  misc_feature (81)..(81): n is a, c, g, or t
  misc_feature (119)..(119): n is a, c, g, or t
  misc_feature (122)..(122): n is a, c, g, or t
gatttgcctatatatttcatataaatggaataataaaacatgattttttgtgactagctttttncacttagcatacctttncaaggttcgtgaaagagtatgggatgcatcagtatttnatnccttatttttgtcagataatattacattgtattgataatatcacattttgtttatccactcatcagtgatg

SEQ ID NO: 701853 - DNA, 548 bp, Homo sapiens
  misc_feature (344)..(344): n is a, c, g, or t
  misc_feature (451)..(451): n is a, c, g, or t
  misc_feature (520)..(520): n is a, c, g, or t
  misc_feature (541)..(541): n is a, c, g, or t
aattcgcggccgcgtcgacaagacgacagaaggggaccccaatacgcaaaattaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcacttcgagacgtaaattaggctgaatcatccgctaccttcacgccatggcgccttcaatattctttatctgcctcttcctaaacatcgggcgaggctatattaangatcatttctctactcagaaacctgaaaacatcgggcattatcctcctgctgcaaatatagcgctttcataaggtaagtcctcccgtgaggccaaatatcatctganggggcaaagtaattacaaattaatatcggcatcccataaattgggaagactagttcaatgtcggggagntatcatagacagtccacctcngtttttt

SEQ ID NO: 701854 - DNA, 138 bp, Homo sapiens
gagcaacactacataactgatttgtagttgacttagcctatagcagttacaatgaattagttaatgttaaaaattaaccacagaattgacctcagggattgtaggggtgggtttgttcaaaatatccagtgaaattgt

SEQ ID NO: 701855 - DNA, 175 bp, Homo sapiens
  misc_feature (5)..(5): n is a, c, g, or t
  misc_feature (38)..(38): n is a, c, g, or t
  misc_feature (76)..(76): n is a, c, g, or t
  misc_feature (165)..(165): n is a, c, g, or t
  misc_feature (170)..(170): n is a, c, g, or t
gtttncatgggaccgtggaagttagtggacatcaagantttcgatgacaacatgaagtcactcggtgtgggttttnctaccaggcaggtggccagcatgaccaagcctaccacaatcatcgaaaagaatggggacattctcaccctaaaaacacacagcaccttnaagancacag

SEQ ID NO: 701856 - DNA, 151 bp, Homo sapiens
ggaaccgcattccccacagatgagggtgggagcagcggaacaggtaatgccagacacaggcttaatatttaaaggcagattttgtgtgctagggagttgattcctaatagttagttctgtcccagcttggccatcactgtgtgcggaaggg

SEQ ID NO: 701857 - DNA, 545 bp, Homo sapiens
acttaggcatcctaaccaggggcgtgcgtgtagttccaggctgtcagatgctcacctggggctgcagtgtgctgttccaggctgtcagaggctcacctgggcatgtgggtgctgttccagtctgtcagatgcccacctgggtttgtggtttctgttccaggctgtcagatgctcacctgtgggtgtgggtgttgctccagaccatcagatgcgcacctggggttgtgggtgctgctccaggctgtcggatgctcgccttagggttgtgggtgctgctccatgcgttcagatgctcgccctgggggtgtgggctgctgctccagcgttgtcagatgctcaccatgggctaatgggtgctgccccatgctgtcagatgctcacctgggggttgtgggcactgctccaggctgtcagatgctcgccttggggctctgggcgctgctccagactctccgatgctcccctgtggttgtgggtgctgctccagatcatcagatgctcacctggggttgtcggtgctgctccaggtgtcgaatgctcgcgtg

SEQ ID NO: 701858 - DNA, 405 bp, Homo sapiens
  misc_feature (12)..(12): n is a, c, g, or t
  misc_feature (30)..(30): n is a, c, g, or t
  misc_feature (69)..(69): n is a, c, g, or t
  misc_feature (137)..(137): n is a, c, g, or t
  misc_feature (214)..(214): n is a, c, g, or t
  misc_feature (329)..(329): n is a, c, g, or t
  misc_feature (361)..(361): n is a, c, g, or t
  misc_feature (394)..(394): n is a, c, g, or t
aagccgggacanttgttaaaaaaaaagggnataaatacagagcctatgaattcccaattcagtggaggnaaaaatggaatttaaaaaatcctaacccataaagtcagttttttaaaaatgccagaaacagccagcgnccgttgtcacgcctgtaatcccagcactttgggaggctgagacgggcagatcacgaggtcaggagatcgagaccatncctggctaacacggtgaaaccccgtctctactaaaaatacaaaaaattagccagacatggtgcgggcgcctgtagtcccagctacttgggaggctgaggcaggagaatggcatgnacccgggaggcagagcttgcagtgagccgagntcacgccactgcactccagcctgggcgacaganggcggtccgtc

SEQ ID NO: 701859 - DNA, 443 bp, Homo sapiens
agaaccaaactttccaacacttattctgtctttcttataaacttagtactgttttcacagcttcactaacttctaaaaattttcttcctggcaagtctttacttatcctcttctacctgtccccacctcctgtttttctgattttacttccttatgccaaacatctaccaccaacaccacatacatatactgtgcctttaccttaatcgcttgggccaggtttataaattaactcattcattttatttcattttattttttgagatggagtcttgctctgtcgtccaggctggagtgcagtggcgcaatctcagctcactgcaacctccgcctcccgagttcaaacgattctcatgcctcagactcccaaatagctgggattgcagaccatctgccactctgcccatctaatttttgtatttttagtagagacggggtttcac

SEQ ID NO: 701860 - DNA, 986 bp, Homo sapiens
  misc_feature (65)..(65): n is a, c, g, or t
  misc_feature (127)..(127): n is a, c, g, or t
  misc_feature (189)..(189): n is a, c, g, or t
  misc_feature (235)..(235): n is a, c, g, or t
  misc_feature (258)..(258): n is a, c, g, or t
  misc_feature (262)..(262): n is a, c, g, or t
  misc_feature (296)..(296): n is a, c, g, or t
  misc_feature (384)..(384): n is a, c, g, or t
  misc_feature (403)..(403): n is a, c, g, or t
  misc_feature (556)..(556): n is a, c, g, or t
  misc_feature (563)..(565): n is a, c, g, or t
  misc_feature (574)..(574): n is a, c, g, or t
  misc_feature (577)..(577): n is a, c, g, or t
  misc_feature (585)..(585): n is a, c, g, or t
  misc_feature (624)..(624): n is a, c, g, or t
  misc_feature (635)..(635): n is a, c, g, or t
  misc_feature (709)..(709): n is a, c, g, or t
  misc_feature (812)..(812): n is a, c, g, or t
  misc_feature (823)..(823): n is a, c, g, or t
  misc_feature (898)..(898): n is a, c, g, or t
  misc_feature (911)..(911): n is a, c, g, or t
  misc_feature (976)..(976): n is a, c, g, or t
cttcccggtgcccccgccgtgggtgtgtgaggggcggccggacagcccccgacgccgccggcccnggaggacgctgccgaggcaccatgcgtgagctcgtgcccctcccggcgggcccgtgcggccncccgatcggcgcccagttttgggaggtcatccgtgatgagcctgggattgccccccctggcngttcccatggcgaccgtgatttgccgctggcgagactccatgtttnctaccatgcagcccctggtaacncatntgttcctcgggccctcctcgtggctctggcgccnggcccgatggattcggttaggtctggccccttcggcccgatcttccgacccgcccctttcgtgtttggcccgagtggggccgggaatnactgggccaagggcccctnccccgggggggccgggctggtcgcctcggtcctggctgtggtgaggcaggcgtcagagagctgtgactgtctcccgggcttcccgctgcccccctctctggggggcggcacggggtccgggatgggcaccctgctcatcagccagatccgggnagagtcnnnaccgcatcntgncacttagntctgccccacccaagtgtagaacggtggtgggcctaaangccacctctcngtccaccagctggtgaaaacacagatgaaacctactgcattgacaacgaggccctgtatgacatctgcttccgnaccctgaagctgaccaccccacctacggggacctcaaccacctggtgtcggccaccatgagcggggtcacacctgcctgcgcttcccgggccagctgaacgcnacctgcgcaantgggcggtgaacatggtgcccttccctcgcctgcacttcttcatgcccggcttcgcgcccctgacaagccggggnagccagcagtacngggcgctcacggtgcccgagctcacccagcagatgttcgactccaagacatgatggcggctgcgnccgcgcacgg

SEQ ID NO: 701861 - DNA, 1589 bp, Homo sapiens
taggctggtctgggtgatgaggctcccgggtggagtctggctattattttttctgggcacctggctgtgtgtgttcccatcactgtcaggaatcccatctaatatgtgtggacgggaccactatgggtgtcgattgggggcaacaaccatggtctatcttcgggttgaccataaattatttttatttatttatattctcggttttctcatctccagcgcatataggggccaggggagaatctccacttattggaggagaggtggcctctctaggcacgcgctctcaatataggttctcaattgtgttctcactccgcgcggtcagtggcaccaagaaagaggctttccaagcgtgtgtaaaggggtgtgaagtgtctcctctctatctccattccatgccggtctatagtgaattgttctctctctttctcgagccaaacctctccgagtggtaacttctctcgaggatacatactccgtgtgtctccatagtggggggcgcctcttttccccacaacacagagtgtctataacacaccgcgggtcttataacactcttatgtggggagacaatatttactcgaggcacacccgcagagagcacacctagttgttctcccccacaaaattctagcaccgggcgcggcggggacacaaaaaataatccacgcgtgggcgaacttccacccccaagaggcgcgttgggtgcgtggtaccaatattccctgctccaccaattgaggagcgctgtactaccctataagcgccgacaaaattttttccaaaaaattacacaataagcgggctgcgaggtcctctgtggggttggggcgcaaccaaaaactagcggcgacggccacatattaacatattaaaagagcggcgatattttccccccctcttttgagaagatttcctccacctgttgggaagagacaccagcattttttccccaaaagagacaagagaactttccacgggtgttatcttacacgggggccgatggcgaaaacatattcccagtgtgtgcgaactctggcgatttctcggggggtgctaaaaaaaaaacacccctctttccaaaagccttccttgtggtttcttgggggcggcgacgcgttcaatcacttttgtgtggatttatcaccccccccaaaggggttttctcctccttatgagaaaggggcggaaaccaggagcggctgcgctccatacacaaagaattatgataccgcccgtgggcggtacaccatcgtcaggcgagataattttgtcatcaacgacgtcaacacattttggggcgagccacccacctgttgtctgccttgcgaacaacattttgtgtagcatctgccttcctcgcagaaagcgtgtctcttgtgggggctctgacaacaaaggccatatcaaagtgtaggccgtcttgggcgacgcatcctattatcgagcgcgcggcacctcttcttttgctcgcgcccaaccaggcacgggagggtttatgaaggcaatatcatggaggccttcgtgcttgttgctcccgaccagcatgccgtccgcgtttgtatgttgttgtgcccccaccactgttc

SEQ ID NO: 701862 - DNA, 110 bp, Homo sapiens
ccagagttgaaaaatgctggtataaatcaggacaaaagaggaggcaagtgagtacgccccactcctctcccatttatacgtgtagctcccattacttaagccggcaaaga

SEQ ID NO: 701863 - DNA, 1098 bp, Homo sapiens
  misc_feature (15)..(15): n is a, c, g, or t
  misc_feature (63)..(63): n is a, c, g, or t
  misc_feature (73)..(73): n is a, c, g, or t
  misc_feature (76)..(76): n is a, c, g, or t
  misc_feature (86)..(86): n is a, c, g, or t
  misc_feature (106)..(106): n is a, c, g, or t
  misc_feature (137)..(137): n is a, c, g, or t
  misc_feature (143)..(143): n is a, c, g, or t
  misc_feature (153)..(153): n is a, c, g, or t
  misc_feature (212)..(212): n is a, c, g, or t
  misc_feature (215)..(215): n is a, c, g, or t
  misc_feature (224)..(224): n is a, c, g, or t
  misc_feature (227)..(227): n is a, c, g, or t
  misc_feature (237)..(237): n is a, c, g, or t
  misc_feature (242)..(242): n is a, c, g, or t
  misc_feature (244)..(244): n is a, c, g, or t
  misc_feature (253)..(253): n is a, c, g, or t
  misc_feature (262)..(262): n is a, c, g, or t
  misc_feature (270)..(270): n is a, c, g, or t
  misc_feature (277)..(277): n is a, c, g, or t
  misc_feature (303)..(303): n is a, c, g, or t
  misc_feature (308)..(308): n is a, c, g, or t
  misc_feature (439)..(439): n is a, c, g, or t
  misc_feature (557)..(557): n is a, c, g, or t
  misc_feature (612)..(612): n is a, c, g, or t
  misc_feature (971)..(971): n is a, c, g, or t
  misc_feature (974)..(974): n is a, c, g, or t
  misc_feature (980)..(980): n is a, c, g, or t
  misc_feature (984)..(984): n is a, c, g, or t
  misc_feature (1023)..(1023): n is a, c, g, or t
gcctgggaaaaatcngaagctagagacagatccttgagtttaacagctaccacgaactgcttnaatcagtctntgngcacagtganatctcatacaaagtccaccnatctcgaaactgatccagactccattggatntcaaanattgcaagtnccttgcaccctcccacatgcccgctggttcgagggaaatgctttcagtccacagttaangtntcctcaaancanttaaggactngggantngttttcctngcttttaancccttaanaccctgnatccttaacctactaggccattaggntttgntgaacaaccccaccaaacagcctttggccctaaacgtggcaaacaggcgcggcttgcagattctggctgcagaactgttcctgccaggttcagtgggtatcactgacccctgtgagagtggcaactttagnggacaaacagtcatgaccctaggacagcaggacatggtctgctatacggctcagactctcgtcccaatcctctcacatggtggctttagggagatccttggccaggagggtgatgccngctttctggcttctgaaatatctacctgggatggagtgatagttacaccttcagnaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagttaactccatagaagtgtcattccactgggttttgatattggcttagctgccagtctcccatttgtgacctatgccatccatctattaatggaggatatacccacatttcttcctaatattctataatctcncantcctgnaaanccctctctcaactaatactttgctgttgaaatgttgtgnaatgttaagtgtctggaaatttttttttctaagaaaaactattaaagtacttcctagtagggcaaaaaaaaaaaa

SEQ ID NO: 701864 - DNA, 308 bp, Homo sapiens
ccatcttggcctctcaaagtgctgggattaggtgtgagtcatagtgtgtggcctctagagcactaactttaaaaagcttcaattacaaatccttcctctgtccctctgagatatatacctatgtatttcctacaacctaggaatgtctttctcaaggacctgaaatccattcctttggaatgtaatcatcataaagggagggctcatgtctcccagtctatgtgggagaatagaatcctaacttccctaattgccagctagcagacacagttggcctaatcacatttacgctaagcactccattccgt

SEQ ID NO: 701865 - DNA, 659 bp, Homo sapiens
gacattaaaaaaaaaaaaaataataaaaaaaaaaaaaaaaaaaaaaaaaaaagaaagagaaaataaaaaaaaaaaaaaatataaaaaaaaaaaaaaaaggaatacagacaagaaaaaaggacacttagaaacagtttgtcctaggtagagcccttgtagatttcagttcctgagggtttacgcctttagtccgtgttgagccctgaaggggatgtagcttatttgggtgggtgaataaacatttttgggcagtggttgtaaaaccggggaggtcgaaaaaggttgggttttccaacttttaatcgctttgaaagagagtacgtttatggcaggtgggggcatttggcaaagggcccggttaaatctggcttcaaaatgctggccggcctaaataggggcaggaaattggacagggccttttttgtgaaaagtcccggctcaaattttgggggaagaaggccctgtttgccacaagggcccaatattgaaaaactctgttttcatcaaaaaaggtcgccctggccacgtttgcgggtttgtcacgactgggataacgattccccttttaatggggaacaattgcccgtaaaggctttaggggtccgggaccggaagggcctatattgaaccctaaggagcgcccctttataaggtttgag

SEQ ID NO: 701866 - DNA, 722 bp, Homo sapiens
gggtccgcgcaggaagctggcctggaggacggagtgtcaggggagatttccgacactgagcttgagcagaccgattcctgtgcagagcccctctcagagggaaggaaaaaggccaagaacattaacacagaatgaccgaaggagctttctccagcaggaagcatctcgaagaacagccctgcacactctttgaagttcctgacactatggtaaccaagacctgagggcagcaaaccgctgggtgctgtcgctgtgagcaagagccggttggcacatttgggaaagccgcactgtatttaacttaatcaaatgtggtactgggaggggttgaaaccaagttgtctcctgggggggaagaacaacaggttcactctgtggctgtggttttcccccttttttaatctaactggcctgttgaacattgacacctcatcacggttggtaggctgtcatgacctgtgtacgtgcttaccagtgactccgtgtggctcttggtgagggcctttcctgttcaggaccccaggtgggctttaagaaccctgcctgtatgggggcgttgtccggtggtgacacttctgcaaaaggagtggcatttccactggctgtgatccatgcattcgggggtagtactgtcttgcctgtgcgtctctcggcctgagatttgcggcagtttgcgccttcggttaatcttccgggggcaatccgtggtgctcctgttccac

SEQ ID NO: 701867 - DNA, 334 bp, Homo sapiens
tctaacaggtcatctgaatcgtcattggtaaagagaatgagagtcattctgcatgcagaggtgtgaaagtggcacagtcttcacagcccccaccacattcctcccacctaaggaggtgccacagagtacagacacatttcccgcaatgggcatctttttctgcacccatgaatggattctcagttcgctgatgaactcgagagttttccccgtaaataacacattcttaaaacatgctacatcaacactgaatgagtttcactggcagctcctactattccatttcagtactcccgcaagtcaaaagaaattagagctgatcctctagagtcga

SEQ ID NO: 701868 - DNA, 636 bp, Homo sapiens
  misc_feature (1)..(1): n is a, c, g, or t
  misc_feature (5)..(5): n is a, c, g, or t
  misc_feature (11)..(11): n is a, c, g, or t
  misc_feature (162)..(162): n is a, c, g, or t
  misc_feature (204)..(204): n is a, c, g, or t
  misc_feature (207)..(207): n is a, c, g, or t
  misc_feature (236)..(237): n is a, c, g, or t
  misc_feature (243)..(244): n is a, c, g, or t
  misc_feature (263)..(263): n is a, c, g, or t
  misc_feature (275)..(275): n is a, c, g, or t
  misc_feature (287)..(287): n is a, c, g, or t
  misc_feature (290)..(290): n is a, c, g, or t
  misc_feature (302)..(302): n is a, c, g, or t
  misc_feature (311)..(311): n is a, c, g, or t
  misc_feature (315)..(315): n is a, c, g, or t
  misc_feature (322)..(322): n is a, c, g, or t
  misc_feature (329)..(329): n is a, c, g, or t
  misc_feature (337)..(337): n is a, c, g, or t
  misc_feature (350)..(350): n is a, c, g, or t
  misc_feature (354)..(354): n is a, c, g, or t
  misc_feature (360)..(360): n is a, c, g, or t
  misc_feature (370)..(370): n is a, c, g, or t
  misc_feature (375)..(375): n is a, c, g, or t
  misc_feature (392)..(392): n is a, c, g, or t
  misc_feature (394)..(394): n is a, c, g, or t
  misc_feature (404)..(404): n is a, c, g, or t
  misc_feature (406)..(406): n is a, c, g, or t
  misc_feature (414)..(414): n is a, c, g, or t
  misc_feature (422)..(422): n is a, c, g, or t
  misc_feature (430)..(430): n is a, c, g, or t
  misc_feature (433)..(433): n is a, c, g, or t
  misc_feature (441)..(442): n is a, c, g, or t
  misc_feature (454)..(454): n is a, c, g, or t
  misc_feature (476)..(476): n is a, c, g, or t
  misc_feature (491)..(491): n is a, c, g, or t
  misc_feature (502)..(502): n is a, c, g, or t
  misc_feature (509)..(509): n is a, c, g, or t
  misc_feature (537)..(537): n is a, c, g, or t
  misc_feature (635)..(635): n is a, c, g, or t
ncgcnccctcnccgacagccacttccgaggcctgggggtcgaggtccccggcgtcggccaggctccgggccgggtagccttcgtctcggagccgggcgccttctcctacgccgactttgtgcggggcttcttgctgcccaacctgccctgcgtgttttccancgccttcaagcagggctggggcagccggcggcgctgggtgangcncgcggggaagcccgaattcgaacaaatgnnaagganntaaggaaaagtggttgtancaattgcaaaangtggggtccaanaanaaaaatcgaaanccaaaaaanaaanaaatctnaaaaaanaaataaantaatggaaaaaanaaanaaaagngggctaatcntctcncaagggctgtctctaantnaaaaaatggnanttgtgcanggaatttncggtggangangttttcannctgcctgtgtanttctcgtccgaatggctgaatnaattctgggatgcantggatgtgganaaataangctttgtctaagcggggcctgcgggcanctggtccccgttccatgctgaaatcttccgctccttcaactggtctatcaatgtctgtgggaagaagaagtggctcctcttccccccagggcaggaana

SEQ ID NO: 701869 - DNA, 484 bp, Homo sapiens
  misc_feature (14)..(14): n is a, c, g, or t
  misc_feature (16)..(16): n is a, c, g, or t
  misc_feature (18)..(18): n is a, c, g, or t
  misc_feature (77)..(77): n is a, c, g, or t
  misc_feature (79)..(79): n is a, c, g, or t
  misc_feature (294)..(295): n is a, c, g, or t
  misc_feature (307)..(307): n is a, c, g, or t
  misc_feature (345)..(345): n is a, c, g, or t
  misc_feature (363)..(363): n is a, c, g, or t
  misc_feature (373)..(373): n is a, c, g, or t
  misc_feature (475)..(475): n is a, c, g, or t
  misc_feature (483)..(483): n is a, c, g, or t
atttcggcacaggntnangcataggtggggcctggatctgcagctgagttgggagcagaaggaacagccagtgcggntntcaccctcttgtggaggcctgggggtccctgtaggttgcccgacccactgtgaccctgagcctcttcccacagaccatcaagtgcctgctgatccaccctaaccccgagtctgcactcaacgaggaggcgggccgctcgctcttggagaactacgaggagtatgcggctcgggccgtctgctcacagagatccacgggggcgccggcgagtcacnnggcacgggcganacgccggtccgggccctggcaagtggacctgaagcttnctccaccgaccctggctncccaggccgngcgaagcggctttgaagggtcccatggccaagaagcatgctggcgagcgcgataagaagctggcggccaagaaaaagacggacaagaagcgggcgctgcggngctggtant

SEQ ID NO: 701870 - DNA, 251 bp, Homo sapiens
aaggcacggggatggtacacggaattctcagtcgtactcagatcctgtactttgcttccaaggtgagaaatgaggaaagctggcggatgttgggtagaggagaaagcagggtggggctgagcatgggcaggtctatacctggatcctccataatggccagatacaacgtgccacgccctgtatgggaggttgagaggacacgttctcagtgccactggtagcaatacgttcagaggagaagtggagcaact

SEQ ID NO: 701871 - DNA, 275 bp, Homo sapiens
ccaaatacgatcgtaaaagttttgttttatccctaagccagagtttaccagctttccttcaagatgataatatcaaggagcgaaaatcatttaagggccaccggtttggtaaacctttctccctaaaacctggaacagtgtaatccttccttatgttaattattagatgcgacacaaatgtgttttcttaggacacagaaactcggcaaaaaagagacaaagggaggagggacttccctttgtttcccgatgtaaatgacctacggctgctcaag

SEQ ID NO: 701872 - DNA, 105 bp, Homo sapiens
  misc_feature (59)..(59): n is a, c, g, or t
  misc_feature (88)..(88): n is a, c, g, or t
  misc_feature (93)..(93): n is a, c, g, or t
atgcagatctctattgccagaacatgaattcaggcaacctggtgtctgtcctcacccangcggagggtgccttcgtggcctcactgantaagnagagtagcactg

SEQ ID NO: 701873 - DNA, 125 bp, Homo sapiens
tggtatcagagcggctcttcaagtatcaggtgattttgtgaggaacgattctcggttctgcaacattgtgtcacagttggagcaatttgtggtgatgctctctctctatgatctctcttaatttc

SEQ ID NO: 701874 - DNA, 129 bp, Homo sapiens
  misc_feature (5)..(6): n is a, c, g, or t
  misc_feature (12)..(13): n is a, c, g, or t
  misc_feature (20)..(20): n is a, c, g, or t
  misc_feature (22)..(23): n is a, c, g, or t
  misc_feature (30)..(30): n is a, c, g, or t
  misc_feature (91)..(92): n is a, c, g, or t
  misc_feature (111)..(111): n is a, c, g, or t
  misc_feature (113)..(113): n is a, c, g, or t
ccccnncattgnntgagacngnnaaatgantctgttctaaaatttgtaatttgctaaccttgatttgagttagtgaaaactggtacagtgnnctgcttgatttacaacatntnacttgtgactgtacaa

SEQ ID NO: 701875 - DNA, 356 bp, Homo sapiens
  misc_feature (194)..(194): n is a, c, g, or t
gtcgacctgtattaaatacttacaatttgcggcatgagtttgagaactagctagtgttagaactaaccagtggaccgggcaaggtggctcaagcctataatcccagccctttgggaggccaaggcaggaggatcacctgaggtcaggagttcgagacaagcctggccaacatggcaaatccccatctctactanaaatacaaaaattagccgggcatggtggcaggtacctgtaatcccagttactcaggaagctaaggcaggagaatcactcgaacctgggaggcagaggttgcagtgagccaagatcgtgccactgcaccccggccagggtgacaagacagactctgtctcaaa

SEQ ID NO: 701876 - DNA, 459 bp, Homo sapiens
  misc_feature (96)..(96): n is a, c, g, or t
gcgtaccttttgtctatcctcatctgctgttaggtgatcacataagatatgatgtaactatactctgtaaaaatgattggtaagcttagatgggtnaacagagtcagtgattcctaattaatgagaattccctgagatgttgacatccgaacttgtccttaaggaatatgcagactggaacttggcagaggcatgcaggtgccaatgtgtgttttactagaatgccaagttcctctgcacaaaccttactgagcctcagcaggtcctgagtttctatcatggaccccatggagtcattcttgctcttgaatgtttttcttctattgttctggcaagttcctctccattctacagttatttggaaactactgctgtaccaagcctcaatgctaacagaatttaatagctgtcattagaaagcaagcttctgcttaccagttgtcctactgtgaatagtaa

SEQ ID NO: 701877 - DNA, 1730 bp, Homo sapiens
  misc_feature (923)..(923): n is a, c, g, or t
gctgtcgactcttgagtgttcatattgaatcacacctcgtcagttcctcctgatgaaattacaaacttttcttgtgtcgtcacaaacactcaagtgtgtttaaccgcaaagcgctgtttttaataaataacaggtccccagtatcatttcatgagagaagcaccgctccctctttttgcacccagcatgtccgcgtcccaagataattcgccctccgtaaattgacgtggatgtgccctacacaagaatacccactggctgtggaaagaaggatcttttcctaccccccccttatgcaaaagatgatgttctctctgccccccgaatgttacaaatcccgcaggtgtttacattggccccccaacaacacccaccccgagatgtgcccccccctgtggctatttctacatgtcttcggccgccccctacggaaaaagagaagggcgcccccacacccctcttgtaatgggggaagaaattctccccaacggtgttggtaaaccgcggaggaggccaccccttgtgtggggcccccatcgagagaaaaatacctctgtgggcgagcattgggggcccccccctcgccggaagaagaaggcctcttttgtgacgaccccagcacccaggggtgaaacaccctgtggtggaagagccccacaaagatgggttctttttgcgccaccacacaggaaattgtacacagagtttggtagttccggagaccggtgtcaattatccgcggggggggggagccccacaacaggggcgccccacaaaggggcctaacaccacaaaaaagggggggttgccaccaccccacagttgccactgttgggcgcccacacgccccccaacaggaaagacttgtgtccccccccccctcatcaaggagcgccaccccccggagagggccgctctggccncagcacaacagcagtggtgcgcccctccgttatatttttggcggcgccacatatgggcaactctccctcggctttcgcctgtgttagcgacccctctctctctcttgtgtgggcgcacacacgcccctctcgtggggcgcacagaaaaaagggctatgccacactgtcacaccccccactctctgagagattgccacaccacacagagaagagtgtttataaaaagatattgtgggtcacacaggggctttacccctcttagtcttacacaggaccccgcgcacacatctttgattctctcaagaaccccatatgcctcgccacctctgagcttatatgagcctcagtgtctcggacacacacagagagcatatcacacgcccctctctctgggtgggcctgttgtgtcccacactaagtgggtgtacagagtggacaccccagaggacactttgttctcaagtcctgtataagagccgtgtgtgttgtggtgtgtgacacacccagagaacccgggggtgcctctcacaccctctctcccaagagtctcctatgtcttgtgtcgccagaacgaaaccggccgggctcttggagaaagaattgcacccttaagattccattgaccacccccctcccagatttggccctaggcccgcttcccagaaccctggaagagagaaagaaaagaccattccatgggcacccacctcgaagaaagacccatattgcccaaggaacaacggagcttaatgcccggaccagattttccccttggtggggtctccaaataaaggtattttcccctga

SEQ ID NO: 701878 - DNA, 1104 bp, Homo sapiens
tgagtgccgagttccagagacatggggtctacggtatgtcccagcactattatgagtcctatatcactgacagacctcccggtaccgccgaccgcgcccgccaaacctgacgaccccagactacacccggagacgccagaccctccccagacaagaacacccgccatttccgaagcagcctgctcggcagcatgtcgacagtgactctaacatgaggctaccgggcgctagaataggacaggcaggacacaggagtcacagtgttactaggcgcgatgggtcactgcgtacagcccgccattgaaccagacatcgcggcactaagcccccaccacgcacgctccctgtgcctcaccccaataccacacgacccacgcacagcgctccacttcagcagccacctccaactaccattatagtacccacacatgggcacgacaaatccgacaaccgcctctccttagtgaacacaaggaacccaccacaaaacacgagagacaaaaagcggcccctctaaccgcggctggcaacagctcacctaggacacaaacgctaaccccagcacacgagagtggcaacaaaacataggatcacccaaccaatggacccatccacagaatcccacgatcacaaccaccaccgcatagtaccccaccaccagcaagccacaccgaccaattcgcgccactcgcccacacacaggaccaaacaggcacaccatggacaaccaaagcaacaacacacatctagaatacacaaatcgcaacaaccaagaccaccaataacaacactacaccatggactcgcgcccccaccacctcaaccccgccagcaacccctggacgaacgacagcatagcaaagtccaacatgactatgctcaaaacacaaaatatcaccctcccagcaactcacttacaactaacacacaataaataaaagcaaaaacacacaaatacaaacaacaactctcatcaacaacagataataccaaaacacaaaaaatcacatatactaaaaacacaacaaacaaatcacacaaccacaataacctataactaaaccaaccaatacatacactaatctcaatcaacccaaatccccc

SEQ ID NO: 701879 - DNA, 380 bp, Homo sapiens
ttctagaggatcccgaggcaggagaatcacttgaacttgggggggcagaggttgcatgtgattcaagattgcaccatcgcaccccagcctgggtggacatagagcgagtcttcatcaaaggaaatggacaggataggaaaagaaaagagacaaagacaagacgaaagaggtcaggcacagtagctcatgcctataatcccagcactttgggaagccaaggagggcaatggtgtgctcttggcttaccgcaacctctgcctcccgagtagctgggactacaggcgcacgccaacatgcccaactaatttttatatttttagtagagacagggtttcaccatgttggccaggatggtcttaacctcttgacctcgtgatctg

SEQ ID NO: 701880 - DNA, 287 bp, Homo sapiens
caggctgtggaccaagctggctaagacagactggcacccaaccacggtgctggatttgcatgtcaggtttcacctaaggtactcaattatacactcattaatatactaaatcccacacccattgggcatggtggctcacgtctgtaatcccagcactttgggcaggctgcaggcgggcaggatccacttgcagggccaggcagttcctaaacccagtcttggcctaaacatggatggtgacccaacatcaggtgggcatccatctcagcagtctgcacctgctaggc

SEQ ID NO: 701881 - DNA, 149 bp, Homo sapiens
gagttagggtgtgtacttaccacacacctacagcagagaatagcagttgagcaagatacagatcaatgctctgagagatgactgaagcagctccaaagaaagctgtaaaaagtgacaagaatttgtcttccactttgagactgttcgat

SEQ ID NO: 701882 - DNA, 248 bp, Homo sapiens
ttatatccggggggctgtatccggggagagaaagatgcgtgaggctgctgaggaggcagcgtgtgagcagtgagcagcttcaagccaggtcgaactaaattgttaagaggtatacaaaattacattaagcagtaagagagaaaaaggtctgtttcccagaggtattagagacccaaatcagcccagaactctcagggggacatgtatttaccagagatgagattggatagcatgttcttcccagctgg

SEQ ID NO: 701883 - DNA, 1075 bp, Homo sapiens
cccacgcgttcgcatccggtgctaggactccagtactcttgacgcaggtggctaggctggcaggcaggcgaggttgggagcttgccgagagtcctcgcttattgtcaccgacggtacagctagcggtgcatggaagcctatccgagagcgcgatggcaagtatggatggcacctagaggattcctggggtccacagatcctcatgtgacgtatggcctgtgcaccgatggccagggacacagcgtaggccaatcttcggtcctcgcagtgagtcgttctcggggggtcactcggtcgtggaccacgtcattgatcctgctagacagcccggggtggtgcacagcgagtcacgggcgtggggctaattgcgggaaggaaccgttacaggagagacctggcatacgacgcgaacgggtggcgcatggcaccaaggtggaaccacacacacatgacccatgcatccccgactccagggtccgccaacgggcctggggcagacaggacggtccacgagtcgccaaccaggtgacacgttggccaagcggtgcctcgggcttacggctggccgcaacgcgggacacctccctaatgtgaaacccgaagtccgccagagaaactctcaaggaaggacatcccgtgcatcggaggacacggagaggacaacacacgtggtgtaacaagggcgttgctcccttgcacgaagcgggacacgttaggatgactacctggacaacaaggccacttgtgtgtctagaaaggggaaccgcggttacacagtcccacgcgatccgtgggccagggtcacctaactacaagatcgggggtacttcctgaacccttgtactcggcggatgcatccgcatcaaggtgagcactatcactcccaggtccctctgatgccgacacgacggcaaaattggaacccccgtggaaagactgacggcctgtctatggtaacacccaaataggtgcgataccaagatgagaagacaggccacattgtcacacccagagtcgcaatgggcacccccctgtaagccaagatttcttaagacatggccatattttcgcagcg

SEQ ID NO: 701884 - DNA, 113 bp, Homo sapiens
ctctgcatatgttggcacagcatgccacccagcaaggcaatatgacgcacgcatgcatctccatagggaggtgctttcgtctgtgtactgcaaatgtgtgttgcaaatccagt

SEQ ID NO: 701885 - DNA, 168 bp, Homo sapiens
aggtgtgctattagatttcgtcctcatctgggtgtcaggaaaggggagggagtgttctaaatcggggagataactttgtggcccattaaggggagaaagaggtcccaagggaaggtctagaaaggaaagacagaccgggtgctgtggctcacacctgtaatcccagca

SEQ ID NO: 701886 - DNA, 353 bp, Homo sapiens
ctatgctacctgtcaacagagctgaagggtttggatcagctctgagtcaacgtccctgtcattggtggccatgcacgggaagaacctcatccgccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctg

SEQ ID NO: 701887 - DNA, 601 bp, Homo sapiens
aaaagtctcataaaatcatcatatccatctttgagtgagattgtttaatcacaatctcagcttcacatccccgtcagtttgggtcctccaagagccgatgccaagactgacttatacatgaaagagatttattggtggaaatgcctggcaaggataaaggatcttgggaacaggaggaggcagagcatcttcagaccccattgcaagtctgagtaagtctggaccaggttgatgagaattcctgagcaaagggtgccaggttgagcagtaatggttcaagaaaagttgaaccctgccactctcagccattggctgggtatactccgtagaaatgcagtgttagtgtgacagctatgatggatctggaggagcagtagctgaaggccgtcatcaactatgcttcccacagcaggttcttttgaagtagatctgggtggtacactccatggccaccacaatcttatatcctaaagatcagtaataaatgtaaccaatgtgaacacttggggaaagaggaaaacagaattggatatatcaatacataaacatcatgaaatcaggcgctgcaatgtctcagtctgcactgatctgagcacagtgc

SEQ ID NO: 701888 - DNA, 98 bp, Homo sapiens
tttcgagcggccgcccggcaggtactgtcatctattacaaccagaattctcctcacatttcatttttcttaaaaggaaattgagaatacctgcaacat

SEQ ID NO: 701889 - DNA, 586 bp, Homo sapiens
gcgtaacgcagagaggaagcacgaatcttcgagctattatgagtactcctgaacaatgaatatcgagaagtgaatgaatatgaggagcaccggtatgagaaggcatttgaagcaaggaaaagaatatgatcaacacagaaaagctagaattgaaaccaccggagaagaaaaagagtgatgagagacgaacttgaagctccattagaatcttcatgagaatcacctgataagaatattgatagaaaagagtggagagacttcacatcagtaagatggatactcgattaagagatctgaatccttggagaaaaacaaagggcgggagggtggcacaaacaaagacaatttggaatggttgaaaggaaccccgttgagaagaactgatgtttgatcttgcggttgttgaaatgatcggatccacttgaagaacaacacgccggtgaaagaaattgaaatgacaaactcgatgatcgagaaggattagtattcacataggaatatgagaccacacttgggaaaggtatggaatcaacatttgactttgaagcaactcgaataacacatactctctgcgtctggggtaccg

SEQ ID NO: 701890 - DNA, 1284 bp, Homo sapiens
ttcaggttgactctgtgcctggggctgtacgtcttaatgtatcttctggcagttcgagctagccatatctgtccacgctgcctgtcgcctgcctgccaccatgcccaagagaaagtgctgaagtgtggatgctaatgtgtgagataaatgcaaagtgtgaaggacgaaccacagagaagatcctgctgaggttgtcttgctaaaccatgcgtcctccaaatgccatgatgcccaatgcctaaaaatggcccctgcaaaaggaagtggacgatgaatgtgtacccaaaatgtgtgaaacatgtgtgaaagagcttgatgcattggcataggatgtgggaataacccgtgcagaaaattggagattgccaaagacagaccagtgcacagaaatgctgaagtgttgctggatgatgccaatgtgaagtgtgttgcattttttgataacttgtgtactatctgtgtgactgtacagtatttgaaatactatatacatatcaagatataataaaaatgcagaatattatgttatatacttataaaataaaagataaaaaggactatgtgagaaagacacaaaagaaacactacatagagtagaaaatggggagaaagggcacataatgcccacaaaatcaaaagtgatatcacaaaacctgaaatacgatgtagaaaaaaaaaacgatataacccatatagaaggaaaagagaaggaaaaataacaaacagttggcaccccaagagaagagaggagaatccccaatgaacatataggaacacacacatgtgtgcacaacatttgtgagacaagaaaaaaccatatagagacgaaatagaaaaaaaagcaaatcgtgttggtgagaaaaaaataagatacagcagtcctgaagttcccactataaccacgactcatattaccagagtaatgagaggtgatatggatccccacatttaagggcacacgaagaacaatacggtgtgagagaaaccacagtggaacccccataggtaacatgtgtgtacaaccaacagtatattacataagagaaaaaaatctgagtattattaccaagagaggaaataacccactagtagagaagtgggaacagtgtgtacgaaaagaaagaagagtgagtgtcaagaaaataagaagatatgtgtgtgactttgcgagaaaaaagatagggagaataataataataaatataaagtagaaaaataaggaaagatggatagtaaaaaaatttgtataggaaaatagtataagttgtataatgttagagacta

SEQ ID NO: 701891 - DNA, 1097 bp, Homo sapiens
gcaggagccgcagtgtccatggtacaatacttggtgttacgaaaggatctatacacaagctccgttctcctggccggcgggcgcactggtatctgcaggcatatgtcacagctggacaccgaggaccttgcacactcaccgcgaccacccgcacacagaccgcttacctcacaagagcatgggagcgcatgcgcaaagtggtcctcagaggcccacagcatgagaccaccctacaggcagctggccgcagacccatgcgaacagacagcaaccattgaccacatgcctgtgggcctatgcagcaaccaaggacgcctagtcgccacttgctattgcctcttccggtgccctaccccccaagtgacagacccgtggggccagtactttgacatgacagattccagacattggtatcaaaagttaaaccgtagccttggcctctcagatagtacgttctcgacaattaccgaccaaggcgcaacccccaatatacacaaaacggcaatccactggttagttacacccctaatgcccaaggttggattccaggacttctggccattaccccggttccttatctacacgctccggcttgacaccacagtgttacattatgaacgagagctataaactgcccccaacttggtttctcccacctccgcttcacaacaacgcgtgtggtatacccaacttattatccagtttacagccgtacacagtgaaaaacgagctcaacacagccagcggccaagcacgagcgcactagaaccaccggcacagcccacctagagcccgcgtgataccattacccgccccctctaccgacaaaggagtggcgtgtcgtccccgcaccaacagccacatattatacccagatgcggataacacccaccagagtcccagtttaacagtccatttgtgccctacacaaaacgcatacggttgggagcacacccccacaataattaccacattgcacaggatcttcgtaatcaaattatacaactaaagcgccaccaacagggtcacaaccattggtaaacccaggcacacacggtaaaccgcacctaacagacggacacctagagcgaacaatg

SEQ ID NO: 701892 - DNA, 175 bp, Homo sapiens
actcgtttcatcggcacgcgaaacatatcatacacaaacgcctgagccctatctattactctcatcgctacctccctgacaagcgcctattttacaccaaccccggtgccgatgaatagcgaagtgccgatgaatagcgaggtgccgcgaatagcgaggtgccgatgaatagcga

SEQ ID NO: 701893 - DNA, 330 bp, Homo sapiens
gttcgaagcattcagcaaacaatggcaaggcagagcccccaaaacgtgacacctgatttttcatgacaaatacggtaatgctgtattagctagtggagcccctttttgtattgttacatggacatatgtagcaacacaagtcggaatagaatggaacctgtcccctgttggcagagtttccccaaaggaatggaggaatcagtaatcatcccagctggtgtaataatgaattgtttaaaaaacagctcataattgatgcccaattaaagccctgtggaccccttaaaatatggccttatttaaaaaataaaggaccttttgaaccttcca

SEQ ID NO: 701894 - DNA, 317 bp, Homo sapiens
gatcgagctcgcaccgtaagtatgaaaagaagcagtgatgatgacaggtgatagatccaaaatagtggcacactttgttaacagttttaccactatctaaaccaatccttaaagaacatcatatatggggtcacacacatcctcacggcgagtccaattaaagcaagccagtgtccaatctgcgatgcatgctctgcaccacataaagcaactggatagattacaggaagattcacgccaaggcatgtgacttggatatgtgctacgtgacagccccgcgtgatcagtaacagagcgtatttacctcattgtcctgg

SEQ ID NO: 701895 - DNA, 121 bp, Homo sapiens
gatgcgtaggctcttacatgttttcactttttaacaattctctgtcaatgaagggttggtgactctgtgggttccctggcttatctgcaaagccctcaaacctgagtactgcgtggtcacg

SEQ ID NO: 701896 - DNA, 1212 bp, Homo sapiens
taaaaggtaaagtgtttgtgattctggtcacaacaaataattggcttttcctcaggggtccccgttcgccggcccgaagcgccgccgcgccacccaggaaccgggccgcggggcctctcgcggcgcggctatagcaaacccttctccgagggcccctcgctgtgcgacaagcgggggaagagccttctctccccccttcgcgccccgcgcgcggggaaagaggtacagagtttgagagaagagaggggggaaagacaggggaacactgtggacactagtgaacagagagggaggaaatccacgcgtgggagccggagaagaacaccggatacccgcgggagagcggtgggtccgaagaacacctgtgccttctggagaaacaatgtgtgcgcacaatttcaaagagtggagtggaaaaaaagagtgtgagaggagaagcatataaacacagggttgtggaaattgtgtggggcaaatcttgtgagagagtgtacctcttacagtgtttataaaatagaagagtgtgatgagcggtctgtggaatcctcacagtgttatcaaaaaatatctcctcgcctcaaaaaagctgtgcgctaataaagatgtgtgagacacacaggctgtgtggacactctcacaagtgtgtacacacatatagaaaattccatgtggggggaggggccttggtgggcacagtgtggtcttcacgctgtagaaacacaaacttcttccgagaaacttctctcacaaacaccgatttctataacacagctcttaaccaacgggtgcgaaacacatttacacacgtgtggcacacagaaaatatctcgaagaccccctccgttgtgggcaacactctcttttgtggcaaccacagacgcttaatcaaaaatggtgtgtctgtgaaaaaaaacggcccggtgggcacccctctctataaaaaccgggtggggagagaggggcgacacccccaacacccctgggagacagctgaccacataccccgaagacagacagggtggctcaccttacagaagcccacccaggtgcgccccccgaaggaataaacacaataaccgtaggtgacaacggggcgactaaagacgacaccccggacgcaagggcaccccaaggaggacaacgacacgcgtagggcaacgctacacaagaactggcccaggactggtaggacaacttgcggtagtgtaggca

SEQ ID NO: 701897 - DNA, 280 bp, Homo sapiens
attatatctttgtataggtattctattcaattatatttgtatgcatttttttaaatttttattttaagttctgggtttcatgtgcaggacgtgcaggtttgttacatcagtaaacgtatgccatggtggtctgctgcacccatcaactcatcacctaggtattaaaccccgcatcccttggttatttatcctgatgctctctctccctctgccctgccaagaggccccaatgcgtgttgttcccctccctgtgtccatgtgttctcattcttcagttccc

SEQ ID NO: 701898 - DNA, 109 bp, Homo sapiens
gggcctgctatggtggtgctgcggttcatcatggagagtggggccaaagctgcgaggtgtcgtgtcttggaactccgaggacagaggctgaaatgccatgtaggttatt

SEQ ID NO: 701899 - DNA, 281 bp, Homo sapiens
cgtctcttacagtatcccccggccgcccagcttcgtcagtgctaaaacgggaaatgtggctagccttgcggtctggggtgccctgattctcagaatccctgcgtggatgtggaaagacgtgtttggagtttagaccggctcacaggatttgggtggattgcaggaaaaggagcggctgggatgcactctctcatcctgcccccatggcgaccctcctttctggctttttttgagacggagtcttgctctgtcgccgtggctggtagacgctgtggcggccg

SEQ ID NO: 701900 - DNA, 377 bp, Homo sapiens
gtgcagacactagtctttgtatatactctgtattcttgatctcacatatctgaggaaggtatatactcaaccctttaatatggtaaactagtacagaacagtctgcacttagctattgtgtgtatgagctagtccaagcctagtgcttgaaaagtgccatgagtctgataattggacccaagagagctgaatctccaggtgacatcagcgggatagttcggactgacgtgtgtgctctgatatccccagaagctagctggttcatagtgggtgagatacagcgtggctggccatttgtactgcagaagggcaaggtactcaagcctggagagggtcatgtaggaactgcaatctcttctactatgtcacagaaatgt

SEQ ID NO: 701901 - DNA, 304 bp, Homo sapiens
acgtctacccagatcacggccgggttgaccctcacatagaattgataccgggagcacacagtatcccaggggacttgtgtattcacggtccgaacctgaaagggcagctcttcgagatttgggggcaagaatggtaaaagaggggctaattactccaaggatggcacctaagggagcccaagttctccaggtgaagagggggtggaaacggcaagtttcttatgatggccgagctccaaacaattttactatccagaatcagtatcctcgcctatctattccaaatttagaagaccattcaaca

SEQ ID NO: 701902 - DNA, 854 bp, Homo sapiens
gggcgtgtggagaagttcgatctggtgcccgctgcccaccaacctttatggagacttcttcacggcggcgacgcctacgtcatcctgaatgacagtgcagctgtactgaacggaactctgcagatatgacctccactactggactgggcaatgagtgcacgccagagatgagagcggggcggcgcgtccaatcattatacgcagtgtcaggctggtatgacgtaccatgaactggtcgggctcgtgcagcaccggtgtaggtccgagggccttcgagtcaggcctaccattccctaggcttacttcaagatctggccctgaagatacaagaaaggaggtgtgtgcatcaaggattcaacgcacgtggataccctagacgaggtgggtggtgcagagactcgttccaggtcataagggcggcggtgttggtccggtgccacccgtacggtaccgtgttggtcctgaggaagaagccttctaagcaagtggctgacttgcttctcattcctggactctgggcgaacaacgatcccaccaggttggatgtaggattccgaacagcgaaatcggtatgagaacgactggaaaggccaccacaggtgtccacaagggcagtccgggacagtcggagcggtagtggctcggggccctgattgcacgtgtctgaggagggctctgagtcccgaggtcgaatgctcctggtgctggtgccccaagccggctctgctgcaggttccgtggacaccgcaaggaggatgcggcaaccggagctggcaagctctacaaggtctccatggttgccggcaccatgtccgtctccctcgtggtgatgagaaaccttccccggggcccga

SEQ ID NO: 701903 - DNA, 400 bp, Homo sapiens
attatggccggggccggaccccagggccggagcccttgcttaggccgccttcccaattgttcccaccttgaagttgtttgaagaaccggggctactcctaaccattggcagccttgaaggagtttgggttcgaaaacaggcaagggagccttgggtgtgggagaaggtcaggagcccaaagtttaaggccagggccaagtctaactttgaaaggtcaagggaccagttgccacccttgatcaggaaggctgaaccggaacgggtaaacttctggagctattccgggaaactgggaccacagcctgccacccagggaagggtccaaaccatggccttccaacccaagttggcctttaaaccaccaactggccagtcctagagctccggtccttaccaattt

SEQ ID NO: 701904 - DNA, 791 bp, Homo sapiens
tgttatccttcaagcatcgctgcagcgcctctgtcctggccaatgtagaggctgggcagccacggcgtgcagcctcccccaatcgccgagcacgcacctttgactgattgtcctctagggcaggggctgtcctgccttaggttgggacgctggtctctagcacacttgtaggatggcgtgtaaagcgtaatccctgtggcgcatccactccgagtcccataggcccagcaggctgcgccagtctcagactacacacgccagataatggtctcccagacgtcgtgccgcagccgtcacccaggtacgcgcactcgcttcggacgacaagtgacactcagaagtcatctagtgtctccgtacgatacgccttgatagtagacgccccaaggtgcacgtggtgtagggtaggccgggctaagagaccctatgcctgtagtccgggacaccttggcgccgcgtctcaccactcactgatggatccttcgcgcactaacacgtgttctctagtgcggctagacgcctagggcatcccttgggcccatgcccagcgatggccatggcgcaggctctcgaaccgcggcatggctttcgccaggccatggtgattctgctctccagggatcggttggcaccttcctcgggggcgggccccacgcaccccagaacacacagacccacctttactggcgttcgtttctacctcccttgtcgttgcatgaggagcatggtggtttcatgagctaatgaacatcttgcaaggtgacacatagagcaaagaacctaaaatggtt

SEQ ID NO: 701905 - DNA, 894 bp, Homo sapiens
gagcgggaacaaaactgcgctcttagaccatggcgacccaggcgaagcgtcacgggtggcggggccctgtggacggctgcgagacctggatcctgtggcctgcttcctgagctggatgccggcgggtggggctggagctgagtcccaatggatgagctgagcgagccggatttgcgagagcgacccgcggtcgcgggacctgcggtgctgcccatgaccagcagctcctgctcagcgtggcggtccagaccggcacaggtcaccggtggccaggactactagcactgagtaggccctggggaagaagccgattgaaagagccagggaggaagatttggacatgcagcggatgtgatgcccagaaagtggagcacctgaggcaatcccattggtcagaaagacatacccccccttgaataccccaatcagggctgggccattgcttgggtacgtcacaacggagcccgcaagattagcgcgcgccattgaaaaagcaagcagcatcgatccagaggagcactgtggtagctgcaccaaaacagtggcatgttgccggtagtgacgcgccatagcaaccaaaaaggataaaaaccatttgaggacgcataaactcaacgaagacagaatcacaggacagccgagaacaaggacccctatatcagtacataggtcaggcttccatgggggacgccgaaagcagtagcagagaaacagagaaactagggaaacgagaaacgccacggaactcggctatacataggcgcgaccagaggcagaaggcagcggaagcaacgaccaggggaacaccagtacgactctccccacacgggggaacaaacaagagcgagtaccagctttagaaccggatccagcgtaagcgacgacaaaagcgac

SEQ ID NO: 701906 - DNA, 315 bp, Homo sapiens
  misc_feature (182)..(182): n is a, c, g, or t
  misc_feature (191)..(191): n is a, c, g, or t
  misc_feature (231)..(231): n is a, c, g, or t
  misc_feature (239)..(240): n is a, c, g, or t
  misc_feature (242)..(242): n is a, c, g, or t
agggaaggtgaaatgcatccggaggcaccactatgatatgagctggagttaacggaatttgattctggcatgttgatcccgttattagtttgcttacgtagggttctagttctgaaaatgaatagttagatgccaaagcagtgtaaagatggaagtcatgcagtcgggcccatgtgaggtgnccgggccgnagcccccgtttgcagtgccccccagcctgccgggcccagnagagaganngnagcatctttgctactagctgttgctgctacctgcctttgcccgccgacgccccccgccttttgagattaagga

SEQ ID NO: 701907 - DNA, 253 bp, Homo sapiens
  misc_feature (11)..(11): n is a, c, g, or t
  misc_feature (17)..(18): n is a, c, g, or t
  misc_feature (49)..(49): n is a, c, g, or t
  misc_feature (53)..(53): n is a, c, g, or t
  misc_feature (59)..(59): n is a, c, g, or t
  misc_feature (90)..(90): n is a, c, g, or t
  misc_feature (120)..(120): n is a, c, g, or t
  misc_feature (129)..(129): n is a, c, g, or t
  misc_feature (169)..(169): n is a, c, g, or t
  misc_feature (177)..(178): n is a, c, g, or t
  misc_feature (180)..(180): n is a, c, g, or t
ttcccttctcntggtgnngttgcgtggccgcgtgtgtgcgtgtgtgccncccngcgggngttggttcccggctggggtgggggggcttcnggcgggggcgcccgggggccggggaggtgnccgggccgnagcccccgtttgcagtgccccccagcctgccgggcccagnagagaganngnagcatctttgctactagctgttgctgctacctgcctttgcccgccgacgccccccgccttttgagattaagga

SEQ ID NO: 701908 - DNA, 425 bp, Homo sapiens
caggcagcgtgtgggtcccgcactctgcccccatttcccagatgtcccctgcgggagcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccaccagtggggccaccccctaccccattgccaaatccacagacacaattttcggagtccgttgcctcttgtgataccatgtagttttgttttgtaaagtgggtgtgcttggggttccgaggtgggcaatggagttgtctgctccgtttttttttaagacaccgaatgggaatgtaaaaagttctctgcatacctcttttaaaccgcccaaaatctc

SEQ ID NO: 701909 - DNA, 588 bp, Homo sapiens
aaggtttatcgaactgcacgttgatttattgtcatcaccataaggactgccatggatgtaggaacagggtgtcttttgctcttaaaatgatttgaggctgggctagaccattgtccccttggaaaggggtgatatgtctttgtgcagatacagtcctataacaaagggaatgtctttcgaaaccgtctgtggaacggatacggcctgggcgtctacacccagggggcgaggctgtccttctcctattgcgagtatggtgaatgcaatcatatgcatggcgttggagtgcatggggtacccctgctttgtgcacgtggcccgagaaatgccattgtcataaccattaggagtggacgcttatgcgtaagtgccatcttggtaatcaactgcatcgagtatggcagagtgacactcgttcatgcagcaaccagatccattgtgctcagcacagatgcctatatacttactagtgtcattgatccacgtactgaactgcatgccattatgggatgcgaataacttgtcactaggatcatcgccaaaatcaaatccagtgaaggcaccgtgcagcattaacgacgagagata

SEQ ID NO: 701910 - DNA, 358 bp, Homo sapiens
tgtgagacagggtctggctctgttgcccaggcgagagtgcagtggtgtgatctcaggtcactgcaacctgcaacctcctcctctcaggctcaagtgattctcccatctcagccttccgagtagtcgggaccacagtcatgtgccaccacgcttgggtaattttcgttatttcttttttttttggtagagacagagttttgccatgttgcccaggctggtctggaactccttggactcaaaagatttgcctgcctcaggtcccaaagtgctgggattacaggcatgagccacccacgcctggctattagaatttcttttcagtcattcttttaccgatttaactcttgtgttgttgttg

SEQ ID NO: 701911 - DNA, 222 bp, Homo sapiens
cgttcagaggttcaccacattccctttctatgtatatacactctggaaggcggttggaggttcaccacattccctttctatgtgtgtacactctggaaggcgctcggaggatcaccacattccctttctatgtgtatacactctggaaggcgctcggaggatcactacattccctttctatgtgtatacactctggaaggcgctcggaggatcaccacattc

SEQ ID NO: 701912 - DNA, 462 bp, Homo sapiens
tgcatagtacttgttgaagctgatggcatgaagaatcgcttgaatgcaggagagcaaggggtagccatgtggcgagatcatgcatactgcattccagcctgggttactcaacgagagtacgtctcaaataaggattatgcaatggtactcattaacacatggtgcaggatggctatattcccactgactgtgatggggccttccagtgggggagaatgattgggctcaaatctgaatatggcttgggcaagcgggactttataaccaaggagcagggtgggggtcagtggatggaaaattactaagaggaaacactgagcatacagcagtttctagctaaaccgacctaacaggattcttgctgaagacaggccagggtgatcagatagtacctggggtatgggggaagatacagagcccgatcagacatcaagggtgatcagctctcaagggcagagggtt

SEQ ID NO: 701913 - DNA, 438 bp, Homo sapiens
  misc_feature (15)..(16): n is a, c, g, or t
  misc_feature (34)..(34): n is a, c, g, or t
  misc_feature (312)..(312): n is a, c, g, or t
  misc_feature (378)..(378): n is a, c, g, or t
  misc_feature (426)..(426): n is a, c, g, or t
aggtcccttcccttnntatgggagctgttttcangctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttncatggttctcttctgtgacccacggcttctaataggaactattaacattaccacatgggcccaagnattccattccttgggaattccgtgaggcccaaggaattccaggttcanggattaggaggg

SEQ ID NO: 701914 - DNA, 732 bp, Homo sapiens
gcgtccagtgccaggctcccctctgtacgccttcaaggtggtatctccggccgtcgactcgttgtggctttgaggctggatctccggactcgacaccccgggtacaagcctgttctgctgtctgtcttcccaccagcgggcagattgtgcctggtgatgcccctgggacgcagagccgttgtcatccgcgcccttggaccgcagccagctcctcacctggcccgggagattcatgatcctgaacccgccgtatggaagggcctcagtgaaggatgtgggcatcaccaattcttcgatgatcctatgttgctggagacttgcccaaccggatgttgtgctcgattaccccctgtgaggtgcgtggactcctgggagctcctgctccctacacgtgggctgcactcctgtacttgaagctgagacctcatatgacgtgggccttcgtgttgtcagagagtgtctggaagctgctgttgccatcttgagaccactctacccacctcccaccccgtagcccccgtgagagaggagccatttggcctcctgcttccttctgtggcctctgccgggctcccttccccaggaaaagagaggagcttgggctcacagaaagagaaggcggatgaacccccacggggccctatctttgggatttacctggaattttattttctaccagcttgaccttaccctggtttgcccagtgacagaccttctgaaaaaaaaaaagaa

SEQ ID NO: 701915 - DNA, 710 bp, Homo sapiens
tccacaccactggatgctggacccctggtctgatgggaaggactgccccaggttgtttgggccgagggcctgagggcccggctccgcgtcctgttccagtccggcccctggaggctggcctgacgcccgacatcctcatcccccctgaggggatccccaggctcggccccaacacggtgaacccaggtggacagggacaccatcctagtcagctttgaacgctgtgtgaggattgtcaacaagcagggcgagcccacggccacactggcacctgagctgacctttgatttccccctcgagactgtggtgtgcctgcacggaccgtgtgctggccttctggagccctgggatgccaggccgaagcctggatacccatgaggtgaccccggagatcacagatgaaaccaggatcttccgagtgcttggggcccaccagagacatcatcctggagagcattccccctgacaacccacgaggcgcacagcaacctctacatcctcacgggccacccgagcacctactaagagcccgcgggcctgtcacggggctccccgccccaccccacgccttagctgcaggcccttttgggccaaggggcccactcctgggccactcccttcccttttgttccaccattcccttctactctttctgcccagagcctgcccctgcacatttgtcctgggaaaaccccggtatttaagagaga

SEQ ID NO: 701916 - DNA, 139 bp, Homo sapiens
cgaatgcagtaggagagactcctcatgaggcttagccctatgtcttactagccagccttagccacaggcaggtgagaaaggcagggccactacctacagcaaagtaggcctcttcatacacttcctcaccagtgtagta

SEQ ID NO: 701917 - DNA, 381 bp, Homo sapiens
cttgcatgctgggtgattagaggatcccaaccgacctccttgccatgtctgtaacatagtttgtgactacactgacctggttgtaaatatcttcctctgtgtactttcgccttcagctcatgctctggtgattcgctcacaatagaagcagctggtttccgtctggaattaccaatttgaaatgccaccagtcgcgcatacctagtagtgtgttctccacccctgggtcacagaacttcgttctccccggctctgtaacccaaggaccctacagcctctgaggcctaacacccaagctcttccttgcagaagagctgagatgctaaggagaccatctggagtgtcataataagcccttgggatttgctgagctcccacatg

SEQ ID NO: 701918 - DNA, 232 bp, Homo sapiens
caggacccccttatttcctttcttattgggggaaatcttatttaatgcagaactgatacttagggtaaatctatatcactaactgcctatctttataaaagaagaagaatctcaaatcattgacctctggcttcccctcttagatactaggataagaaggtggaatttaactctaagcagaaggaagaatattataaaggttgagcagaattcaataaagaaggaggataag

SEQ ID NO: 701919 - DNA, 340 bp, Homo sapiens
acactatacacccccctgctctgaggaagtctggaacacttaggagacgtaagatatacacttgttgtatccacgttggtggactcgggggataagcagaaagaaatagcgtctgagatcataggaatactgatgctggaggctcaccattttcccggacccttattggttgaattaggccatgagtttattagtgctggcagagaaggcagactagtgaatggaaaatctatggaggtactacctatcatttctcactgacctggctacgaaaaaggagaatctgttttattgggaaaaggtgtactgagtgggggagaattgtagaaaacagttgatt

SEQ ID NO: 701920 - DNA, 101 bp, Homo sapiens
ataggatcccctcatcgaaaccctaatgaaggactagtagatggatgggatgacccaagattgcctacggttcgtggtgtactgagaagagggtttgatga

SEQ ID NO: 701921 - DNA, 187 bp, Homo sapiens
tctcctctgccaatggctggcaaactacctgtagctggtctgtcctcaagtgacctatggcatagtgcaacatgtatgataatcttgcagtttcgaagcgacatttagtccacagcagtaaggccgtcgacactcccgcaaccaacctcaataaaaggcctgaatatactgcaaaggttgggctgat

SEQ ID NO: 701922 - DNA, 287 bp, Homo sapiens
cgccctggaatatatctggtgattgactatatatactgaagggcagattgcaactgttagtggagcccatgaaatgtttgtgacccctgatatacatcaggcactgagtctggtccataaattctctgtgggccaacgatgaggggatgctgagattactggctatttagttttcaatctcctgacatttctattcttaaatggcctactacttgcttggctaaatcatctttcagttaaagaacttctgcatcttcgtgcccagtagagcctggaattcaggggat

SEQ ID NO: 701923 - DNA, 220 bp, Homo sapiens
gggcgaacgcaccgtcgagcgggggagcggcgctgccctgttggagatccgcggaggccgacaggattcgttggctgccgtccccctgctgtacattgggttaaaaacgacaaccaacatcagccatgaaaggatccaaggtcgcagcagtactagcccaagcatcatcaatgaaggtgttattattaacggtcattctcatgaggtggacaatccattt

SEQ ID NO: 701924 - DNA, 472 bp, Homo sapiens
ttgagtcgcctgggacgggagctgagccaaagtgatcatcgtggacaatttctcctgcctcctacatcttccatcctgagaatgcagtgcccgtgcaagtcctggtttgacgacatgacagacacggagctgttggacctcatcccgttcttcgagggcctgagcagggaagacgatgtctacagcatgctgcacagactctgtagcaggtagccctgccttggcccatctgtgcctgtgcactctggaaccctggctcaggggacccgcccggcctcggctcactgagtgcagcccaggaagactccgtgctccgggccacagggtgaatgtcaccatgcctacctggtttgttttgttttgtttttttaaagaacagaaacaactattttaaaggaaaaaaaaaaactcttttaatagatttcataaacggactgcattttacaagattcgattttcttaaaaacatacc

SEQ ID NO: 701925 - DNA, 528 bp, Homo sapiens
  misc_feature (1)..(1): n is a, c, g, or t
  misc_feature (59)..(59): n is a, c, g, or t
  misc_feature (102)..(102): n is a, c, g, or t
  misc_feature (113)..(113): n is a, c, g, or t
  misc_feature (132)..(132): n is a, c, g, or t
  misc_feature (140)..(140): n is a, c, g, or t
  misc_feature (172)..(172): n is a, c, g, or t
  misc_feature (203)..(203): n is a, c, g, or t
  misc_feature (206)..(206): n is a, c, g, or t
  misc_feature (220)..(220): n is a, c, g, or t
  misc_feature (229)..(230): n is a, c, g, or t
  misc_feature (235)..(235): n is a, c, g, or t
  misc_feature (246)..(246): n is a, c, g, or t
  misc_feature (250)..(250): n is a, c, g, or t
  misc_feature (269)..(269): n is a, c, g, or t
  misc_feature (281)..(282): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (297)..(298): n is a, c, g, or t
  misc_feature (302)..(302): n is a, c, g, or t
  misc_feature (307)..(307): n is a, c, g, or t
  misc_feature (320)..(320): n is a, c, g, or t
  misc_feature (340)..(340): n is a, c, g, or t
  misc_feature (346)..(346): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (383)..(383): n is a, c, g, or t
  misc_feature (392)..(394): n is a, c, g, or t
  misc_feature (409)..(409): n is a, c, g, or t
  misc_feature (432)..(432): n is a, c, g, or t
  misc_feature (469)..(469): n is a, c, g, or t
  misc_feature (489)..(489): n is a, c, g, or t
  misc_feature (497)..(497): n is a, c, g, or t
  misc_feature (519)..(519): n is a, c, g, or t
nccctcagcagaaaatgatacagtttatagaaaacctccccgcccctcccacaccccanttaaaaactacaaaaaaatctcccctccttccctacgatgtcntggtagtctgnctcctccagtggcactgcngctctggngtggccagctcaccacagcaccctccccttcnccttggggggggggggggtgctggtggttanggnggttaaaaccattngttccagtnntgccngttcccaaacntgcncttccttcctttcccccanggtctggggccnnggggnangggnccgnnatgngcccngccatggggggcnactcgggggggggaaatttngcccangggggttngangngttcccatttacctcctccctccncccccctcnnnaaagaaaaaaaggcngtttagggtttttttcccacccnaattggttccccctcaggcctggggaaaagccccagntgtcccgtcttgcgggggtnctgggaanctccgggctcttctttccttgngcctccctt

SEQ ID NO: 701926 - DNA, 895 bp, Homo sapiens
aaggaagtaagctctcagagatcctaacacgggctgggaacctctgactcagagcatgtctttaaagagtccaccatctggccaggcgcggtggcacatgcctgtaatcccagtcactttgggaggccgaggcgggtggatcacgaggtcaggagttggagaccagtctggcaactatagtgaaaccccatctctaataaaaggtacaaagaaattagctgggcgtggtggcgatggcgccttgtaattcccagcttactttgggaggctgagacaggagaatcacttgaaccctaggaggcggaggttgcaggtgagccagagatcatgccattgctactccagcttgggtgaccagtgcgagtactccatcatcagagactgaaactgaatagatagaatagactcgcatgtttgtgtcgacctgggacggcgtgggtatcatccccggaaaatggtccagaacccttggaggcagtgcccatggcgtgggcctaaatcacacctgggggggttgagggcgtcaaaatggtcgccctgtccacccaaatatgaaataccaccgtgtcgctaacactattgccagaactaagcaaatgatgagtacctgtgtggtcgcggggggcggcgcactggtagaattctacgaaaattggggaaggctgcacgcacagagaaatctctttggagaccctaatgagtgcataagggttgtggttgacaccatgaatggtggcccacgctgggacaaagggggtgaggggccctggtctgccaaagacaacgtcccacgtctgcgttggaccccttggaaacccggcggtgggggccgcggcttgaacccaactggagggaatgccctggaactctaacacggactgtggtaaggttccaa

SEQ ID NO: 701927 - DNA, 660 bp, Homo sapiens
  misc_feature (26)..(26): n is a, c, g, or t
  misc_feature (233)..(233): n is a, c, g, or t
ccagacaccacgactcatgcctgtantcccagcactttgggaggccgaggcgggcagagcacttgaggtggggagtttgagaccagcccggccaacttggtgaaaccccacctctactgaaaaacatacaaaaattagctgggcgtgatggtgcatgcctgtagtcccagccacttgggaggctgaggcatgagaatcgcttgaacccaggaggcagaggttgtagtgagccnagatcacatcagcacactctagcctgggtgacagagcgagactctgactcaaaaaataaataaaataaatatcacttacattagatatacccaaggggtggtctatagagacttggaagcagtggttattgcaacaggggcacggaagtcatctgctatgccagggtgcccaggggatactcggggtgggtggcatggtgctgctggggactcaccgcacaggacgctctgattgacgcactgccaggagtagcgctctgtcttgggctgcagccggcctcctcagctcgagtgtaacaacagtcgtggccatggcagcacctgcggatgtcacatgggcaggacagcaggtgggtgaagctctctcctggccctcctctcttgccaggaccatgggtgactgaagacccccagggagcacagcatc

SEQ ID NO: 701928 - DNA, 139 bp, Homo sapiens
ctactctgtatgccaatatcaaaaaggcactctgttgttcattagagaataggtggggtgtaacgtgctcatagagctgctgcagtcacctgcttatgcttcccaggatggctgtagcaaactatgccaagctgaagtt

SEQ ID NO: 701929 - DNA, 602 bp, Homo sapiens
gcgtgatcacagttcactgcagcctcgacctccccaggctcaggtgatcttcccacctcagtttttgtatttttaggagagatggggtttcgccatgttgcccagactggtctcgaactcatgggctcaagtgatccacctgcctcagcctcccaaagtgctaggattacaggtgtgagccaccatgcccggccttaagcaactctttaaaaatatgggcaagccacctcacacctgtcagaatggctatgatgaaaaagatgaggccgggcgcagtggctcatgcctgtaatccccagcactttgggaggctgaggaggggggatcatgaggtcaggagatcgaaaccatccttgctaacacggggaaaccctgtctctactaaaaatacaaaatattagccaggtatggtggcacgcgccctgtattcccagctattccgtgaggctgaggcaggaggatccgcttgtacccaagcaggttggggtttgcaatgtgccaggatttcccttactggtctctaccctggcgacagagtgagactccatctttaacttttttcccaattggggggaatgcctccctcgtgcatggagtttgcg

SEQ ID NO: 701930 - DNA, 167 bp, Homo sapiens
tatggcgttgaccaggagatcgagcaagtcaaagcgtagagtcaaagcgattcggttcttatgatatagccatacttcagataggggtacccccatgcaatatagtggctcatacaagtcctcagcatgttaagtcgaaagcctcgcttgcagcttcacaataggtt

SEQ ID NO: 701931 - DNA, 179 bp, Homo sapiens
ggtaatcagaattttagagtaatgtattccttgacaagatatgtttaaatagaacttgagtttttggatgggcgcgggggctcaagctgtaatcccagcactttgggagccaaggcgggcggatcatgaggtcaagagatagagaccatcctggccaacatggtgaaaccctgtctcta

SEQ ID NO: 701932 - DNA, 550 bp, Homo sapiens
  misc_feature (14)..(14): n is a, c, g, or t
  misc_feature (52)..(52): n is a, c, g, or t
  misc_feature (70)..(70): n is a, c, g, or t
  misc_feature (141)..(141): n is a, c, g, or t
  misc_feature (187)..(188): n is a, c, g, or t
aaaaaggcacttgnatggaaagggtaatccatgtgctagggctgccaataanaagcaatagactgggtgncttaaacaagaaatgtgttttcctcacaagttctggaaggctgagggcccaaggtcaaaggttttggcagnccctggtttcttctgaggcccactctctttggctttgcatgatggnnggccctttggcaatgtccctcacgtggtctttcctctgtgctcaagaaatccccatttctgaggccatgcacgttggctcacccctgtaatcccagcactttgggaggctgaggcgggaagatcacttgaggtcaggagttcaagaccagcctggccaacatggcaaaaatcagtctctactaaaaatgaaaaataaattaaaaatttaaaaattagccaggtgtggtggcaggtacctgtaatctcaactactcaggaggctagacagaagaatcgtttgaaccctggaggcagaggttgcacagagctgagatcatgccactgtactccagcctgggggacagagcgagactccatctct

SEQ ID NO: 701933 - DNA, 1068 bp, Homo sapiens
tagagacagggtttcggcatgttgcccaagttggtctggaactcctgggcttaagcagtcctgcctcggcttcccaagaatgctaggattagagccaccatgcccagcctattttgatttgtgtttttttaatgttcctttctaataaatgtaacaaatgatgttctcaagtacgtttccagtttcttttcttttctttcttgttttttttttttttgtgaaaggggagtcctctgttctattcgtcccaggctgtgagttgcaggggcgcgactcatgggcgtcatcgtgagaagctcataccttccgggggttcacaccagttctgcagtgccgtcagcctcccaagttgaacgggcacatacggagggcttgtgtgactagtgcgcgggaataatgttacagatcagagacggggttcggcagctggttagccaggagggtctcaaaaactcattgacctgcaaggtgtatgccgtgcaatttccttcccgatggagtgcgtggtattggcgaggattatggagtcggcttaaaccagagagggcctaaactttgcttgtgcaagttgggattggaacccttttgccgacacggttggtctccacaatggcggtttcgggcttttaccctaattgacttttcatatttttgcaagattaattccctgaatgggctactgataaaatttcagggttgcaaggaagggggcaaactctcttgggaactttctgcaacatgtcagtggcaaagtctgccttctccttttgaacccctaattatctttgcttccgccataccgcaggatcttcttgttgttgaaaaattcatgaccctttcaatggaccagagcggggggcaaactgagcgggaggaagggcgtacaaggcgttcccgattttgcattcacgttgtggggtacacccaaatttccttccccactttagagatgttttaaccctttgaggaacaagcttgtggcaccttttttgtgccaacaaaaaaaaaatgggtcacgctacagggagattcttaacaccgtgtcctcactttgtgagaagcctctac

SEQ ID NO: 701934 - DNA, 513 bp, Homo sapiens
acactgggttcgaagtcctgggtgcatgcatgtggttaggtttcgttttttaacttcatcaatgggagagttagagaaggagtagaggttgcttgtaggcatagctctcaaaacaggctggtattccaattgggccaacccaggtcagtgggattaagttgtagccaatgtaatctatatattaaaaaaagttattttatgttctttttcttgtactaggtctttgaaatctgtatatttttataattgcagcacatctcaattaggactagccacatttcaagcgataaacagccacacacagctagtggttaccataatgtcagtggaactctataattctggcaccaagcctgggcccattccaaagaatctaccctaatacccatttcacaggttagcctagatccatgccacctaaaatcatctcacaaatctctaggttacccagggaatcccgttgcttagattactataaaacacctgtatatttaaaagctcacagtcaggttt

SEQ ID NO: 701935 - DNA, 419 bp, Homo sapiens
tctggtatgcaaaggtccgagtccgagtgtgccaggtgggcagtgtattgatggtgcccgtccgatgcgaggtgagatgcaaactgcaggacaaatcagatgagcagaactgtggaagtgcttcgtttaatagatcagttccgctgtgtcattggtcagtgcattggaaagcacaagaagtgtgatcataatgtggattgcaggtgacaagtgagatgaactggattgttatacgattgaagaaccgagattgacagggcagcaatacggttggttctgtgatgggcgttattgttatgatttttgtgtctggaactgtatactttatctggcagaggatgttgtgtccacgtatgaagggagatggggaaactatgactaatgactatgtagttcatggagcagcttctgtgcctctt

SEQ ID NO: 701936 - DNA, 103 bp, Homo sapiens
attgaatattgactctgtaataaacctaataatgaatgagtaaattacaaaaatactttgtgtaggcatattttgtgaaacatcttttgattttaaatcattt

SEQ ID NO: 701937 - DNA, 234 bp, Homo sapiens
gtgctggcaggatacagagcaacagaactctaattcatgctggtagcagtgcaaatggtaatcgctacttggaaaaactgttgacagtttcttacaaaattaaacatactctacaggctgggtgcagtggcttacgcctgtaatcccaacactttgggaggccgaggtggacgaatcacgaggtcacaagatcaagaccatcctggccaacatgttgaaatggtcgccaatccg

SEQ ID NO: 701938 - DNA, 129 bp, Homo sapiens
acatctcagtgccaggaactgtccatttctctcagagagcaatgatatgctacagctatacccagaccttttataggtaatgacgcagttcacatcttgagagaacacacaccctgtcctcagatttct

SEQ ID NO: 701939 - DNA, 433 bp, Homo sapiens
gagatccagatcatccgtgtccggtcgcagcggatagggtggaagggtgatgcgataaaggtgggtgtagcgttgtcgagttcagaggctgtgtccacggacagttggatcgcttgcggcgcaggtgtttggctgacagagagagacgttgagcgcatttaacatcctaaggatagatatgcagttccttccgcctgagaaatgatcgaggcttcgtgccttgtggacaactaagtgattggtggcgtcctattggttccgaggccgaactcatgtacatctggaaacaggaattctcataaaagacaggtagtacggtcggggttttgatatttgttgcacaactcaccgggctcacatttagaaggacccgcatgtcgttcgtcgaaaccaatcaagtccacctgcttgccgccctgtggttcatcctgtg

SEQ ID NO: 701940 - DNA, 362 bp, Homo sapiens
aggaggtctggaacacagcttccacattgttatttaactcatcaactctatttctgattggcctttcctgttgtagcaagctctcttgcaactgacatctgtgtagcacacctttcaactttcttttgagtgacagctgcttggtctggacgagccatatagccacttcctgtgatggccgttgggccaggcctcagtctggaagctctcttctctcttcgtgccaaggggtcaatgaccacgggctctgaagaaaccctcttcattgtcgttgacaccttgggacttactctagagacacacacatatagtagcaataatatatgtctcatggttttaagtgtgtgaaagctaaaagaacc

SEQ ID NO: 701941 - DNA, 395 bp, Homo sapiens
ctgaattcatgtgatggttatcagaacaagatatagcaatagctaggttagaagacatacagctggtaggcagaagtcaggaaaagtgcttatgtggccaggccattttttcaatactttaggtgtgtcagaaactacgggggttggtgcaaggttcaaaaacttgatggttcttggccatgagcaaaccctcaagattggtggaaatgtatcacatcttacatagctgtagatgtactaccctgagtaaagagcatgtatacttttcacaaatggggatatctgcaaaactcagaaattcaggggctctcataagatttctcctttccctttccttacccttttcctttccctttcccttttcctttccctttccttttcctttctgacccctg

SEQ ID NO: 701942 - DNA, 255 bp, Homo sapiens
ggcacgagtaggggtgagccaccgcccaagacctaaacttaagagaatcttttaatcagttcgtatgttcaacttacttcaggtttttataaagactgccacagactaaacaattttctttttctgttttgcagtttcactattaaaggatttaaaacatgcaaatatagtaaccttacatgacattgttcacacagataaatccttgactttggtgtttgagtatctggtaagcatctcataaaaatcagtatt

SEQ ID NO: 701943 - DNA, 128 bp, Homo sapiens
actgcggctgtttacgttacggactaactactaaactacgttaaacttaacgaactggttactgttacgggtttgtacggtacacacctgctacttacttcctcctactgtgggtaacttgacggacg

SEQ ID NO: 701944 - DNA, 147 bp, Homo sapiens
agggttaccctctaagactccggggctgagcgctaggagccagctggagagctgcggctgcccccaaaggcctggcctgtccagagtatggccacataaggtgtcagaagctccggcccactggccacaccgtgccgcagcctcgtg

SEQ ID NO: 701945 - DNA, 115 bp, Homo sapiens
gggggaccccccccctgccatttgcctacttgccatgtggccagggcttaggtttttttgggcatgcccccctcgcagaatttttgataattaaataaattaggacatgccccca

SEQ ID NO: 701946 - DNA, 176 bp, Homo sapiens
cgagtcgagccggaccccaagaccccttagctattgtgtgttcaggactatgtaagccactttcgtagtctattccgtgtcacctggcagttgtttacaagctcaggtgagtcctagctttattggggagggggtgatctaaaacagtctttacgccggcttaagggacccttgca

SEQ ID NO: 701947 - DNA, 186 bp, Homo sapiens
  misc_feature (15)..(15): n is a, c, g, or t
ttggcttcaactcanaggcgcaaaaagaattatgaaagagaaaattttaataattaaatatttctatttttcaatttgtatttttttcaattttgaatttaaaaatataaactccagtaacatccatgtttgtattatgttccatgcattcaccatagttgagtaaagatccgatttgatgataaa

SEQ ID NO: 701948 - DNA, 136 bp, Homo sapiens
  misc_feature (42)..(42): n is a, c, g, or t
  misc_feature (65)..(65): n is a, c, g, or t
  misc_feature (105)..(105): n is a, c, g, or t
  misc_feature (133)..(133): n is a, c, g, or t
gaccaattttttatttttaaaactagttcttttgtaatgtgntgttcaaaacggaattgaaaacnggcaccccatctctttgaaacatctggtaatttgaattcnagaggtcctttgtgcttcagcccgggcncta

SEQ ID NO: 701949 - DNA, 145 bp, Homo sapiens
  misc_feature (22)..(22): n is a, c, g, or t
  misc_feature (106)..(106): n is a, c, g, or t
aagatgaatttacttttcttanaaaaaaaaaaaaaaaaaaaaaagagtttctggctgatgggtgactcaaagtgcaggactgctgtctcgtggggcagaggggttngcccttctcggagggaacctcctgttccctgtctgagca

SEQ ID NO: 701950 - DNA, 1081 bp, Homo sapiens
aagtatggtgcactggtcaataactttgctgcctgggatcatgtaagtgctaagctaggagcagctgagtagccaaggattattgtagaatagaagccatctcccactgggaactgcagtctgagggtggtcaatctagcagccccatcccctgcctacctgggcctgcagtccgaaccttcgatgcttacactatttgacagaggggatatcagtacgcttccctcctgccagacctggcagacctgggtgtcatggagtactacctgatggatgctgcctcctatgctgcctgtactggccctacggccatgcaagccatgggagacatcagtgcattgaccatatgtgcagctcctgggggaaagacactagcgtagctacagactggcatgtctgccgcacatcttgctgccaatgatctctaccccgtaccccgaatagccagactacagaagatccttcacagatatgtgcctagacgagatcagggataggaacatcaggctccgacgtacacctccactgcgattggccaggaaactggcggacaaacatggaggagagacaccctatgcaacgggatgccaggatggatgtgccctgaacccacagaccgccaccacccttccatgacgaggacaacacaatccataacaggcgcgaacaacggcacagcacaggcgccgaaaccgaccaatggcacgagagcatgccaaagaggacgaggaccagacggccgcgccagacacccatgcaacaccacacaacaaggcaagggaccggtgagaaacaacaaccgacacacacccacacacgagcccgaaacaacaaaagcgcgccaggagcacttgggcacccagtgaaaaaaacataccgacatccagaacccgggtggcaaaaaaggtccacagcaagcagacaaacgacacacgaggatcgacaacaacaggtgcaaacgcacacaccgacaggactagaggcccaccaacaacagaagacgacagacaccacggcagacaagacgatatgaaacaaaaacaaacagcacatacagaaccaccaattacgcacaaacgcc

SEQ ID NO: 701951 - DNA, 724 bp, Homo sapiens
gggggctgctgggactcgcgtcggtgggcgactcccggacgtaggtagtcatgtggggccgggtatctgaggcccttggctattcttatacttttgccacctctaggccatcgatgccgcagtaccgagacctgggaggtagtgcagccagtgctgctgagaaagctttacctcgtagagccatatgaaggcaggtgtggttcgtcgaaatataggctattctgatgggaagttgtgtgttcaaagtaaccagatgatttagttagacagtgtcttgctctattgctcaggctgcaagtgcagtggcttgatcatggctcacttgatcctcgacctcctgggctcaagcggtcctcttgcttcagcctcctgaatggagagactacagtgttggggtcataaaacagaccaagctcaagatgtcaccgacgcttgagaaattccacagtcaactaatgcgattatggtagcccaaggaagcccgcaaatgttaccattggaaactgagtgaatggttgacaatgaagacttttgtcgtgtacttaggaagtaaatatctttttgaatcagagaaagtgttgggacagacagtactttatgtaactagtgggtgtcagaagcttagaggtccattattggtaatgtcttttaattactttagagagctaggatgcaaatgttttcgtaagaaggcttatttacttttggaattgaacaaaattgt

SEQ ID NO: 701952 - DNA, 474 bp, Homo sapiens
atctgtcggaacacctgttcgagcatcggttcgggaccgctgtcggaatagcggacagcatttcccgactggccggagccgatggccagcggcacgcacagcgaggacaggaaaagggcgttgcgcagtacgcgtgtgagcgcgcggctgcgggcgaccggggccgtgctcatccgccgacccgctcctgctggatcagccagcggccgtcgcggcgcaccagcgtcagcgtcttggtcgtgcttgtcttcaggccgaccgccttgtagtgctggcggaacgtggcgtcggcacggtctgcggcgaccgacttcaccttcacgttctcgacgcggacctcgattgcgcccggcttggcgatgcgcgaccggcgctcggtttcccaggcaccgcggggtttgccgtccggtaccttgaagtcggccgcgtaatagccaaggtagctcttcacatccttgcgcgaccaggcggccg

SEQ ID NO: 701953 - DNA, 302 bp, Homo sapiens
tgaggatccccagaggctgaatgggtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgc

SEQ ID NO: 701954 - DNA, 92 bp, Homo sapiens
tcgatacgacttttttttttttcctaattttgacctgtttcaccagtgttttacccttgactgccccttctgtcgtcttatcgcacccgtat

SEQ ID NO: 701955 - DNA, 124 bp, Homo sapiens
tagctatatcagtgggatgaaggcctgcttacctttgtgtgtgggtgatgaggaggtataaccttccagtaaagtagttgagccttcagaaatgattagggtcacaacttgcacctgtaacatc

SEQ ID NO: 701956 - DNA, 251 bp, Homo sapiens
tggtggcacaggatctctggggaccttgggtgccaaagcatggatccccacccccaaaagccccctggtggctgagtttgacttctactgccaggcctgcagagctcacttatccaggccagtgggcagcaacctaggtctaggagacccctggcaaaagtggaggcagatccatcttcctggccccatagggaggtgctaggggtgagggcagttcaagtgtggagaacaaagtgaatgctcctgcgact

SEQ ID NO: 701957 - DNA, 1666 bp, Homo sapiens
  misc_feature (1)..(1): n is a, c, g, or t
  misc_feature (141)..(141): n is a, c, g, or t
  misc_feature (144)..(144): n is a, c, g, or t
  misc_feature (1270)..(1270): n is a, c, g, or t
  misc_feature (1284)..(1284): n is a, c, g, or t
  misc_feature (1337)..(1337): n is a, c, g, or t
  misc_feature (1357)..(1357): n is a, c, g, or t
ntcggtctgtgggagaggacccacaaagtggtggcgaccaaagaacgcaccgcgcgttttttatccctcgccggcgcccctgtttactttatacgccggtgctctaaatggttagccgaaccgcacccgtgtgggtgggcngcngaaaatttctctgggcaaccagagggaccccaccagcaacacaccaacggcgcggggctttgggccaccaaggaaacccaacgcccgccctcttccctggaataggccggggcgccaacaaaaaagaggggaacccccacaaccaagagcgaaaaaaatggggggtggggacaccacccagactttgtgcttcaaagagagagagacatattggggtaaataggagaggtgggaagaagccaaccccgcgctgaagaggttccacagagatgaaaaggagaaatatttttgggggaaaaagacaacgcccctttccgcgtttctaccccagcggggaccccctcagggcgcaactccacagcaaattgtgcgccactatctggcgatagggttttcctctcacaagagcgtttccccttgtgttgtttttttggaagaaatgggaaaatttcctcttgtcctggggattattgcggccccgcgagatagtgaatagggagagaatgtgcgcgcaacttttgagtgggagagaaatgttttttccacaatgccttgggaggattttatatccctcgtacgaaaagaatatgtgttttctcaacgcgggggtataaaaaaaaaccttcggcggcccgtcggagtgacttataagcttctttcccactcgggcccactcgggagatgttctttataacgcggccgcgcggagccacagcagaaaataggtggtgtttctcacactcggggttccacacaaaagattgggcgccgacagagacacactgtgagtttttgagaagtctttcacacgcttgttggagagtgtctcacacagagctcaacctccgagtgtgggtgtaaactctgggcgtctgtctgtgtcttctgtgttttctctgtgtgtgtgtgggtgtgttttagactctaagaatataccgccaacccacacattcacagagatactcgcgagaagagccccctccttatatggctcaccgcacccacacacacagggtctccccccacaatctccggagaagagaagagatagagagtgtgagaaaatctacatgagaccccgcagagagagggtcgtcacagaccacacaatggagactctgtaganaagagaagttgtgngccacacatatagaatgtgagatgttccacgcagacacgccacatgtggaganaaagagacacatatgagaanaagggctgtgcacacacattctatatttaattcctctctctccacatcgagaggttctttcgcgttatgagaaaagtataaaaatgctcgaaggagaggccccacagtttgagaattgggagaaagctcactggaggcttcactggtgaaaggcacgtaagttcctgggaaaagcccctcggggaacgaagacacacggtgggctataaagttgaaacgagagactgatggatatgaaccccccgtcccagaaatctgtttaaagattccagacttccaatagtggcccaattaaaagtgctatttgtg

SEQ ID NO: 701958 - DNA, 112 bp, Homo sapiens
cgggtcaactttctcactatgtgcttcatccgacaactaatatttcactttacatccaaacatcacttggcttcgaagccggcgcctgatacagccatgagatgttggaagg

SEQ ID NO: 701959 - DNA, 654 bp, Homo sapiens
aacaagttgtacatcaggtcgctgcatgaggtgttaattcaggacgaggcgcgctggttggtgccaggcggtcgtgcggacgcaaacatgcagatctttgtgatgaccctcactggcaaaaccatcacccttgagtgtcgatgcccactgtgacaccatatgagaatgtcaaatgccaaaattcaatgacaaggagggtatcccacctgaccagcagctgtctgatattttgcctgtgcaacacatgcttggatgtgatgtgcctgcgactctactcatgacatcacaaccatacccagcaaatgcagtcccacccatgacagccatgtgtgattagcatgccatggcgacgggtgtgcaatatactttgacgcctatcttctcctgaccagacttgcccatgaaatacaacttgcgacaagatgatctgccgcaagtgctatgctcgccttcaccctcgtgctgtcaacttgccgcaagaagaagtgtggtcacaccaacaacctgcgtacccaatgaagaatggtcaaataagtgttgttacttatccttggaatgtggcatgcctccatgacccagggcccctgatgggcacctgtgatggccatcaagtaaaggtgtaccctttcaattgacttggagcaagcaacaaac

SEQ ID NO: 701960 - DNA, 190 bp, Homo sapiens
atgatccccgttattgtctctttggggatacagtcaacacagctcaagaatgcgtctaatgggcagcctgaagatccattgtcttctaagaccaagctgtcctggaggagtttggtggttacgaagcttgaagctacgaggggatgtagaaaatgaagggcaaagggaaaggttcggaacctagtggctc

SEQ ID NO: 701961 - DNA, 589 bp, Homo sapiens
  misc_feature (12)..(12): n is a, c, g, or t
  misc_feature (541)..(541): n is a, c, g, or t
  misc_feature (583)..(583): n is a, c, g, or t
acaataccaaangcaactcctagagaaataagacaatttttaaattttctactttatattaattagtaactaatttgaaatgtcttaatgtaaaggtggaagatatttctggtccagtcgctagctttaattagttatttctaaaccaatatattttcttcctttctttgggctccatatgttcttctccactgagatctaaatgtatgccctcactgagacacagtaaacaggcatattcataaagagtgctttcttgcaggaatgccctcttgacatcattatgcatataaaaataatcttagaaaataagaaattacaaaagcgagggatgtttgaatgcattcttctgttttactaaagttgttatagattcatctacctcagcattagactgatcttaaaagtattagattccagccattcacccagtgcttgtgccacatccctaccaggtggcaagtccttgtttaaacaccccacaaaggggctatttgctctgcaaatatattgtaaaatgtattatttaattattaatatnttttaactatttatattttagtattacctttcagtcctttgntttctt

SEQ ID NO: 701962 - DNA, 260 bp, Homo sapiens
gctgcgctactactacctcagaatcccgctccttcgtcggcttggtttttcagcatagcactatcgcctacggacatactatatttttattggttattatctatcttccttcactagaaggtaagctccattagggtaagaacttaattttatcaccggcggtatcccagggcttaaaattctgcttaacacaaatacggtggattactgggtagaatgaataaataactaaaaggcaacataatgagggtaccgagctc

SEQ ID NO: 701963 - DNA, 234 bp, Homo sapiens
gtcctgtcccccaggcagatccgactgctgtgaggcacattcctgtccagtgaggcggccactgtgagggagttgatggaccgagctctggagctagaggcacggtgctgggttgaggatgtgcctccccagaggctggacgagcactgccacagggagctggccatcgacatcatccagatcagctcgcaggcccatgggaaggccgagatcatcacgctggacttgggctca

SEQ ID NO: 701964 - DNA, 1123 bp, Homo sapiens
  misc_feature (1123)..(1123): n is a, c, g, or t
tggctctgaaagcaccatgtggcagtggagcgtggcacgggagcgaggcaaccatgcaactgaactcgcaggcagtgccgggacggccccctggcctctctgcgttttgcctttacacactaactgtactgttttttctattcacgtgtgttctagctgcaggactgctaacatggaaaacaggtaactacacagattaacacttcaacaggactttcagacagttaaggttaacgtttctctacgtttaattctgctgctttaccctacaactctgtatgctactaactctctctctgggctggcgctactgggcgacacttgcatcttgcctaacacacactagaggcgtcctcagcggcctgcttctcagcacctctagcacgaagcacccaaggcgaccagctactcctctttagtccaacagggcaacttacctacgtatatgtctgtcaactaccgtaacgcgtcaaacctgtggcttgccttcttgcaataacctcccagaaggccctgaacttggggcggctctttctcccggggctctcttggggtcattccaactaggccccaaggttccccctggaggctgcctagagggattattaggcagtctttccctcagactttggctatgccccaaggggcagccttggggataccgccctcggggacggggggggatccgtctttatgggggggccccaatagggtgacccaaattaccccccaaacgtattctccaggccacacaatggttacaacttaaaggtggggtcctccaacggcatcccaaaagggggggttctttcgagtttttcccaattggaacccacaacggggaccttcccacacgcaagccgcccaagtcggtggcttgcggccttggtcggggtcctccctcccaagatctttcggacgtggccttcccccagcgggcctcgggccgctccccagtgcctgggcccttttggcttggccgcgagcgcccaaacctttgggccgcgcgcggcttctcaacagcgcgtcctcccacgagcccatacgacttctcaaccgccctaatttgctcgggtctctgtaccccctcgctttcgtctctctggcttgcccatttggggcn

SEQ ID NO: 701965 - DNA, 189 bp, Homo sapiens
cggcacgaggccggctcacaggtgctcaccaccgaaaacgcctgtgagcagatggcctgcgagttgttgcttctctttttcttctgcttttagacttttcttcgtttcgttttaaatctgattacaaaaatcaacgtacacttttaattgaaaacgcacacattacgcaaagtaaagaagcatcccaga

SEQ ID NO: 701966 - DNA, 731 bp, Homo sapiens
gtggggaagagaaagatgaggatgaattccaataaatctgaatctgaggacagcatcaggaggaaaggtttacgcttctccattgaggggaaccgatcgacatatgaaaagaggtactcctccccacaccgagctcttggttgagcatccgtgtgctcccatatttgcagccaaggcgaaatagccgagaatcaagccttttgcaggctttagagggcgagcaaaggatgtgggatctgaggaacgacttcggcagatgatgagcagcagcaccgtgtggaggataagcgagagccggtagagattccttgattgtgccccgacgacacggagagagacgcaacaggaacctgagtcgagaccatgtaggtcatcccggatgctgtgcaggtgttatccagcgaatgggaagatgcacaggactgtggattgcaatggtgtggtttcctgtggttggtggagccttcaggttcctacatcgcctgttggacagcttctgccagagggaacaaccacgtgagaagctgagaatgagaagagaggaaggtcaagttctttccacgtgtccatggactttctagaagatccttcccaaagggcaactgagcaatgagtatagccatgcattgctaacaaatacgacgtagaaggaacttgaagaatccacggcagaaatgtccaccctgtggggataaattttcgcaacatattcttaatctgggactgtctca

SEQ ID NO: 701967 - DNA, 468 bp, Homo sapiens
tgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttatatttcaagaagagagaaattccattttgacaactatactcacgaagatacttctagtcctcagagtaggcctttggcttcggatttgaaaggtggaaacaatacacatgcctgccctggctccagaggaaacacaatctctagcttccaaggttgcaagcacacctgttctgtgctccagagacactctgtcttccaagactgctattcaaatattccttgttgaattctgtccaaagctttttctacatttattggaggttatttcaaagttaaagacagaactctcaagcatcattaggatttctcaagattgct

SEQ ID NO: 701968 - DNA, 224 bp, Homo sapiens
  misc_feature (6)..(6): n is a, c, g, or t
  misc_feature (23)..(23): n is a, c, g, or t
  misc_feature (46)..(46): n is a, c, g, or t
  misc_feature (61)..(61): n is a, c, g, or t
  misc_feature (148)..(148): n is a, c, g, or t
ctgcgnaaaagcttcgggcaganctccaacttgcaacacaaccacntgctcctttgaaaanttctttttacacgtgtaagcccaactgagataccgtgatggtgttgatttctctcaatgatgcttactgtctattttagcatagacnatactgtacgtgaacaaatgatcatggatatgttctaataactcatttaataaatatactgtttatctgtttctga

SEQ ID NO: 701969 - DNA, 969 bp, Homo sapiens
tgtttagtagagacagggtctcaccatcctggcaggctggtcttgaactcctgacctcatgacccacctgcctcggcctcccgatgtgctgggactacaggcgtgagccaccgcacccagcccttttttttttaattagccaggcgtggtggtgcaatcctgtggtcccagctactcgggaggctgagatgggaggattgcttgagcccaggaggtcgaggctgcagtgaaccatgatcatggcactgcactccagcctggatgacagcgagactctaaaaataaagagtgatgacagaggagtgtcacctttgaaagaaaaaataaacacgtctccacgctgctgtgactgacgataagcaggagagtggggaagagtacctcccgccagtggaaagacaacagcagaattagaaggcgctatttgggcaaacaccgtaataaacacaggcaacattagcaaaaaatgctagaccttgaggagtcccaggtatttgggaaggcctcccccaagagacatctgtaaagggcaaaacagtcacttcacagtgaaaaacccctggcagaccccgtctcagccgaacggcagcaatgggactgacgggatgcacgtcacctcggtgccactctgagaaaagcacagccttatggtcacggcggtgggagacaccaagacaatactgagcttgaggacggtctgcccgaatgacagggccagtggtctggggacagtacgatgtcccaaaccacagacgctgactggggacactctagattaacgcggggggggggggcgcaatgcccaccacggggggggtgtacacagaccactgggccctccagaggcggccgcctaaagatgggcccaccccggtagaagggcggcaaaggaaggcgccgccggcaagccagaaggagggaaaacagaccggaggccacacgctccacgccgcaaaaaaagccgggtta

SEQ ID NO: 701970 - DNA, 142 bp, Homo sapiens
gaggggcgctcctaagggtacaaactgacgctcactctaggacttcccaagacacacttagacacggagcccaccccaaggacctcccaccgtgcatgagacaggacagacccgatgccaagctggacctacctagactagt

SEQ ID NO: 701971 - DNA, 189 bp, Homo sapiens
ctcatgtatgcacgatgttctcctgccccaggaaactgctgagatcacctccacagcctgtcgccgggtcaccaatagcaacttctggcagtcctcccttctaatagtcagatgcccgagggcaggggaagcttctgtctccagcttcccgtagtaccagtgacacgtctcgccgagccccagctgcgg

SEQ ID NO: 701972 - DNA, 131 bp, Homo sapiens
gtgatgccagtgatgacagcattttcagagccaaggatagactgagttggaaatcagctgaaatgaatacatgactgggaataatggggcctgcctgtgaggcctctgaaataatagaaggcaagatgaag

SEQ ID NO: 701973 - DNA, 377 bp, Homo sapiens
taccggacactgggctgtgctggaaggggctggtgtctgaactggcagagccaagtctgagccccctgatcaacatcactgtgaggcaggagaatagggtctggaggcaggtaacctaatggccaattcatgctgacttcttagaactaaatccaaaggaaaaccccaactttccatccccaagtaacaaaagaaccagaggctactcccttcacaccgacctgcttttctaccaagcagatcaagaactgaaagtacctctgattggtcccctcctgcaagcaatcaagctggtctccggccaagtcttcatttatataggagtgcaactttgtaatttcacttcagcctctgattggttgcttgccacaatgaat

SEQ ID NO: 701974 - DNA, 565 bp, Homo sapiens
acgaatccaatccaggttcccaaatcgcccgcacatccaaccccgttatataaaaaagaccgaaagccggtaaccgacgtactttttgccgactcgtccgccggaacgccggagtagtgccctatagcttcctcgtcccaatccgagcccgacgccccgtgcaaggaaatctacgtcgcggagtcctcctaaccggcttcttaacccgagcgagaaccctagtagaaaaggggtcagcaagaagaacccagggaagactccgaactacaaacggagatccgagaagccttagagaactactaccgcgtggaatctttaggaagggtcacccggccggctctgttatattcgccggactcgcgccgttcgtacttaagaccttaatcaccgtatgtagacgcggagtcttcattcgaaacgtcgtctaaagcgtcggcgactttagccgataaaagataagactaaagggacgactaactggaggggtgagacctagacttagtaacgatactcggatagcctctcgcagcacttctgccggtaaactcgtcggcttcgtcggacg

SEQ ID NO: 701975 - DNA, 769 bp, Homo sapiens
  misc_feature (360)..(360): n is a, c, g, or t
gattcctgtaatggctgtcttcctagaaaggtcgtgtctcgggaaacctcttaatctcagcatgccggagctccaggagagggaagtgtttcaagtcagagtagaattctatatataccattgtcttggcccgtcagagattccactatcatgacctcagtgttcaacacagttgtccttagtcctcatgtcactgcttgttggtgctgccgtgttgtggaaggcagttagaagccggtgatgcaatgcgcccttttggtctacggatagtgtgtttctcagtcattacaggtgcattgtagtgccgtgctcgaggggtaatattgcacgagaaacgacatatggaggagactgtagacnttgtggataggtgcctacgtggatgtccaaaaagcatcaagcccgtgaaagaagctatgtgcgcatgtagaagggctaagtactgaagattttggttgtgtgaaacggtttccacagaatcaggtacatttcaaggggagtctcacattttttcactgtgtttccatgaaaattgggcaacaaaaacatacgattttatagatgggaggagaggaaaatgttggcgtattacgaacaaaattgaggtgcccagaaaatttggaagctattggattggttagtaaggtaagtcgacagaagttaagatgggggaaggtttacataagggtcatagatttcatgagtcgttagaaattcttctcaaacgtattgtggaaaatacggggaagcaagggagggtctggcccag

SEQ ID NO: 701976 - DNA, 420 bp, Homo sapiens
  misc_feature (120)..(120): n is a, c, g, or t
  misc_feature (131)..(131): n is a, c, g, or t
  misc_feature (179)..(179): n is a, c, g, or t
  misc_feature (193)..(193): n is a, c, g, or t
  misc_feature (195)..(196): n is a, c, g, or t
  misc_feature (278)..(278): n is a, c, g, or t
  misc_feature (353)..(353): n is a, c, g, or t
  misc_feature (372)..(372): n is a, c, g, or t
  misc_feature (379)..(380): n is a, c, g, or t
agcttttccagcccgcaactggggacccgcccaaggtcgtacgctccagcacaaagtgggagcactttgtcaaaatttaaggtcggcgagggctggccacggcgcgtctctactaacagnccgcctccgcncgcacctgctccggtgccctccacgccgcccggcgcagggcggggaancagcgcgtccgggncnnccggcccggagcgccgccttacgttggacggagttgatgagcgcccggtactgatggcggatctggcggcaacagccttcgnggcctccgcctccaagctggccgggtccatcatctcgtccccggaatccgacggctctgtgtcctccaggctcgngcgctctggggccttgtcnccgcganncgcggcgggacctgggcgacaaaggggacgcgagcgggag

SEQ ID NO: 701977 - DNA, 1233 bp, Homo sapiens
ccgccgctccgcgcacgcacgcacacacacgatgctggcagaccaacgctggcatgcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggcagcgcacttcacagcaacacacgctactgagcgactgcacgcactcacactaacccgctacacgcacgcactgcgacgcaaccgaactcttgctccctcactcacacgcacagcgactgctgcgcactgcacacgccttaccactgcacacccaacgggctacgcagccctggcacgcctcctcgccccctgcgacacgcggcctgcacccgcaccgcacgcactcacaccttccctcacgcgccacccctacctactgaccccacggccgcaccccggccacccctgccccctcccccgcactctcgcgcaccccactctgctggctgcctgctccccccggccccccccacgcccgcctcccctggcccccctggcccccccccctccctctgcctgcaccgctcacccggccccccgctaccgcaccgcactccttcgcccaccccgtccacccccgcgcgcctgcccgcctgcccagcccctgctacccaccacctccccgctcctgcaccggacgcttgcccccaccccctgcccctgccgcccgcccccgcgggcactgcacccctgccgcgccgcccccccccgaacctgcgactctcctgccgcacttgacccccggcaccccttcgccccggcctcccgcgcctgccgcactggccgcgcccctcccccgcgcccccacgcgcctcccctgccccggcccgccctcccccacgccccccccccgccccccagctggcccccccccgcatgccccccccccctcgctcgcacctggccgccccccctccccgcgccccacccgcgcctgccccgccccccgccctactccccgcccccgcccaccgctacccctgcccctccacccccaaatcccccccaccccacccctccaccccacccaccccctcgcccctccccccccccccactacccccccccccccaccccaccacccaccccccccgcccctcgccccccccccccccccccccctcccccccaccaacccacccacacatcc

SEQ ID NO: 701978 - DNA, 120 bp, Homo sapiens
agcggagcggtggcgggctgagcggtttcgagccggtgtcggggagcggcggtaccgggcggctgcggggctggctcgaccaagcttgaggtctcggcgtccgcgtcctgcggtgccctg

SEQ ID NO: 701979 - DNA, 414 bp, Homo sapiens
caggcactcagtttgtaagatgaacaaatgaaggaaagaaggaacgaatgaataagggctcatcttgcagagcgttcgcgtctcagcgcgcaccaggcacatcagtgccaaaggtgctgggggtcgggcccagcgcccggcgcggctggaatgggggcggcgaggagctcctcctagccagccgcagggcgggaactgcccaaacgcaggtcgcagcctcactgggttccgcggcggctccgctcagtagggaccgccctgttccctagcccccaatagcctcgccctcataaattcacctgagcaccctggcccaagtcaccccagatccctgggacttcccaggccccgacctcggccgggcgggaggctgatccttaacagcggcccccttcccccattcccggcttctcc

SEQ ID NO: 701980 - DNA, 787 bp, Homo sapiens
  misc_feature (787)..(787): n is a, c, g, or t
atgctgcatcgatcgagctcggtcccgtgctgggaagaaggcgctatgcaggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 701981 - DNA, 169 bp, Homo sapiens
gcggccgcctactactactactactactactactgctcgaattcaagcttctaacgatgtacggggacatgagcttcttgccgttgttgcggccgtgcatcatcatgcctccagctacaaaacaattcaattgctttttttttttggtccaaaataaaacctcagctag

SEQ ID NO: 701982 - DNA, 2370 bp, Homo sapiens
  misc_feature (8)..(8): n is a, c, g, or t
  misc_feature (2370)..(2370): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 701983 - DNA, 1025 bp, Homo sapiens
ggcctttgtcgctatcttctgcgtgccgtccggtcattgccgagtctgtgatatctgtacttgtgtttacggcgttaaagccctgtgtgtcttgctgggtttaaggcagttttgactccctctttatcatcttgtagccacccttgtgctcttcctgaatttactgttttctgttgagctgtaagtttttggatcttatacatgtggcgtgcgaaccatggttcctttgttctgcagttcctttgcttattgtgcttactctcaattagggaggggatggcgtctaatcccccaaacatagtttcctccgacttagaggttagaatgatgttgttctctattcgttttgttgaaagcaggtaaatggaatcctagtcatggcactgttattcagtagttacaaggcttgctgaatgaaccccggaaataccgtgtttttcgctcaaagtcttgcccatcgttggaatggatgagtgaaatttttcttggggccagttgtgtgtcctcagtaggggtgattagacgaggctgtaatgtttctggaccactcaaagacggctatactctacacggagcgttgtttcgtgttagccttcgcgttatgcacacaacgctcggtatacctcctcaggtcggctaccacagctcttaaactcctggtggatacccagggatttacttaatgatcctttgttccttgatcatggagggcttaatacgagcgccagtatatgaggcatttttactgggcctctctatcaaatccgccggaattctcagtaacagtgtgccttctgatgtatccccggacagtagaagatggctggtataattctttggtaatttctcttcagatgttctcttattagtttgagacagccatttttattgttttaacggtaaaatatcagtcagtgctccgggagagtaatttcctatggggtatgcaccctcctgtctgggtggtgaatgtggtttgagaagtaggagagcagatattggtcaccgtgtggctctaaccctgt

SEQ ID NO: 701984 - DNA, 566 bp, Homo sapiens
tccacacatgccagtccttaccggaaccccatgagctggcaggcaagtcgaagggcttgcccacgtatccgccttcgcgagcctgctccagggtgcccacctggattccggcctcgggcagggcgcgaagcacacgttcgagccacatcggtccctcgtaccaccaatggccgaacagttcggtgtcgaacgccgcgatgacatgcgcgggccgcccgatgcggtcggactcggcgatcaggcgctggcgcacggtattcacgaagtcgccgacatggacgtcgatggctccgtcggcacgctcggggtcgtacggcgccttggcttccggtgccacattgcgtccggtaacccgcgcgggcttaaggccggtgtcatggtcgtaggtgtgaagtcgcggtaggcggcatggccgggatagccggacttcggtgaccacacccggtaactgaccgtcagatcgcgcccgaacgccaccacatcggagtcgcccaccggacggcccagtgaggtgtctccctgcagagatggcccgtccaccatgaagtggttgacccctgcggccg

SEQ ID NO: 701985 - DNA, 2394 bp, Homo sapiens
  misc_feature (2394)..(2394): n is a, c, g, or t
gcccgaggacagggaagaggccaaaggcacaccaacaaggtgggtggagaggaaactggtactttaagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 701986 - DNA, 1376 bp, Homo sapiens
agtgggccatgtgggccaacgagcaggcgctggcgtacggcctgatcctcatcaccgtggggcatcgtggacaccagatgggcgcttcacccagtggtactattggtgcctactccattgtggctgggcgtgttttgtagtgcctgctgtgagtacccccgtggggaagcggcaagacagggctccaacaatggatgctgctggtggaccagaagcacatgacagccgaggtagaagctagttcgtggcccttttaccaggacattactatagtatcgcggccgcaccatgcatctaacctgaatactcaggatgaccacagaccatggacttaccttggactggaacaacatacacttttgcgaaacacaggagcaatgacacatgaggacacctggccagacagcggcacaatcgtaacaccaataacaatggccgcgcaaggcgcgcatagaaggacgaagcacacgcagcgacacgagcccaaacacacacgaacagccacaaaagacacacaggcacagacggaccacgcaacgaaacaggaaagagcgaacaacccaacaccagaagacaggaccacaggccacgagccagacgaaggaaccgaaggagaccaacagcgacaacagacaagacaagcgcaccaacacagaacagagcacgccgccacacaaacgacaacggccggaaccggagagacagaaaaacaacacccacaagccacacaggcgcgcaccagaggcacgcgcggacgacagaagcaacacacgacaaggggaagaagcggcacgcaagagagacacagcgaaagccggcaaaccaacaacacgccccaacagacgaggaggagaagacgaaaaagacggacagaacacgcccgacacccagaaccaacaacaaaggcaggaaacaacacacagacgcagcgaacgaacagaagagaagacagcagggacaaacaagagagacacacgcgagcagaagcggcgaggaggaaaagacagaggggacgaaagtaaaagccaggcgcaccagaccggagagaggagaaggaggagcacacaaagcgcgaatgagaaggacggaggaagaaacagaagagagacccgaagaggacggcagaaaaacgaacggacaggagaagcgggacgaaagaccgagaaggaggcggaccggaagggccacagggacgagagcggacacaaaaagaaagagaaaggacgaaagaagaacgacgacgaggacgagccggaaggaaaaaaagaaaggaccacaggcggcaaacatggacaagaagagagagaaagaaaacgaggaaaacagcgagcaaaaggaaaacgagggacaggcggcgacggagacagagaacgagg

SEQ ID NO: 701987 - DNA, 1788 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctag

SEQ ID NO: 701988 - DNA, 157 bp, Homo sapiens
aggaaacacggtatgattgggtgatgtgtggagaccgatgaaagttgaaatgtacattgctgtcgcattcccatgggtcatgagccaatgactggagtgctggagtgtgctgccaggtcaggtcatctttgggttttgcccagtgagctgtgcggcc

SEQ ID NO: 701989 - DNA, 574 bp, Homo sapiens
gtaaggggagtggcggttccccccagaagtttatgtgcttcttttcctaaagggcggttggccaaaccaggggttcattcggaggggcccccaacaccccactgtggggagctatctcttcaatggcccacatggtggtttgtcccccctgggttttcaacaaacctcccggtggtaaagcttctctccgcttgaggcaaataatcccgcaggagtgggtatcgcagaggtgcccaaagaagggcagccctgctggagaaggtattcatccttggaacaagatcattttgtgggagctcagtcatcctctgtgcgaacacactacactaccaggagtgtaaaccccaccgacgcttgtcttgataaccaccgctagtgatcctcttataccattgtctcgaacaaggatttctcacccaatttttgactacaatcaagcccacatgatgagaatattcatggcataatttctttgcgaagccgtgtatacgtaggttggctatagacttcatgttacacgactataaataaattttatgtggtcaaccgctgtacaaaaaatagtaagagaaaa

SEQ ID NO: 701990 - DNA, 1941 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagttctggccaatgttcacaaaaaattaataactgaaaatacctcgagagggcaatttggtaccgggtcggggacccatagaggatagaacatagggcccaggggtagtagcgtgtaccagagtcccacttctgctgtgacccaggcgggtgcaa

SEQ ID NO: 701991 - DNA, 331 bp, Homo sapiens
cttatttaggattccctccttgaaaattttgcccccaggccccccagggaaatttatagttttccatttagttgtcattattgcccggccttgggattattagtcattggtaagcaactaaaacttcccccggtcaaaaaaggttttattgttcaaaagaaggaaaaacccctgaactttttaaaaaaatttccttttttggataggtttttaacccgttcaaaaaaaaactttgtccaaaaaatggagggggatggggccctttttaaaaacccggatggaaaccccccttccctgggggacctttttaaataaaaaattttacccggga

SEQ ID NO: 701992 - DNA, 1970 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagttatcagacaatgcaacttgcaacttctcagtgcgaaaaatgagagctcgggtagctggtgctaagacaaggaaaagtgagcaacagggggggcggggcaagaaaaggtgcccggggagcccaatttatccgtggccgcttgtgtgggaagggggcccaatggaagggtgtaaaagaaacgggggccaaacaaggcggagggaaaccgacggtgaaccttggagcccgcaccggggg

SEQ ID NO: 701993 - DNA, 1703 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcctccaactaccctctggctgccaactggaagaccgtttcaggtacctggacacgaacccctaagtactgctcaccctgggtttatctgggcccttgctcccgaaaactcatgttttgcaaaacctttca

SEQ ID NO: 701994 - DNA, 1534 bp, Homo sapiens
  misc_feature (8)..(8): n is a, c, g, or t
  misc_feature (1434)..(1434): n is a, c, g, or t
  misc_feature (1436)..(1436): n is a, c, g, or t
  misc_feature (1441)..(1441): n is a, c, g, or t
  misc_feature (1459)..(1460): n is a, c, g, or t
  misc_feature (1470)..(1470): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagcccggctcagtacagctgggtcagttggtcngngcggntcagtcttcagcgacaannctcaggcggntggaaaaacccacctgttggggacgggttggcccggccccccagaagggggcctccgccctggg

SEQ ID NO: 701995 - DNA, 507 bp, Homo sapiens
  misc_feature (285)..(285): n is a, c, g, or t
  misc_feature (301)..(301): n is a, c, g, or t
  misc_feature (312)..(312): n is a, c, g, or t
aagcccgccctctctggtcctcccaaaccccaaagctgctggagagactttgggggacttttttattttcattttttgcctaacagctttttgtttgttcatagaaaagtcttcgctgcgttttttgatggctctgaagcactgtttgagtagaggtagaaggagggagcgaggaaccgtgaatgaactcgcaggcagtgctgggcggccccagctctctgcattttgcctttaacactaactgtactgttttttctattcacgtgtgtctagctgcaggatgtnacatggaaaacagtanctaaagattanattcaaaggactttcagaaattaaggttaagtttttacatttaatctgctgtttacctaaacttgtacgtataatttttgggtgggtatgggaaattgctttgctaaaaataagatcccagggtgtttcaaacttagagaagaccaagggacagtattttttatcaaaggaatcctattttttcacactatgtct

SEQ ID NO: 701996 - DNA, 485 bp, Homo sapiens
tgagctattgtttcttgtctcattcactcacctttttttttcagacactgcatcctctggtttccaaagctagccctttcccttgagcctgtacatcctcctgacctcatcacctctctcctgttatgaacttagcttctttttcttacagacatgcctgcgtttcctcgaccttcaaaacaaaacccggataaaattcttcaaactttttctttttctgttcccctcagaatctaggccaaccctaaggatgctccgtgatcctctaacaaaatcaggaagggggacgtgagcaccctatagttttggtcacctttctttccacctatgttgtctcatcggtttcgcatggctggcctctatactgcttggcaatgtgcatagtcaagtgccttagcgggtatttagtaagtatgaagttaggagagtgccttcatcatgagccctagttcatgttttcggtcctaaaaaaaaacatttcactt

SEQ ID NO: 701997 - DNA, 475 bp, Homo sapiens
tggtatcagcggcttagctgcactggtggttgggcttagctggggcttgggtttgggctcagctcccaggttcagaatctggtccaagtcctcttcaactctgaacagttccttgtgggcgtccctgtggctagaggctgtgtgcgggccctctcactctcaccaggcgggcgggcagcacgagggagtcacccaggggggatagacccgccgaggtcaggatcatccaatagcttcagggggtccatggatgacacgtaactccgaggggtcctgtggagacagctttctgcccggggcaaagagcccctcatcagggtacacctcctcgtccaagattgggagccggggcgagggcttggctttcaccggccactatgggatgtttcttggggcttcttggagcgcataattgcccgagggtcccacgcctcctcctcctcccaggatatctcaggatcctcgccctttaggg

SEQ ID NO: 701998 - DNA, 147 bp, Homo sapiens
cacgagggtcccccttaaaagcataaaccggaatcgtggattacatgcaacaggggccctgctcaatgaagcgatcacttttacttaacatcgtgtgtcgccattttttaactactacatccaattggtactgcatggcaacactga

SEQ ID NO: 701999 - DNA, 158 bp, Homo sapiens
  misc_feature (57)..(57): n is a, c, g, or t
  misc_feature (60)..(60): n is a, c, g, or t
  misc_feature (63)..(65): n is a, c, g, or t
  misc_feature (67)..(67): n is a, c, g, or t
  misc_feature (74)..(75): n is a, c, g, or t
  misc_feature (77)..(78): n is a, c, g, or t
gtccaccaggctatgatattaaatctagcacataaagccattactagaggtgaaatncangcnnntnctattcnncnncaccatccatttggttgttacagaaaaattcttaactgtaattgatggttggtcccgatgaataggtggatcctctagag

SEQ ID NO: 702000 - DNA, 173 bp, Homo sapiens
gcggtgccttgcaggtcgacgtgtattcgccactgcgtgtgcatgctctcccatggtacaacgttcctgtctgcacactgtgagacaccgatgctgtacctcgcaaagtattgcttcagcatgggagccatggatcgacttctagcatggatcctcgcagttaccctgtagtc

SEQ ID NO: 702001 - DNA, 335 bp, Homo sapiens
tcatcccaacactccagagacccggagacgaagatcgggcgtttagaccaggctgggctaaatgagacgctgtataaaaactaaaatgtaaagaaaaagtaaagaaggcagcagacacactgtggacaagcttattgttgccagtgcctccaaccgcctgatgcagcagttcagactcattgaagagaaacgttgtgggctactgagcaggtgcaggctcttgccaccaatcctgaggggcctgagttcgatctcggagacaagtaggaccaccacagacaaagatgagtaaagcaaagtaatgaaaaataaaagctgtgcaaatgctgaagcca

SEQ ID NO: 702002 - DNA, 1455 bp, Homo sapiens
ggcgcttttccctgccgcacggagccgcagggcccgcctagcgcacgccactgcgcgcccagcccgcgcacactggcactgcgcctccttgcacacccccccaccttccacacacggcacctggccacgccgcgcgcgcttgcgccccactgctgcgcttcaacccacgccccggcccccgcgcacagcactcccgcccagcaccgctacacgcgcccggccaacgcccaacggcgccgcccgcacttcgccttccgccgccccccgccgcctcgcggctccccacttccggcccccatcgctgccgcttgcccccccacggctctctcggctacccaacacccgacactgcttgcccctgccccggccccgctgcgcctttccagcccttgcccacgcgacgcctccacgggccttgcgccccgcgccctttccaccacaccgacacggcttgcgcccccggacccactccgggccattctccttgctgcgcaatcccgacgcgcacgcgccgcgacaccaaagcctcccaaccggcacgcttcccccttgcccacgggccccaaccgtcttgccacccccgcgccctgccacgcggaagctaccccgtccctcccacaacccttcacttccctcccttttccccccacggccaacggcccctcgcgcccccccccaaagcaaaccggccacgaccaagcttccttgcccttgcacacgaaccttgaaaacctcggccccacccccagcctcgacccggcaccccgcgctcacttgacccggctcccgcgacaccggtccttactcaacccacacggaccgacacacgcctccgaagctcatccacctcgcaagcgaaacgagcacacacgaaaactttcccaacaggccccttctcgcccttagctcctcccgctaattgccccccccggctgccccacacggccccgggcctcctctcgggcccctacgcggccaaaaacacagaagcccaacgggcaaccccgccacacaccacccgccctgctcgacccccgcacccccattcacagccccctccctggcggcaactgccgaactccccccccccacccccccccccccccccccccccccccaccccccaccccccccacccccccccccccccccctccccccccgcccccacacacaccccccacccccccgcccccccccccacccccccccccccccccccccccctcccaccacgccagccacacccgcgcgcccccccccaccgcggcccctctctcccccccacgaggctgtccccccccccccccccccacccaccaccccccaccccaccccaacccaccccccccgacccccacccccaccacaccaccccacaacccacccaccccccccacacgccccccgaccacaccaccctcgcccaccgccacgacacccccccccacaacca

SEQ ID NO: 702003 - DNA, 331 bp, Homo sapiens
gatcttgtgaacacaaaagcgggcgggatcctgagcctgtgtctgcaactacaccacagctcatggcaacgccggatcgttaacccactgagcaagggcagtgacctgaacctgcaactcattgttcctagtcggattcgttaaccactgcgccacgacgggaactcccattatcagttttaatttgcttgaggcaggcccacaacttgcaaataggcatataaattgattgaataacatgtttagcagatttaccagattgagcagtagccccaataaatttagagaaagttgtccgtacacacatgaacaaatgatgattttccacaag

SEQ ID NO: 702004 - DNA, 183 bp, Homo sapiens
tgcaatttataaggagctagctggcccagactgattgttacgctgagtgaacatcgcataccccaactttgtccgctgcatcatccccaaccacgatacgaatcgccggcgagctggacccgcatctcgtgctgaacccgcctgcgctgcatacggttttcctcgagtcgcgtccggtactct

SEQ ID NO: 702005 - DNA, 1418 bp, Homo sapiens
  misc_feature (482)..(482): n is a, c, g, or t
  misc_feature (488)..(488): n is a, c, g, or t
  misc_feature (530)..(530): n is a, c, g, or t
  misc_feature (537)..(537): n is a, c, g, or t
  misc_feature (738)..(738): n is a, c, g, or t
gcatctaactgcctatgaaaactaactaggtacagatgtactatagacataatattcatgtgttgcgagttgccctgtaaccttatggatagcatatgagatgctcaagcgggagttgtaatacagacaacaatcggtacagaatcgaactagagtccacctatccagtctgtacgaggaaatggatcatctcacattctgaactcggatggtgcgcatacatgcggaaatcgtgcatacaaaagtattgtctgtggaagctagtgaagtatgtaggcgtaaattgaaagaattattgtatataggaatagtgttataattactatatatgtcgaattaggccacaggttaacttgtagtgtgtactgttcaaaaataattcacttagtgtaggataatatatagcgatttgttctaattctgctattcagtacgatggcaaaagagatgtaagcacttagcaatgtcacagggaacattcnagaggnacacaggaggggtctcggtttttgcttgtctaacaactcagncaatctnagaagtgtgaatatgcaggtttaatatgataactaaggttccgatagtcaatagggggtaagagaaaaggtagttaaagtcgtcgcgaggaagattgtaaaggagtggaaatcctcaatatttccatgaagtttgcattcatactaaaagtatttgccctacgggcatagcacgataacactggccataaaggcaccaccnagaagttctcaaggtgtcaaaatcctacccgcgctgaaaaaaggcaattcaaactttgtgtgtcccccgcaattcggaggtccaacaaaggaggggggccaagaggctccaaatggaattcattggtccaaattcatgcatatttccaattggtcaggttgtaaagacccaccgtgtgtaaggtgcatggaccgatcaatttgagggttgaaatggaggggctttgggcaaaggcgcaaagttaactttcaggggggtccgggggggttagggggcgaggttggagttacacttccccacgacaaacttggtgggaacaaattgcacaaattacttagggtgtttccttgggaatggacttaatgagagagtggaacaggttgtcttcacacaacaggcgtaatgccgttgggaactggagacacggagaactatgggtcctttgttggccaccttggtgatggggtttctttaaacaccatttcgccagtttactgtggcgtcgcacgcgggcttgggggaccacactgaggggtgggaggtataatacccccatccgggtgggttataatcccccccatggggccccatgttggggggagaaaaagggcggccaaaatgtgccaaagggattaagggcgcgtcgacacgtttgtgagaaaaggcatacaacgcaagtg

SEQ ID NO: 702006 - DNA, 2096 bp, Homo sapiens
tgcagacacccttactccagccggagctgggactgttcagtcactgggagaagggatgtgtgtgtctgaagagcttggttgcagaaacttcgcgggctctacaaactgcagtgcgtgtgatgctgagccaaaagacgcttgtttgctgggatggtgcggagatagcagcaccggcagcgatcacagaaagaaccaaatcactagggaggtgaaagctcgagcagaagggagacgcgtcaatggtataggacatagacgagcaggcgaagaacggatagaaagagaagagaaaagcggcgagcagagagcgaaaaggaggcaaaacacaacacgactacgcgggaacgagggcaggaaatattagcaaagggagtactactgacgacacgaggacaattaatagacacaaacaagaaaaccaaaataacaaaagaacaagcaggcgaagaaacaataaaatatataagacaaacaaagccttatacaacaccatacacacaactaaaaaaaaagaaacacaacataaccatcctcaagaacctaaccagatattatttgctatagaaacaaaactcatgtacataaagaaacattcagtaaaatataaaaacagagacaagatacacagtaattaaacaatagaatacatctaacaataataaacaaacctaatctaaataaaaaaaaatctcaaatcagaacaataatatcaaaactaataatcatgactacaaagaagcaacaagacaaacatagaacgtcgaaataagaacatgaatatctagcatggaagataggataaaagaaaatactatacaacaatatgactcactcaacagatagcaagataaatgttgacataagattaactacgacaaaacaatcacatataaacaaccagaactcataaattcacataacaggaaaatacaatagagacactgcaacgaagaaacatataactagcttaactaagaatacgtagaatcactcaatacaagcgcgcacacacaaaggagaagagatgatatactaacatctaactactcgtacatataaatctagagtgacaagataacaacaatgtattatatattatttatagtcttaaactagaagacgcaaggagagcaggaggaggaccagacgccgcagacgtggagagtgaacgaaaggagagacaaggggtaggagactagtactagcgagaagcgggagagcacagaggcgtcagagagcacgaagagacaagcacagggaaggagagggagcgagaagtgaagctcaagaacggagactagcacacgcgagccgcgagagcatcgcggcgtgagtgacggagatactaacggctgcgcgtacgagcacgtcaacgaagcagggggagtcagaagacagctgaatagaacgagctacggtagacagcagagaaggtcagatggagaccggagaagagaagcagatagtagcagcactacggagagagcggctgagagtagtgggagggctcagagaccaggtcgcgaccatgagacgggagctggtggacgctgtagtagtgagctcatcagagtgagcgtaggcagaggagagtgcagagaggacaggagcgagagggagagatgcgaaagagagggagagaacggaggaagcggaatgagcggaacagtggtacgaggtcggcagcagcagacggagacaagaaggggagatagctaagaagagagtgagatacgacagagagatgaggagagaaagagaagagtgcgcggagctgatggggaagagacgagtaagtagagcagcagacaaatggagacgtgagtagacaaggagagtgagatgaagatagcaagcagagcgaatcgcaaagcagagacagagcgaagaagtggagatggaggcggcatgaatgcgagcagtagcataggacaggcagcgagatgagcgcgggcgagagataggagagtagcaagcgcagcgacgcaagggactgctggagagtgcgaactgaggcgctacgagcgagaagagacgcagaagatagcagcgatagagagcagcaactgagagacacgcagcgcagcgcgatagaa

SEQ ID NO: 702007 - DNA, 173 bp, Homo sapiens
ccctagttcagaagtttcaaatagcatgtgataatgatgtaaactaaaactattttcagcttttctcaattaacattattggtagtatacttcatagtgatgtcatctaagttttaagatagtttacagtttgtcaacgtgtggattcttttacacagggtaccgaggctcga

SEQ ID NO: 702008 - DNA, 219 bp, Homo sapiens
acgctaatgtcgaaatattagatataaaaaggaatggcatactgatacatgctacaacgacaggtaactctaagagtataccattatgcagacgtgacataactaatcactaaatagcacacgtatgcatatattccattgcatactgaaatgtacctgaacagagcgaatccagcagtagacagaatagcatactacactggatggctgccatggaac

SEQ ID NO: 702009 - DNA, 130 bp, Homo sapiens
gttctagaggatattgagagacacggggagaggtgggacaggggaaaaatgttaagaagacacaggatgaattagatacaatggtctcgttcgcttacccgtcaaagtctgcttcaggtgtaacaggagt

SEQ ID NO: 702010 - DNA, 138 bp, Homo sapiens
cattattcaggtttaggcaagaagtgctttatatactttttatatatatttttagagacaggatcttgctctgtcactcaggctggagtgcagtggtgcaatcatggttcactgcagccttgaaccccaaggcacaag

SEQ ID NO: 702011 - DNA, 277 bp, Homo sapiens
acatcacacaaattcaggattgagaaaggatatgggatacatatgaagactgttttgttctcagtctttgagactgagggggcgtatatcacccacgctggagtgcagcggcacaatctcggctcaatgcaacctctgcctccggggtatcaagcgattcttgtgcttcagcctcctgagttagctgggattatcaggtgcccgccaccacgcacagctcatttgtgggatctttactagagacggtgtttcaccatgttggccaggctggctctgg

SEQ ID NO: 702012 - DNA, 1234 bp, Homo sapiens
ctgctacatggcttcagctgcgctaaacatgtgtgttaacagattcatgcatcatacctgtccacgcatcgccatgaccctgggtaccccagcctggggacacgtctaccagcttacttggcaaagcacgagctccataaactctcttcagacacactctctcagcagccgtctcagtggcaaaagcgttaattcctctctacactctacaccacacgctaacccagccactccacgcacgcaagtatcaacacgcgcgcacgcacgcctttcaccacttggcacccagaagacgggcgcaacagctctgcgcctgctactcgacgcgctacgcacgactccgtcctcctgcagcacgaagcgcacgcctcgactggaccttggaactgccacacacgtaatcgcccacggacctcaactggctactctccttgcataccgcacctacactctgccgcgcacctgcacaccgtgacctgcaaccgccacgcgcagccacgctgaccacacgctcggcacaccccacggcaactggcaccgcgcaaccgcctccggccactcgaacgcgcaccacgcagccggcaccgcgacctggccccctgacgaccgcggccaacaccgcccaccggccaacccctgggccacacacgtcgccccacatcccacaccccggccgacccagacgacagcgggcacaaacccatccgccacacccagacaacagcttcaccgcccccccggcccgcagcaacgggcccgttcggaccaccacgcaccaccagtcaccggtcaaacaacctcctactccaccccccacgctctgggcggccacacagcgaaacactcctatgccagctgggcaagccccccgctcgcgctccctcaggcaggtcgcagtacacgatcgcctcggaccgagcccgccatacggggcgcacacctcaccgacgacacgctcacgagcccactccccctcactacggcagccgactcacagccgacccacacacacgcggcacccacacaccgaccctgtcggccatccgacatcgccagccccactctgtgcgccaccgccacccctgccgctcaacgctgcctcaccagcccggcgcacctcccccctgccataccccgcccccagccccgctgctccaccacaactccgcagctactgcccccgcacagcgagcaggtgccacacatccccccccccaccaggcggacccacgcc

SEQ ID NO: 702013 - DNA, 93 bp, Homo sapiens
  misc_feature (69)..(69): n is a, c, g, or t
  misc_feature (71)..(71): n is a, c, g, or t
atctccatacttgaggaaccttcaaaggcacttctgggggtaacattagacagcagactactgcgacananactatccttagatggtaacccc

SEQ ID NO: 702014 - DNA, 153 bp, Homo sapiens
ccacaattgataagaaaagcaaacgaactagtgaacaaaaatgagcagaatatctgaacagtgaacttccccagagaggatattcaaatgggcaataagcctgtgaaatggtgtccaatatcattatccctcaggggaaatacacatgggaac

SEQ ID NO: 702015 - DNA, 252 bp, Homo sapiens
ctagcggagttattccaccagcaaagaccaaaaaaacaagaaataataataataataggctgggcacagtgtgctcacacctgtaatcccagcactttgggaggtcatgtgggcagattgcatgagctcaggagaccagcctgggcaacatggtgaaaccctgtctctaccaaaaatacaaaaaattagccgggtgtgggggtgttgcacctgtggtccccagctactaagtgagaccgaggtgtggaggat

SEQ ID NO: 702016 - DNA, 373 bp, Homo sapiens
cgggtgttatcgatgccactggtgtatatcgatagccactggtgtttatacgatgccactggtgtattatcgatgccacctaccgtggcatgtaccctgatactgtgcaaagacccagtccaggaggcctagggctgaggacgtggacctccgggtgaactttgccatgaatgtaggtacgtggctggagcaggggctaaagcctagaggagcgtggggatgcttgagcattggcttctgtgggactccgaaagtttggggaatagaaaggggaacacacagaccttagtggggcaaaaggcccagcgactgtgcctctcccttattgggaatagttcattctgaatctctcattctccgacagtcctaagct

SEQ ID NO: 702017 - DNA, 521 bp, Homo sapiens
ccttcttccatcatcgaccccaccgccgacgcgtgatcgaggcgatgctaccgtcgtagttacatcgacaccgccaggatgagatctaatgacagaagatgctcttcgcttaaatctgtagaatcggctcttggacccagcagataagcgagatgatgtccgtggccaagcgaatcaaaatggaggggcaatgatggcatggaaggtctgacaatgtcgggattgctcacaaggcaggatttggagaatcttgagtgttgccagagtgagttagccaccaaacaggatggcagtggtgtcacgggctatgaagaaaaacttaacgggaatctcaggcctcatggcgagaacaggacgtgctggaagggcaggcaaatgaaaacatcaatgatgagcctgtggatatgagtgctagacggagtgagccagagcgaggaatgctaactccctcaccagacatcattgttttgtctgaccatgaggcttccaggccccggtccagttcccgaatggaagaaaga

SEQ ID NO: 702018 - DNA, 819 bp, Homo sapiens
tgtggtggctcacatctgtaatcccagcactttgggaggccaatcacttgggcccaggagttcaagaccaccctgggcaacatggtgaaactccccaggcatgatggcacgtgcctgtagtcccagctatgcctcccagctgacatgggaggatcccctgagcccgggaggtcgaggctgtgatgggccatgatcatgccactgcactccagcctgggtgacagagtgataccgtctcaaaaaaaaaaaaaaaaaaaaaaaaaaaattttgggccgcatggcccacaaaaaaagcgttcttagaaacaccatgtggtattggggacgactgcggccccaccataagatatcacggtgcacaggagtggcacatagagccggtacccaagggaaaccgccggcccatgcacagtgagaccgggaatccaccacaccaaagtaaaaaacgccccgggggagcccacgacatgcttctagtgaacacactaccagaagggcgacaacgaggagacaacatcaggggaacctaaccacaggggagcacaaaaggagaccccaaaatacaaaaatcagccccccggcgggggtaacacagcacaggagcgaaccagaacaaacaggcaccaccaacgtgcgagagagtatgaaagagcgccgcatgggagacacgaaaaacaacacacaaaaatggagttaagcacaatcacagaaaaacaagcagaagaaaaaagcgacgacacagacatgaacacatgcactcaatagaagtgaaacaaaggagaagcgaaaaaaagcacgacagaaacagcatacaaggca

SEQ ID NO: 702019 - DNA, 295 bp, Homo sapiens
  misc_feature (208)..(210): n is a, c, g, or t
gcaaaggggccagagaagtgttatcatttctagaagatggtatatgtaaagcacctctatgttcaatataagaaatattggaaagacgtcgtcaccaggaccaaggaaccaaaattgcatcttatggtctcaaggggtcgtgtgttttaagtagtctctgattttcagaatgatgaggttgcatttagaaaattcaagctgattactnnngatgttcagggtaaaactccctactaacttcatggcatggatcttacccctgacaaaatgtgttccatggtcaaaaaatggcaga

SEQ ID NO: 702020 - DNA, 316 bp, Homo sapiens
cctttaaaatacagtagaaggccgggcatggtggctcatgcctgtaattctagcactttgggaggccaaggcaggtggattgcctgagctcaggagttcgagaccaccctgggcaacatggtgaaaccctgtctctcctaaaaaaaaaaaaaaaaaaaattacaaaaaatttgccgggcatggtggtgcacacctgtagtcccagccactctaaaggctgaggtacaagaattgcttgagcccagggtcagaggttgcagtgagtggagatcggcgtgcgtgcacctgcgcgacagagcgagactatgtttttttt

SEQ ID NO: 702021 - DNA, 300 bp, Homo sapiens
cggaaaggaattcccccccctaaggggggggcccccgggggggttttttttaaaaaaaaacctttttggttttttgcccttccccggggttttttttgggaacttttttttggggccccccttggtttttttccgggcccctttttgggccccagaaccaatttagggttttccccccccacttgggggggtttttaaaaaaaccccggtttttttttccctttttttttggggctttttttggggtccccagttggtttttttttttttttttttttttatttaaccccttttttttta

SEQ ID NO: 702022 - DNA, 514 bp, Homo sapiens
  misc_feature (11)..(11): n is a, c, g, or t
  misc_feature (148)..(148): n is a, c, g, or t
aaactttttanactgccgaacccccagggtggccggatttttcctccgggttctcaaaaacccaactgttttggctgggagggcggggtgaattccattgggtgggcctttccttttggaaaaaatttttatccgtcccttctgggantggcccaaatgggcccttgcaaaaattgcccccctttttgggggttttttttgacccctttccttaattgggggggggaaaccccccaaaaattggggggccccgttgccccctttggccaaatggggggggcccaatttgggttggggggaattttttttttccaggccccccttgggggccggggttattaaaagttaaccccggggttattttccccaaaccgggggggggctttcctggttccccagggaggggggggatggtgggggtttcttttccctttttttttgttgggcccaaacctcccctttagtttttttttttgggccctttcttttaattaaaaaatttggggccccggga

SEQ ID NO: 702023 - DNA, 540 bp, Homo sapiens
agtccaaagccgcatgcccaactgcctgcaatttttaccttcttcacaaagagctatccagtctgccctagccagttgctgtctggcccctggcccttcatctccatcctcagacccagggatcttccttcactctgtccgggctcggggtggccatggcctctgtttccttctagcctcccctctttccttcgggaggctgggcataggcagattcagtgctacagaccagcctcagaggggtgggggtatcagacacagccccatccccaggaaggcctccagtgccagtgcagaatggcccatgccctttgcccagccctcaccagacctgtgcccggcaggttcgctaagctctggctcggcctgccggctctgcgctccatcgggctcaaaggccggtaacatctcttcttctccaagctcatcggggacacacccattgaccccttccttatggagatgctggaggcgccgcaccaaatgacttaggcctgcgggcccatcctttgtgccacccgttctgccaccttgcttgac

SEQ ID NO: 702024 - DNA, 1256 bp, Homo sapiens
  misc_feature (139)..(139): n is a, c, g, or t
  misc_feature (240)..(240): n is a, c, g, or t
  misc_feature (1094)..(1094): n is a, c, g, or t
  misc_feature (1121)..(1121): n is a, c, g, or t
ggtgccaagatgcgagtgcgtgactatagtagcaggaagccacatactcaagacatgaaccccgatgaccgataaaggttgaatagcatggttggcaacgcgtggacggcaagtggtatacctcaatgctaaacggctnaaggagagcccatgaaaggagtgaatgaccccaattgactagactcagtaaacacacggatctcatatgctcctactagaccttgttggacagtgatactngcccctgaatctagcacaatgttattccagcaagggagcacagtgtacagactaaggaacgtacgtcaagaccgcatcaaaagtcctaccggtatatgaacccagcaaataaagagagcgacgacacgcggttctcagtcgatacgctgatatactaagaatagcgcgaagatagtgttggtatgagctaagaagagcgggacgggataacccagcgggatggccttagagatcgattcagccatagaagattgctctagaagtatttgatctcttatctgtatacgaatgtttgtccctctgaatagacgccatgctggaagccccatcgtgacaaatacacacactctctttacagttcaggacatcggtttgaaggtacacaaccttgacgggaaagacccaggcctacttttatcgcgcaccaggtggaaacgcaaatatcctggacttctagttccccgtaccaaaacgtagagctaacagacaccaaactttgtggagggcccacacgccacgtggggttgggttgtctccttcacattgaaaacgaccaggcaattgggcctttagattgggacttttgacttttatccttggcttcgacccttggaggcaccccataccttagggcttcaccttccaaagattccggaacgattacccctttccttttacaggcataagaggaaagctaacccaatcccaaggaacaccaccattattggttgccgaaaatctcgggccacaagccttatgttccaaaagcccgattaagagtaacgtcacggaggataacattcctaggggctaggattttggcgtagtaacattataacagtcttcaccaggangatttggcccaggttcccttttaatcnttggagacctttgtccccttgtaaccccttctccaaggacggggataaagggagagatgggagaagaggctttttagcccggtaggcacaaaggggcccccccacaaagggaatggaaacccccaagggtggaaa

SEQ ID NO: 702025 - DNA, 382 bp, Homo sapiens
  misc_feature (176)..(176): n is a, c, g, or t
aaaaatggggtcctgttataaagtttaaaggggggttttaatatgaaaagccaattttgggattttgggactaacgcttaagaaggccggtttttgaggggggggggttataattttaatccccagggccaaaaccccgggggaaatttccaatttaatttttgaaggttgggtangggattggcccccccccccttttggggggggggcccaggcaaagggtcaatcaaacccttgggatgttttggagggcctttgcccccaggtaactaaggggtaaagccggtttttttgattaggggatcaaattttttgaattttttttttgaaggttggaacttaccagggataacccaaaacccataaaataattaacttttta

SEQ ID NO: 702026 - DNA, 282 bp, Homo sapiens
acgtgtgttgcaacgcaagctgctggtacttcatcaccaaatagcgctcgctccttcctgggaatcctttttcctagacttcaccaccaaatcgtgtagcgctccttccttcttcccggcttccttcaccaaattggactgggtcccgggactccttttcctatcttcaccacgaactgctgcttgctcgcttgctcctcagtcctagcttcatcaaacactggttcctggaatcctgtctgctgctgtcttcctagattcactgaatccacttctgtgtag

SEQ ID NO: 702027 - DNA, 260 bp, Homo sapiens
gtcagagcggtcaagttaagttgaaatttcgaaagtgaccagtcgtccaaagcacatttgacaaacctaggacccagccaggcaaatgtcaatatccaaggaggtttgatatgatgcgtggggcccagttactagacttcctagacttaagcaatgcttagaatgcttagaataccatgttatggttggaggtttatagcggggttaaaatgggaatttatgcaccttaggtttagaaatgaggtcaacagtttacctta

SEQ ID NO: 702028 - DNA, 1276 bp, Homo sapiens
tatgaaagacacaggcggagacaggcagtatgaaggatcttgtggaaggaagagggcttagactggaagtttaagtggcagggttgtatattgagtagatagagcagagattaatatttaagaggaaagagttacgcgaaagtgcgttaggcttggggatggggagcgctcgagtcgtcgagcttgtaggacagcttgggatcctttgtctgaagggaatcgatagttacagtggtgacgaacctaccttaggatagaatgtctggcacaaaagatcgttctaactctgtgtacaggaagcgaagagatagatagactgtaaagttcagtgtgtggcttttagggtagtgtcgctcttccaacaacttgaccaaaagtcccaccttcggcccttttagttcaatgggtagtgaggagtagaatgcagacttcacttgtagtttccacccatataatggtggtacgctacttagggatttgccagttttttagttaaattattagtgataggcaaaaatcattccgcataaaattggcatggaggaatttcaacttagaggtgaatttctcgtctttcttccggatataaattaaacttactaggttgataagacgggaggtgtcaccggaggagtaactgcactttttatttcggggagagagttctcaaccaaagggaacaaagttatctaaaagtaagttagaggggaaaaataggaggagtcgctttggcctgggtattaatttcgcggggcaaaaggcaatagattttggccaattacgttaacgggcgggggaaaccgttgtgtgggggtctgggaaaaggcatttctaaatttgtgccgtgggaacgacgtaagtttactttttcgaaaggtgtttggacatttccaaggtgggtgatttttaaacattgggaatggttgtgagatagtgccttaagttgttatgggtctaccgagagggtattttactgggaaaagtttggctaaatttggacagtaataagcgtgtttagtgttcggacctttaaacgaacggtttacgggagtatcacatgggtaagagggctaggggggtatagcatgggggtataattgaatgggcccaggttaaagggtctaatattcgagggtaaaagaggagtccttaaaactaagcaacaatttaggtttcatgttctaaattaaagttgatgcgatatttgtaaaggagattgtaccgaaagagatacttatttgaagggactagtgccgttcggtgttaaaggtgatga

SEQ ID NO: 702029 - DNA, 1025 bp, Homo sapiens
  misc_feature (1007)..(1007): n is a, c, g, or t
ttttccataccatcaataccttgtggctttaaatgtgcatccatctttttctgtaagtattctacaccttggctaaatacttctatccttctcaaggtcccattcctaaaaactatacttcctttctctttcatgaatggggatccacttcctttcattaccccagactgctcttttctcgatcactctctgatcctcttactttgaggtcctatcaatctcataatccacttacatctcttattattttatttgttcttttcgtccttatcaacgttcacctaacttttatctcagatgccttctttcaatccttttctgtgtattgactccttccccaggaagtctcgcctctgcttgagaccctccatctggtacgccacccattgcttgttcacagcgactactcatgttctaactctgttgtgcctacccccaagtaccgcgcgcagtgttcatccggctctgtgagcaggacacgcacgttcgtcctgtatcaccctgggcatctcgccttggcaggagatataggcatgcctcattcttcggcattagactaccgctatctctacatgtggctttcttctgtatggcagttttcttacaggaagttttcagagagctagagaatctccaatatatccatcgatcaatactgtgactggcaaccaattcgcgcgcaggatgaatagatgtgattcacacgtggaaggctactgtactgtaggaaagtccctgagttactcatctcgaggccagagtagaaggatacgcgcttgagatcgctggcactgattacgtttctatcagctctgatgccttcttccctttccgagagaacgtagacagagctaaaaggagtggtgtggcgtacattcgcggctcactccggttctgctgcggacaaagttgtgattgaggccggcgacgtagtggcaatcatccttcggctcataagaaccttcggctcttccaccactgagtttaccacacactgttttttggcntactccggggagtgagca

SEQ ID NO: 702030 - DNA, 327 bp, Homo sapiens
ggcgacgacgtcgcgggttcaaacagttgtcgtggtgcacctccggagtggcggggagtacaggtgcgcacgacgacgcgtgtaatcccagcacgttggggaggccatggcgggcggatgacgaggtcaagtgatcaagagcgatcgtggccaacatggtgaaggcccatctctactaaaaatgcaagaattagctgggcctggtggtgccctgtggtcccagttgcttgggaggctgaggcaggaggatcacttcaacctgggaggcggaggttgcagtgagccgagatcgcaccactgcactccagcatggtgacaaagtgagac

SEQ ID NO: 702031 - DNA, 152 bp, Homo sapiens
tttcgggttaataaatttgggggggcgggcaaacccccctttcccgggttttttggtttgccaaaaaaatttttggagggacccccgttttaattttttccgggggcccagaattgaaataaaacccccaccgtttcctttggcccctttga

SEQ ID NO: 702032 - DNA, 415 bp, Homo sapiens
gggtttggggcaaccccttaaaggtgctgttacttcatgtgactgcagtggcgctgccctgtgtgcatcaggaagcttcaacatattatagttgtttgtttgtaggtttgtttattatgatatacagattatctcataccttcctttcgattttttaaaattttaaaacagatttactgccatggctggaactaatcaacactaatttttctattgtatctgtatatatatatgtatgtatgtatattcacacacatgtataatgtaccttttaaaaaatagatttaggggctacaagtacagttttaatgtactcttttaaccatttttaaatgtacagttcagtggcattaattacattcatgcccttatgcagccatcactgctatttccaaaactttttcatcagccccaa

SEQ ID NO: 702033 - DNA, 429 bp, Homo sapiens
caagagcggaagtccatctccaaaaaaaaaagggagtaaggagggagagatagggtaggaaggaaggaagaagggaagttagctgccccaccatggaaactggaattggagagtgcaataataattgaggggagtttggttcctaggttagtgtcaagagttctgaccagaaactgcaggcctggtggagaggacgagttcactgtgtttagattccacatgtaagtgagatcatgaggtatttgcctggcttatttcacttaacataatgtccaggtttttccatgttgtcacgaatggcaggatatccttcagttaagattcagcaaatattttgtgagtacttattatatgtgtggcagtggtatacaaaattgataaatatgtaggttcttctcttaaaaagcttctattctgttgagagagatt

SEQ ID NO: 702034 - DNA, 367 bp, Homo sapiens
  misc_feature (60)..(60): n is a, c, g, or t
  misc_feature (78)..(78): n is a, c, g, or t
  misc_feature (256)..(256): n is a, c, g, or t
  misc_feature (301)..(301): n is a, c, g, or t
  misc_feature (337)..(337): n is a, c, g, or t
ttacgacaccaaatcacccctgcaaataagcgccttgccccgggaagcggctgcgcggcngcttgaaggctttagccngtcagcacgcggtggtaggcgtaagcgaagcctgcattgccacccatccgagcgatatggcgggtcgcaatgcggttgctggatgcggtggtggaaaccatcacgccggagggaaagactcgcagtatcacactggctgatttttattcactccgggaaaaacgccgcacattgaaancgccctgcttcccggtgagcttatcgttgcggtgacgttacctcncacgctcggcggaaaacatatctaccgtaaagtgtngatcgcgcctcctacgcctttgccctggta

SEQ ID NO: 702035 - DNA, 293 bp, Homo sapiens
tggcacgagagcaatatacacgtgtttataaccatcactgtgaacccaccacactcatgctcataaggagaagggataaaaaagtgtaaagagctctaggcaatgttaacccgcctgtccacagagtttgagaactatgtggcagagatcgaggcggattgcaagcacgcacagatgcctttgtgggacaaaggtgtgcaggaaaatcatgaacatgctgccccttttctatccacatacacggaggatactgtggcgggtttacattgacgggcctgacaagttagcattgc

SEQ ID NO: 702036 - DNA, 553 bp, Homo sapiens
ggcttcatttaacgccagaagagaaactggggtgtcgtcgagcaagtcattatttagcaatgtgttaccaaaaataaagattggtcagagtctgccctccgagagctcatcgtagccaccattgctgtcagagtacactcagtctagactctgtgtgctacgccaagaacgggcgggttatcgcgcattggagcaggacagcagtctcgtatacactgcactcgccttgcagggagataaggcgaaaactattggtggcttagacaccatccaggagagtgctttcgatgaagtttaaaacaggagtgacgagagcagaagatctccaatgccatcgatcaatatgtgactggaaccattgggaggatgaagatgttgatcaagtggtcatggcactgtgtgaggaagtccctgagttactcactgtaggcacgacgaaggaaggaactgggttgagaaactgactgaacgtttgcctatcagctctgatgccttcttgccctttccgaggataacgtagacagagctgcaaaggagtggtcgtcggcgtacg

SEQ ID NO: 702037 - DNA, 619 bp, Homo sapiens
gaggagagagagagagagagagagagagagagagagagagagagagagagagagagagagagagagagagagagagagagagagagcgagcgagagagacacagagacaggttcccccccgaaagtaccccctgtgtcaactccaactcttgtctaggtctcatgatacctatgaaaagtgggcagcctatgttgtatacatcctgtagcaaaaagaatgccctgtgcagaagactatctatccgcggtcctgaaccacttatgtgtgttgcctgagaaaacgccagttagtgacagactcaccacatgctgcacagtatccttggtgaacaggcgaccatgcttttcagctctggaagtcgatgaaacatacgttcccacagagtttaatgctgaaacattcaccttccatgcacatatatgcacactttctgagaaggagagacccatcaagaaacacactgcgctttttgagcttgtgaaacacaaccccatgcctcgagccactgaaagctttttttggtgatttccccccttttgttgacaacttcttcccggcttgaccttaaagaaaccctcctttgcctgggagggttccttttccccctccttggttgcg

SEQ ID NO: 702038 - DNA, 482 bp, Homo sapiens
catccttaccccttatgtacctgaagggtgtcatcccagcacaggctgttagtaccgaagcggaagattcgtgtctgaacgctaatacagtttgtctggacctccttccttgtaataaatcgatctctttaacggtcatattcctcttacgttttctaaaattctcctagtagctttaactgattattcaaaatggagacagtgctttgcttcttgattttaagatttgtaaaatttaaaggtacactgcctttatttgattttgcttggagtcactgtgtgaaaattaattgagcgttgacaatctatagttagtaccagcgattttaatcaatatgcaatgatgcagcgtaatggcaaagtattggtttatctgttttgactgatttttttctataaataaagcaaacatacacccatatatgtatgatttatggtgatagaaataaaacggagtcagactattaacccagcaaatatgg

SEQ ID NO: 702039 - DNA, 460 bp, Homo sapiens
gacaccactagaatgcagatgtatactagaatacatgagctcgtgtcatcacagaagtttgtgacataatccttatactcacccaaccaaaggtggctaggaatgaggtgaataggtgagtcatgtatacaggtgttagttgataaaattgttatctattcccaacgctgcagcaagagatgagacatgattctgttattaaggctaaaatactgcatttctagcaatatttctcctttctgatatccccttacactcaagtgtgcagtacttaaaatagagcctggattgcctattattgtggctttaatcaccctttacttggctatgaaatagttcatttcatacctcttggcattatacaacgatgtattgaatttagagaaggggcatgtgctatcttgcccacttacaaatgtagttctcggccattctatggtagtgaggatcctctacagtc

SEQ ID NO: 702040 - DNA, 399 bp, Homo sapiens
tactgtcctcctgctgagattcggctgagcacgagtggtcacactgagcacgcagaagacatacgcttcaaccgtctacagcagatcaccacacactgagggtgttgccaaaggggtcatggcatgtgtggtggcagacacccattggtgacctggcgtttcttgtatccccaaatcgataggccgtgggacacgtggattctgggggcggggtcccgttctggagtccagccccatccctgactgcgctgggtacgtggtcgctgcgggacccggaccggcggaatcacacgcagagcccccaagcccatggcagggatgtcacccggggtggcgaggctctcaagcccgggttcaggctctcaggggagctggcagaaccaggagcgaacacactcc

SEQ ID NO: 702041 - DNA, 460 bp, Homo sapiens
cacctctccctatacccccacacgagaaaagaaggcccttccaggctaaccctccgctcaccttctgtgatggaaccgatttcgcgtctctccaaattcatatgttgaatacttaacctgccatgcgatccgtgattggagataattcctttagggaagcaatgaaggttaaatgaggtcataggtgggggcttaatccaatgggactggggtccctacaagaagaggaagacaccagagctctctgtctccacacacagagaaaagaggctgtctgaggacacaggagaatgtaatagctgtctacaaaccaacaagagaagcctccccagaaaatgaaccctgctggaacttggtcttggactttccacccttcagaactgggacaaaataacagtcaaactaaagctctcttgcgtaaaaaaaacctaaaaaaaaaccctggcccccttggcctaac

SEQ ID NO: 702042 - DNA, 391 bp, Homo sapiens
  misc_feature (21)..(21): n is a, c, g, or t
  misc_feature (43)..(43): n is a, c, g, or t
  misc_feature (361)..(361): n is a, c, g, or t
ccaacaaagacccctgacacnggtgccgatgtgggtggacagncccaaatcatttgtcacatgtacatcctgtgtaacctacccactgcaatcaggataaagaagtccccatcccccacaaggatctccctcccccaccttcccctaactcccggtaacccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacncctgggatgtttccagtttggggctattcc

SEQ ID NO: 702043 - DNA, 147 bp, Homo sapiens
ggcacctctcttatcggctctctgtcctcctactttgccctgggtctgtggacttactctgggcagatctccacgaccaaccaccccctcccttgtgcatgtcgatcagcacccttgggggaaagaatttggaaagaggagagtggg

SEQ ID NO: 702044 - DNA, 363 bp, Homo sapiens
  misc_feature (53)..(53): n is a, c, g, or t
gggggggggggggggggaaagggccccccccccctttttttttttccctttgnaaaataagggtttttaccagggtgggggttggggccttttaacccccccccccccccgggggccccccttttttttttttttcccccaaccccccttttcccgggggggttttagtttggggggggggggggggtttcccgggtgggaattggccccccccgtttccccggggggtttccccggggtgtcccttttgggggtttaaaaactgggcccccccccaataaggcccctgggggggggtgggggggggccccccggttttttttttcttttttttttttccaaaaaggggggttttttccctta

SEQ ID NO: 702045 - DNA, 463 bp, Homo sapiens
cggtacccccgatgactccacatccgtactggcccacgggccagtacggatgtgcaggaaggcaggctggtctgtttgtgtgctcagagctggtgccaccaagccctcactagcccttgcccaggaagattttgaggcaggcctgatttcctgtatgtcaggaaatcagccaaaccatgaagggggtccttctgcaagattcccagcactgtttggctgccccaggtgactagcccacacccccccggagagaccttggaggcaggaattgggacacagttgatccccaaatcagagaagcccaggggcctgaccccacaggggtggggctagaagcatgtcacacccagagctgggtagtgaccctgtgccagtgaggccccatgctaccacctcaacctcatctgacagcccagagtctgcaggagcgggaggggcagcactacaacccacatccgtactg

SEQ ID NO: 702046 - DNA, 170 bp, Homo sapiens
tcagagagatgcttgcgtcactgttccagcagttcttcaccatgatgtaaacttaatatctgccctaaaagaagtcagggaaataaccgttataagagtggtcctctctaagtacccaaaggtatattggggattaaaccattgggtttggcatttttctcttttttctt

SEQ ID NO: 702047 - DNA, 315 bp, Homo sapiens
aaaaaaaaaaaccccccaagggttttcccccttgaaaaaatggattgttaattttctttcccccctttgggtcctgggtgggggggggattgtaaattttccccctttttttttgggggaggcttgttttgggggccccccaatccccttttcccccgccctgttaaatggggggttttggggccccggaaaaaggggggttttttgtttaatttttttttcccttccccctggaggggaatttgggttttttttctggcttttttttttgttaaatttttttttggggtttaaaataaaaaaggtcccccatta

SEQ ID NO: 702048 - DNA, 518 bp, Homo sapiens
tggaccattactggccgagttatggttgccgttgtagtaagggcaaaattaatatccttgggaccctggagaggttcctggaccttctgggtgagaccaggacgttgggcaggaaggcaggctggtctgtttgtgtgctcagagctggtgccaccaagccctcactagcccttgcccaggaagattttgaggcaggcctgatttcctgtatgtcaggaaatcagccaaaccatgaagggggtccttctgcaagattcccagcactgtttggctgccccaggtgactagcccacacccccccggagagaccttggaggcaggaattgggacacagttgatccccaaatcagagaagcccaggggcctgaccccacaggggtggggctagaagcatgtcacacccagagctgggtagtgaccctgtgccagtgaggccccatgctaccacctcaacctcatctgacagcccagagtctgcaggagcgggaggggcagcactacaacccacatccgtactg

SEQ ID NO: 702049 - DNA, 223 bp, Homo sapiens
  misc_feature (12)..(12): n is a, c, g, or t
  misc_feature (196)..(196): n is a, c, g, or t
ctcgtgcttttncgattcaaactgtgattacatctatggaaaatacagcctttgccgaccaccctctttgtcccgccgccctccgtgctcccctctgttttgtgtacggagtttcttactttgtacaagtccgcagccgcttatgttacagccccgaggccagatgcgtttaaaatcgaggagttctcggagtttngaaagttcgttcccacatgcagggcag

SEQ ID NO: 702050 - DNA, 156 bp, Homo sapiens
agatctctccctgacatcctttcaccttccccttccttccagcttcttctgcctagagcgttcagaatccctacaattttcctggatcagggccatctcccagggacccttttgccttaccaagtaccttttgccctttctccggggcttaggggt

SEQ ID NO: 702051 - DNA, 725 bp, Homo sapiens
aaattgccactcgagatagaggcttaattgtttccacgtttgatcctgttgtgttggaccaacaaagggggcgccaagaaagtgccacagatttgtttaaaaaaacattttgagagggttataattatgaaagggccccacttacttcttatatggttatacaagagtatttttcttaccctccgagagagcgcgggagaaagaaagaccacacatgttttatatatacgccccactgtttgctaacactcttgtgtgttttgtttgcctcggttgtccacgttgcggccacaagggtggtccctatgaacatggcccacgaagtttttttgaccacgagccacgcgttgtggggaagtctccttctttgctgtcgctcattccacacggctctcaatttgttagtgcgcctctctatgagctcacgatataacccctcctaacccctggagtgtagcacttcgcctgggtgctcgtgtttgttgtatttctaagaggtgtagtgctcctctattagaagaaagggaaaaaaaaccccgaggcccaagaatgttcttgtggtctggctgatgagaggccccactcattctggcgaacgcacgtaaaccaagtgaaccgtgactgttaaactagggatgggaaattttgcatcttggggggctggacatttatttatttagttgaagattcactgatccccctttgaaaaacatctttttacctta

SEQ ID NO: 702052 - DNA, 482 bp, Homo sapiens
gtggctttgcagggtacagtcctcctctaggctgctttcatgggctggcattgatgtttatggcttttccaggtgcacagtgcaagctgtcagtggatctaccattctggggtctagaggatggtggccctctactcacatctccattagacactgccccagtagggactctgtatgggggttcccactccacatttgccttctgcactctcctagtagaggttctccatgaggattccactcctacagcaaacttctgcctgggcatctaggtgtttccatacatattctgaaatctgggtggaggctcccaaacatcaattcttgacttctgtgcatttgcaggctcaacactacatggaagctgccaagcactgtggctgaaagggcctctgtagagcccagctcgtgccgaattcggcacgagcgccagcgtgaggagggctgttgtgctgaagcggcggcgggactgcgtggcgtgg

SEQ ID NO: 702053 - DNA, 404 bp, Homo sapiens
  misc_feature (49)..(49): n is a, c, g, or t
  misc_feature (61)..(61): n is a, c, g, or t
  misc_feature (178)..(178): n is a, c, g, or t
  misc_feature (197)..(197): n is a, c, g, or t
  misc_feature (211)..(211): n is a, c, g, or t
  misc_feature (214)..(214): n is a, c, g, or t
  misc_feature (217)..(217): n is a, c, g, or t
  misc_feature (300)..(300): n is a, c, g, or t
  misc_feature (318)..(318): n is a, c, g, or t
aaattcaaaaaaaaaaacgccaaatccctgaactattatatccaacaanacactaaggacnacaaccaaaaaaccctactgaacctattgtcaaaaaccacaaaagcccaacacggcataagcgtccaaaaatggtgctcaccatgcttccagcaaacaggtctaaaaaaccagcttncaaataacagtccccatgnccatccctgtaaangtnacnttagcattacccccaacctcattttagttgcctaagcattgcctgcccttcctgtcaagtctctcccccaaaaaaaaaaaatnaacattccaagaagttgnaagtgaagtctataatataaaacactttgcctcctgtgaactgtgtcataaacaaataaataaactgaatttggactttaaaaaaa

SEQ ID NO: 702054 - DNA, 874 bp, Homo sapiens
  misc_feature (874)..(874): n is a, c, g, or t
ggaccgcgtgggctcgcctccctgggactaggtttcagcggcgctgcctatgaccaaaatacaggcagatcccgacggcccgaggtcaggcggacgcgctgtgtccggtggagcgcacctaccaggagctgctgggtcaaccagaaccccatcgcgcagacccctgggttctcgccgcctcacgcggaggggtctacgaatgcggtcctcgaaggcgttggggcagaagcagattcggcagcgggggtgaagaaaggttcacgaatgttttggcgaacaactggcgcaccggggactcatggttttgcgcaggagaaccatactgcccattgaggtatactggcatcctcccagtcatgtgtgatggaccgaatatttggcccgaatgtcttatatcccctctaagacggaactggtttgcagcctgcaaggctccagagctggggcccaccgtgttgtgatactgggtcaagcccaatgagcagtaccacggacggcttaccgagggaggtgctggcgggagggtgctagtctcttgcacgcgtaaccccataatgagggggctcgggtaagcacacgtgccgcccttgcccgtagagggcaaatagcgcgttggcagcgtgcgaccacgctggtgtcctcctggcccatcgagcacgtggcggggtccttcccatgtgcccaaaggagcggccttcattccacagagaagtctaaacaggccctttcctggaggtgagtggttacgcttatctaggcacaaaactgcattttctggtgaattaacggctctccactatttgggggggccaaagaacgtagtgagtgtacaagaacagagaaaaattggtgggcacaccccgaatttaagacn

SEQ ID NO: 702055 - DNA, 309 bp, Homo sapiens
  misc_feature (46)..(47): n is a, c, g, or t
  misc_feature (153)..(153): n is a, c, g, or t
cgtgtcagaagactagaagtttcgggccgggcgtggtggctcaccnngtggtcttggcgctttgggaggccgaggcggatggatcacccgaggccaggagttcgagaccagcctggccgacatggtgaaacccgtctctgcaaaaaatacaanaattggccaggcatggtggtgtgtacctgtatccccagctactgtgaggtctgaggcaggagaatcgcttgggcctggtaggtggaggttgcagcgagctgagattgagctgttgcactccagtctgggtgacagggcaagactccgtctcaaaaa

SEQ ID NO: 702056 - DNA, 414 bp, Homo sapiens
  misc_feature (64)..(64): n is a, c, g, or t
ctacggaaaccttaattttaacccccaaaagaactgtcgttaaaccctcattccaaacagacanaggccttatactggaataatggaatgttgtacattccatcataatttaaaattaaattctaagaagaggctgggtgcagtggctcacacctttaatcccagcactttgggaaagccaaggcaggaagactgcttgaaacccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtctta

SEQ ID NO: 702057 - DNA, 278 bp, Homo sapiens
agcccatcacccaacacactactctactaacatgtagtaagagcgagtttttatctgacagcctggactcatcagggaatgaagatctttctgccgtttcgtttagtttctgcttatgttttttttgagataggatctcgctgtgttatccaggctggtctcgaactcctgctctcaagggatccttccacttcagcctcccgagtagctgtgacaacaggcatgagccaccccacctggctggtttgctgtttttttgtttgccttgttgttttgac

SEQ ID NO: 702058 - DNA, 114 bp, Homo sapiens
  misc_feature (81)..(81): n is a, c, g, or t
catcttcatcaggattattaatgacctccaagcccgcttcaataacttccaccaattcatctcgtttgtctccatctcaanaaaagcctgacttttcatcctcatcaatagata

SEQ ID NO: 702059 - DNA, 174 bp, Homo sapiens
atccccatacaggatctggactgaaacccatgcagtcgatgctccaactatacaaattatgtgcatttatgatccatgatacctgaatatgagatccgacgtactacttacaagacctggtgaaggtggacgtgggctcctatggacctccactaatcaccagaacaaaatgtg

SEQ ID NO: 702060 - DNA, 375 bp, Homo sapiens
  misc_feature (39)..(39): n is a, c, g, or t
  misc_feature (273)..(273): n is a, c, g, or t
  misc_feature (363)..(363): n is a, c, g, or t
ctgaaagcgtgccaccccggagtcttccctttgccatgnataaaaactttggtctcccacaacccccttatccataaccctagacactcctttcctagtgataataactctttcaaccaattgcccaataaaaaaattttgaatctacctataaccctggaacctccccgctccaccttcgagttgtcctacctttctggacagaagcaatgtggatcttgcatgtatttgattgatgtctcatgtctccctaaaatgtatacaattaggctngcccagatcaccctgggcacatgttctcaggccctcctgaggtctctgtctcgggccattggtcactcagattcggctcagaataaatcncttcaaatatta

SEQ ID NO: 702061 - DNA, 439 bp, Homo sapiens
taaattctttaccttttacagatgttctaccacgatatttagctgacgcaatagctctcgtttattccagccaaagtatatgcttgcttcatttgtcgatttaaacgcaataccatcaacgataacactttttgcatttaatggctgctttcatttttttacttttagtcatttcatttgaccaatgttcgtcaaattgttctttgcgactaacccatgctaagttgtcagcattgttattttctgggttatggtcgatatgatggacttctgacttattatctgggttctcaacgaaagctaatgcgacaagccttgctaccgtctttgtcgttcgttttgatttgttagataaactaacggttatttgtttgtataaacgtttcttgctttgtcgttgttttaaattctttcttcaacaatacggtttttgccatat

SEQ ID NO: 702062 - DNA, 146 bp, Homo sapiens
gggagtattaagtggagtcgaaagaggtattttacggtaaaagctatggtgtaagctagtcatatgaggtggtgggctcaggagttggatagttctggggcagtgagagtgagtagtagaaggtttagtgaacccaggatgtggga

SEQ ID NO: 702063 - DNA, 321 bp, Homo sapiens
  misc_feature (12)..(12): n is a, c, g, or t
  misc_feature (245)..(245): n is a, c, g, or t
tgggctgccctnccccattccccttccatagtgtccctttgatgtaaaaaaagttttaattttgatgaagtttaatttatgttctttcttttgttgcttgtacttttagtgtcataatcaagaaattatcgccaagtcccaatgtcatgaagattttcctctatgatttttttttggcagggtcttgctctgtcactcaggctggaatgcattggcacaaacatagcttaatccagcatagactncctgggctcaagcagttctcatgcctcagcctcctgagtactgctgggactacaggtgtacactaccatgccaggc

SEQ ID NO: 702064 - DNA, 247 bp, Homo sapiens
tgagcaccatgctgctcagtcttaacattttaaataaaagtcgaaagtaccaagcagtcaactaagctgttcattccctactggacctatctcagtctctggtgctgctctaatgaaatacttgaggctaggtaatttataaacaatagaaattaatttctagcagttgtggaggctgggaagtccaagatcaagccacctgcagatttgatgtttggtgaggacccggtctctgcttccaagatgg

SEQ ID NO: 702065 - DNA, 581 bp, Homo sapiens
catgcctgtgttgggttgacagtgagggtaataatgacttgttggctgatgggaaatattgggctgctaattgtcagttcaccgatttaatctgacgcagtcttatgcggaggagaaagcattcatgttacttatactaacattagggtcttctatagggtgatcgattgctccaatcgggtgtgaggagcacagttatatgtctgggattttaccagcaaccgcgtgttgagcttgaacgctttcttaattgatgggtgcttttaggccttctatgggtgttaaattttatactctctctacaaggatttttcctattgtccacagagctgttcctctttggacttacagttaacttgacaaggggattgaaaggtgtctgtggccaaatttaaagttgaactaagagaatatcttgggcaaccagttttcaccaggctggatacgtttgacgactatacctatagatcttcccactattatgctacatagacccggtgtgctcttatagctgttcttaggtagcttgtctggttaccggagtcttagctttggctctccttgcaaagatatctctagtt

SEQ ID NO: 702066 - DNA, 576 bp, Homo sapiens
cctacagaagcagaaagggcatggggatttatgtttagaagcagaaaggggaatagggagtgaacgtttactcaatagagtttgggaagatgaaaacgttctagagatgagtggtggtgatgccacataacaatgtgagggtacttaatagcactgaactgtatgtttaaaatggcaaaaagggtaaattttatgtgatgtatattttaccagaattttttttttaaaacttactgcatggggaccaagcgtggtggctcacacctgtaatcccagcactttgggaggccgaggcgggtgggtcacttgaggtcaggagttcgagaccagcctagccaacatgttgaaaccccgtttctactaaaatgacaaaaaatgagccgggcatggtggcatgtgcctgtagtcccagctacttgggaggctgaggttgcagtgagccaagatggcactctgccggggcggcagagtgagacccggtttccaaaaaaaataaaagcttactgtgtggtttcatatacgtaaagtttatcaactggcaaaactaacatatgtgtacggtcagaagtcaatgta

SEQ ID NO: 702067 - DNA, 552 bp, Homo sapiens
cggggcggggcgccgggagcaggatgcggccgcccgtaattaaatagcatttactcttattattactaataataataacgtaatcatacctctagtcatagcataccatttatcgggctcggcgcaggcccgcggggagcgcagcccggcggaggtctccctctgatgccgagccgaagctggacggtactgctgccatctcggctcactgcaacctccctgcctgattctcctgcctcagcctgccgagtgcctgcgattgaaggcgtgcgccgccacgcctgactggttttcgtatttttttggtggagacggggtttcgctgtgttggccgggctggtctccagctcctaaccgcgagtgatgcaccagcctcggcctcccgaggtgccgggattgcagacggagtctcgttcactcagtgctcaatggtgccaaggctggagtgcagtggcgtgatctcggctcgctacaacctccacctcccagcagcctgccttggcctcccaaagtgccgagattgcagcctctgcccggccgccaccccgtctg

SEQ ID NO: 702068 - DNA, 483 bp, Homo sapiens
tccaatatacaaaaccaaaccctttgcttggaccaccctctatcataacctttgcactattgattgtctcaaattgagaaaaatcttaccagagacgttcatcatccataccatcatcaggatctttcacataaagattaacagccaggtatctggtgatcctatcttgtttcatctgttcaaatttgcgcttaagttccgtctgccgttccaactttttctgagctcgaccaacataaattttgttttccattgagctcctttccgttcatctgatccacaggtttctgtgcatcttcatgcctttcaaagcttacaaatccaaatcctttggatttccagtttcatcagtcattagttcacacttaaggcaggccaaactgccaaagagatccttaaggcgctcatcatcatgtcttctccagaatcttgatgtaacattggtgtatcttatgcctagctcaagtcaggtctcggtcttag

SEQ ID NO: 702069 - DNA, 1019 bp, Homo sapiens
ttagccatggatcaaccgccaccgtgttcttacgacattgccgtcgacggcgagcccttgggccagcgtctcctttgagctgtaatgcagacaaggtcccaaagacagcagaaaattttcgtgctctgagcactggcgagaaaggatttggttataagggttcctgcttacacagaataattccagggtttctgtgtcagggtggtgccttcacacgccataatggacactaggtggaaagtccatctatggggagaaatacgaagatgagaactatacatcctaacagcatacgggtcctggcatcttgtccatggcaaatgctggcacccaacacaaatggttcccagtctacaccatctgccactgacaagactgagtggattggatggaaagcatgtggagaaaggcacagtgaaagaaggcatgcatatgtagaggccatggagcagcttagggtaaaggactggaaagcacaacaaagaaggatcaacattgctgactgacggaccccgtcgcaataagttcagcaacatgctgtatatctctataaccgaacacgatcattcctatctgtagctccaggacagcacccatcaaacaccaatatgcacaacaataatctctacacatcctatatgagccatctagacatgtcaagtaccaccaagagaatacaatgtatacccttgtatcccctcccaaatgacctaaccttgacataggcaaacatataaatacatcatcaatgacacacaaacaacacacaaataaacaaatatggtaccattcgataatggaaatcaatcaattaagaaaaagatgtgttgcctgctatcatatgaattatacccatcgggagggagcccgcaaaggtatagagagatccaccgagtactttagaacacaacatggatacacatataggatacagcgcaacatatctataatgtaagtgtactgagatttcacaagcaataagtaacgggaaacaggagaaggtagaatatttagtaaag

SEQ ID NO: 702070 - DNA, 281 bp, Homo sapiens
aaaaaaggggggttttttaaccccccccccccccccttttttaaaaaaccccgggggggaaaaaattttttttttttccccaaaaagaaaaaaaaaaggggttttaaaaaaccggggggggggttttttttttttttttttttggaaaccccccttccaaaaaaaaaaaaccctttaaaaatttaaaagaaaaaaaggggacccccccaaaaggggccaaatttttttaaaaaaaatttttttttcctttaaaaaaaaaaaaaggttttttaattttttta

SEQ ID NO: 702071 - DNA, 762 bp, Homo sapiens
tgccgaccctccagtttatttgttcattaatttaatttatgttggtaaacttatctaactcctacatgtgctaggtttaggatccaaagacaaatatttcagacgagctggatagaaagacaagtgaaaagctcacttcaataaggtctggcaagtgtgacactagagagaggcacagcaggccgggagaacacactgggaggcaccaagtgggtcaacatcaggggaagtttagagtcaggcagccctcaacttgagcctttgctttgttatgtactgtgtggggtgtttggcaagttacttaaggtcactaaatctcagtttcttcaggtgaaaagtggagatattaggtgttcctatcttaggggcattgtgaggaataaatgaagctgtgtgcagaacagctacgtagtatatgcctggcacaggataagtgctcagttaatgtgaggtattatcactattattttttatgtgtatgatttcatggcccatgtggtgaattgtttgagctatgtcatgacagatatataatgtcaatttaactaaaaattttcatttgtatttcttgaactcatagaggttcaggcttagcacataatcacactcctcaagaacatctcttatttttcttccccatctacttctattatgcattcaggagctggccttcctaagacgcttcattcaaaactatttttggttctcatccattttgcccctgtctcatagccccaaagtggtgtcacaaacctatgagac

SEQ ID NO: 702072 - DNA, 803 bp, Homo sapiens
tactctttgcccttacggggcaccacccgccgccgtggtgtgtgctggtgcagcaccctctcctcgcctgagtcgctagcgcgttttgtggtgaattctcacgccccccccttttgtccacggattattttggtacacacagcgccgcgcggtcgtttggtagtcatttgttgccgtcctacagatcgagcgtcccgtggccggttcagtttctggcggcacccactggggaccccctcccctgtggtgacaaaaagcggtctgttcccgcacggggttccactttcgtgtggacagctccccccactatatgggcttcctgtggtccgcggtactcccggaactccccatggcggcacaaatttttactatgggcccccctccctcttgttgggacaatattccgtgggtcctctcgtatcatctgcgcgacgtttggttcttgtcctccccagtcaatttccccggcctcctattactcggggtccccgcctcccggcccatatctcgttggtttgtggctccgctgcttgggactccgctgtctccaggaggcggtttttgctctcttcacgaccccctcgggtggggggctctcgaggtggtggcgatgtccctcgcatggaggcccctcgtcgatatctagaacagccggtcttgagcatatttcgtgcccactaccgccctggttatatgcaggtttcacctgctccccggtcttgttgttttctcctgaactttccccgtggcctgtgtcccccggcatttttaaaaaaaaaaatcttgtacgtacaaacaaaacg

SEQ ID NO: 702073 - DNA, 166 bp, Homo sapiens
ttttagctagagaacattcttctcatagatcactgagtgcactttcctatgcacttgccttggcacagagaaaagcaattcgtctacataagtcttctacatacatttgtcacgtttccatgtggaggagccacctaccatcgtggagagacccctgtgtaccgag

SEQ ID NO: 702074 - DNA, 119 bp, Homo sapiens
caccgctcattctccttcttcttcttcttcttcttcttcttcttcttcctttcttcttctccttctcctcctcctcttcttcttcttctttttgagtttcactcttgtagccaggctgg

SEQ ID NO: 702075 - DNA, 341 bp, Homo sapiens
tacttccacgggcagttaaagcatgctgggagacacatgagagagagggagaaccatctctgggttcctcagacagaacccggtggagcaggaagcacccacgtgtgcctgccagctcccttgggcatctacctgacttgccaacagaccagaagttggtggaaaaactcattgtgttggcctgtttatccagcaggggagcacttgttctgccaagttctgaggccccacattattgcctccagctgccactcaagggaacaaaatcagagtctatgtggctagtgtggggtgaggaggaggaggaaaagggagcaggagaaggaacgagaatatatggg

SEQ ID NO: 702076 - DNA, 1129 bp, Homo sapiens
tcgccgtttatttctgggcccgtcggctaccttcttcgttcctctctctcgtgaccgctcgtgctgtctcgctacttcgtccctcggtgccccgcctctcgttctgttttctctctctcagttgtttcggtcgtctgtgcctctcattttgttattgtcgcgctcttctttgaatctcttggagtcctttttcgatctggacttggtgcctcgtcgggcctgatccctgtgctgattcaggttacccgtccgtaccgtgctggtgcctggtaggcccgcggtgcgtggttgcccttgggttatttcattcgatggcctcgcttgcgggttttctctgtcaccgtagcttgctttttgtctaggcgtcgttcgatgtgtttggtttctgaggttagcctagactcgatgtgttcgtaagcagcctgtcttctagccttggagacagggctacgaaccttggcctgtccagtgcgtacgcttcccggtacttatctccgctaactggtatcatccatggttgcgagttctgcactggcatgtagtggtatgcttaagatgtcgattgaacgacagctattcccagtacatggatagctttttgtaaaaactcagatccagttacatgtattagtgatttgttctaccttatggtactattttggcagggattaagctagtaagactaagactatgaatgtagtagttgggcgaaggagcaggtatagggtatggatacctgcacaccacattggtacctgcacaccactattaactacatataggcaatcttctggctcggactgttctttactactgttcgttaaagtaataatgtgtcattctgctgcagcgtaactagcctccatcttctacaccaaatactattccatgtccatggatagtgctatgctaataactctcccaggtagcaccttatagccgcttaaaagcctttaaaatctccaatgctgaatggtgtcacagtaaagataatgtagaacacttaggaagaacagaagaatgtaattacctgatgaagtcatctatgtccatggaacgggcccgtttgtcactaaaacctgtgctggttaggatttgctgtattttatctaactactgctgaatcttc

SEQ ID NO: 702077 - DNA, 385 bp, Homo sapiens
cccaccagtacttgaccaattttcatgtattcaagtcttggagttttgggtttaacgggtattaattgacttgtcgctttattagaagagagttttacctaaagaagccaacatttgagttggttgcagcatatgagaagagacactggtccttcttgtcaaaattaagcaactattaagagcgccattttatttatgtcatttaaaaaataatctatgcagcatttcaagagacaaccatatggtgttgtatattataaactggtgacattctactattgagttatgtacaacattttcattttgtatgcttcttgaggtggtaatgagaaaaagttttttaaaaagtgtgccttgctgtattcttataccatttattaaaagc

SEQ ID NO: 702078 - DNA, 164 bp, Homo sapiens
gtcgtctctaggaggatccccccctcgaaacccagtataaggactttgagttaacattattttttaaatcctgtaggactagcatttaattagactagctgtacccaggtgcttacacagatagtggattccggtgtaactctacggaagacagctagcagaca

SEQ ID NO: 702079 - DNA, 113 bp, Homo sapiens
atggctttcagtgctccaagaatgctgcccaatacttcagtgttactcttcacccaaatactcatacaatacaacacccaatgtgtcccatcaatacattctccaactcatat

SEQ ID NO: 702080 - DNA, 428 bp, Homo sapiens
tgctctcgacgatccctcactaggttcgcaggtggagagtacagacatggacgatctccagccgtggccttcttttggggctgactctgtgcacagacaaaacagaaaacgaagtcgcgcctgttgatgcccgccctgctgccgaccgaggcgtgcccactcgaacaggttctgggttgacaaatatcaagacggaggagatctctgaagtgaagatggatgcagaattccgacatgactcaggcatatgaagttcatcatccacacacttggagtactatgcagaagcatgtgggttcacaccacacggtgcaatcatcggactcatggtgggcggtgttgtcataacgacagtgcatcgtaatcaccttggtgatgctgaacaagaaacagtcaacatccatacatcatggtgtggtggaggttga

SEQ ID NO: 702081 - DNA, 230 bp, Homo sapiens
gcccttgccgcccaccccccttaacccttttcccccccatggaattattattgtggccgcgaatggcagtcattaacccatttgctggggcccttccccaaattatttaaatcccgtgaaagatctcccttttgccccttttagggaacccttgttgaaggggggggggggggggaaccccttttctccactttttgttttcccccgtttggttttccccccttcccggg

SEQ ID NO: 702082 - DNA, 318 bp, Homo sapiens
ctattttacataatggttattaaattttattatcacaacctgcatctttcactgctatttaagcaggggttggcaggctttcttctgtaaagggccagataataaatattttaggtttctgtggaccagaaggtttctatcacaagtactcagctctgctgtttgtagagagaaaacagtcataggcaatatataaacaaacgagcatggccatgctccaataaacttaatttgtaaaagcaggtggctgtgaggccatagtttgccagctactcatctaaatattgatacagaggattcagatattctaaagctata

SEQ ID NO: 702083 - DNA, 274 bp, Homo sapiens
gcacaaggtgaatcggttgttctttcctcccatttggatgattgtcataaggtttttagcatgttcctcctttttttccccctcccctttttttttttattaatcaagagaaacttcaaagttaatgggatggtcggatttcacaggttgagaattggttcccctccaagcatttcatgaaaaagctgttttttattaatcatacaaactctccccatgatgtgaagagtttcccaaatctttcaaaataaaaagtaatgacttagaacctgca

SEQ ID NO: 702084 - DNA, 213 bp, Homo sapiens
  misc_feature (94)..(94): n is a, c, g, or t
  misc_feature (212)..(212): n is a, c, g, or t
gtgtcacttactttcattggactgctttatttggcttgggaggcacctcttagactctgcgttgtggtttttctagagtaagatcttccagggnctgactacattctggagttcccttacgaacagcttctcctctgtatattttttctgtttcctctttaagtttcttttccttgtattcaaatttttctttcacttcttttacttgtgtnt

SEQ ID NO: 702085 - DNA, 108 bp, Homo sapiens
cagaggtgcagtgagcaagatgcacactgcagtctgctgggtgacagagctagactctgtctcaaaaacagaaaaacaaaaaaacaactttccagtggcttctcactg

SEQ ID NO: 702086 - DNA, 289 bp, Homo sapiens
gtgggctccctgggtttggttttttttttaaaacttgggagcccccaaggaagggctaatgttggtaggttctaaaagtggtttcctccagcctccccaaaatcaaccctggtgtttaaaaaaagtccttttttccattgtgggtaacaacctttgggagggtgcaaaacttttcaaaaccatgggccaggtgggggtgcctcagttctttcccctttggcccttaggaaaggggcccatttccctttttcctaaaatgcttttgtaaataaacaaatggatcccttga

SEQ ID NO: 702087 - DNA, 302 bp, Homo sapiens
caggcatgcagcttggctccaccttactaccagactaaccttagccgaaaccactttacccaaataaagtatagtgcatagaaattgaaacctggcgcaatatattcgtaccgcaatggtacagatgaataattataacctagcatcatatagcaaggactaacccctgataccttctgtcatatgaattaactagaacttactttgcgatggagtagccttgaggctaagaccccctagatcctagcttgcatgctggggtaccgatgctcgaagttctgttctcatagtcatcgctattt

SEQ ID NO: 702088 - DNA, 463 bp, Homo sapiens
tcctgaaagcagcctgctgagggagaagactcgcatgaacccgggagggggaggttgttgtgagcggagatcgtgtcattgcactcccgcctgggcgacagagtgagacactgtgtcaaaaaaaaagaaaaagtgcttaagcttggtcaagtcactctgaagctatcgggagaaaaatgaagtggccctaaggaaaacatagccaataaacccaaggaaacaaactagttaacagttgtcactacagaaagaatcccccacatagaaggcatttggacgatcaatatgcagtggaaggccgggcgcggtggctcacgcctgtaatcccagcactttgggaggccgaggcggtcggatcgcgaggtcaagagatcgagaccatcccggccaacacggtgaaactccacctctacgaaaaatacaaaaagtagccaggtgtggcgggcgcacctgcaatagagct

SEQ ID NO: 702089 - DNA, 387 bp, Homo sapiens
taacagatcttactggagagtcccttgccgagcttaatgtcataccacacctccccttggcaggcgatagacttgacacataggctccagagtctgatacagtgtgaaccagccacggattccccaagcaagactgatcatctatattgaaggtagtcacatcctgagggtactgcacccacagtggcctcatgacaggaatgccttcccgatgtgcctgatataagagggtgtacccagaagggcagcaaagaatatcgctttcccaaggcatctcggattatatcattgtgctgagattgtaacagcccatggatctcgtcgcccagtgtcccaagtggggcatttgcccggaaagaaatggctggtaagcaccccatctggtac

SEQ ID NO: 702090 - DNA, 142 bp, Homo sapiens
tttgggtgctgccctcgagtctgcaggtaagctggccgagctggaggaggccctaaagaaggccaagcaggacatggccctggctgcttgagtgaggtaccagtgagctcatgacacaccaatgctggccctgtgacgtgga

SEQ ID NO: 702091 - DNA, 167 bp, Homo sapiens
ccttaagtgcagtgagtgcatgctgatgaatatagcgcccctttcaaaaggtgagttatgtagtacacacagcccagccttcgatagggaagccctgggaggagatgtagtggtagtcaattgctgaacaccaggaaagagacttggtgaaagaaatccggccgagc

SEQ ID NO: 702092 - DNA, 476 bp, Homo sapiens
  misc_feature (41)..(41): n is a, c, g, or t
  misc_feature (73)..(73): n is a, c, g, or t
  misc_feature (76)..(77): n is a, c, g, or t
  misc_feature (93)..(93): n is a, c, g, or t
  misc_feature (96)..(96): n is a, c, g, or t
  misc_feature (101)..(101): n is a, c, g, or t
  misc_feature (112)..(112): n is a, c, g, or t
  misc_feature (121)..(122): n is a, c, g, or t
  misc_feature (126)..(126): n is a, c, g, or t
  misc_feature (151)..(151): n is a, c, g, or t
  misc_feature (153)..(156): n is a, c, g, or t
  misc_feature (159)..(159): n is a, c, g, or t
  misc_feature (165)..(165): n is a, c, g, or t
  misc_feature (174)..(174): n is a, c, g, or t
  misc_feature (196)..(197): n is a, c, g, or t
  misc_feature (203)..(203): n is a, c, g, or t
  misc_feature (264)..(264): n is a, c, g, or t
  misc_feature (333)..(333): n is a, c, g, or t
  misc_feature (414)..(414): n is a, c, g, or t
  misc_feature (460)..(460): n is a, c, g, or t
gggattggttaattttggtataaaagcagcacagcaggccnggggaaagggtgggggcaggaagcagccgggntcnntttgggcctccctgtngcnttggnagggcccaganatccaaatnntaanttcccaacctcttcagaggttaggntnnnnggngggggnggggagagnggttatcaccacagagaccttnnggggtnggagggcagagcattatgacagaggctgtaatgcaagtttgtgtggccaacagaacgtagnttcccaacttctcccttcgctggtctctagggtttcacagccacttgccctagttctccttttttgggncctggaacacaggaggactcttggcccacattcttcttctcctgcatctgtttcatggcatcagccaccttctcgaagggncagactgagtcaatgtggggcttgatgtggccctggttgtacagancaggaggcgggcaaca

SEQ ID NO: 702093 - DNA, 308 bp, Homo sapiens
tggaaatatatatcacaaagcccctgtaggaaaagcccagacaattgttgcatcacctgggtgagcagtggatagatctgtctcaatgcccctgtaggtagagcttagacaagtgttacatcacctgggtgatcagtgcagggatatgtcaaaaccctcctgtaggctgaccctagacaggagttacatcacctgggtgatcagtgaagagatatctgggaattcccgtgtaggcagagtctggacaagtgttacatcacctaggttatcagtgcaggtataagtcataaagcctcctgtaagcagag

SEQ ID NO: 702094 - DNA, 163 bp, Homo sapiens
gctatcataatataaagtatactacgtactactataaatagctatgagtatgatacataaatctgttatgttaaattttttataataaacttttttgtttgcttcctgggagcatacactcaagtgccctgaatatacattccctatttttaatttttaaaat

SEQ ID NO: 702095 - DNA, 442 bp, Homo sapiens
attgtaggctttattagggctgtcttacagagatcatgttggcatagctgatcatgtctttatcataaaccatgtcgttgaggtagaagaatcaccatatcattcgtcgcccaaatcgggactatatgagagagaaaggggatgctattaattacaccagatcaaaaggcataaaccagacctgtcccaggccgagtgtggaaatatgttctttctagttgtgggtaccctgatctaggtggtttgtaattgtgcattactgactgcatatgtttgtgtatgtgtaactgtgggctccctgttaagtggggctcatggatacgaggcctgaggaagtgtggcttgctagtctgttacgttaacatgcttttctaaaattgcttcacgtgttaattcatttactcctgcattcattgactgtttatgtacttttccattctat

SEQ ID NO: 702096 - DNA, 388 bp, Homo sapiens
tacgctgttcctttagagctgtcaaatttccttgacttttcatgttttctttgttcctatgttgatatctatacatcggtatagcagttgcttcttccaaatttttgactttgcttctgtagaggactttttcctgaaggtgtgtctatgatgctggttgggtaggacactttccctttgattctgggtgtacgcagtagcatactgtatcatttattcagtagtaaatggagtcaatggtatctgtgatttccttggtggcttagagtgaggctattagtggaggctttggtgatgttttgctggagcctggtatgccatgttggttagtcttttgactccattactggcaacagtgcgctgtgtctgcacttggctcaaggcaagg

SEQ ID NO: 702097 - DNA, 699 bp, Homo sapiens
  misc_feature (11)..(11): n is a, c, g, or t
  misc_feature (206)..(206): n is a, c, g, or t
  misc_feature (217)..(217): n is a, c, g, or t
  misc_feature (324)..(324): n is a, c, g, or t
  misc_feature (332)..(332): n is a, c, g, or t
  misc_feature (387)..(387): n is a, c, g, or t
  misc_feature (429)..(429): n is a, c, g, or t
  misc_feature (439)..(439): n is a, c, g, or t
  misc_feature (451)..(451): n is a, c, g, or t
  misc_feature (467)..(467): n is a, c, g, or t
  misc_feature (479)..(479): n is a, c, g, or t
  misc_feature (486)..(486): n is a, c, g, or t
  misc_feature (515)..(515): n is a, c, g, or t
  misc_feature (526)..(526): n is a, c, g, or t
  misc_feature (536)..(536): n is a, c, g, or t
  misc_feature (538)..(538): n is a, c, g, or t
  misc_feature (542)..(543): n is a, c, g, or t
  misc_feature (640)..(640): n is a, c, g, or t
  misc_feature (699)..(699): n is a, c, g, or t
caaaggcaaangaaatctgaataaactaaggactttagtagtaatgtatcaatattggttcattaattgtaacaaaggtaccacactaatatattaataataggggaaactgtgggagggtatgtgggaactctctatcttctcaatttttctgtaaatttaaaacttttctaaaaagtatctaattttttttaaaactagtttgngagtccatagnttttaggagccattggaattatatcaaattttaagtattggtcacttagaccttgtgtgaatgctgacttgttttaagagagggagagtgtcttgctctgttgccangacagagntcagtggtgcaatcacagcgtactacagctttgaactcctgggatcaagcagttntacctaagcctcctagtagctagcaatacaggcacaccccancatgccctgntaatttttaaantttttgtacagatggngtcttgctatgntgctcangctgatcttgagcttctggcctcaaatantcctgactagncctgcaaagnantggnntgatttttttttttttttttagatggagtctcactctgtctcttaggctagagtgcaatggtgcaaatctcgctcactgcaacctcagccttctggntcaagcaattcttcttgcctcaggctcctgagtagcttgggattacaggtgactggttn

SEQ ID NO: 702098 - DNA, 673 bp, Homo sapiens
  misc_feature (11)..(11): n is a, c, g, or t
  misc_feature (206)..(206): n is a, c, g, or t
  misc_feature (217)..(217): n is a, c, g, or t
  misc_feature (378)..(378): n is a, c, g, or t
  misc_feature (386)..(386): n is a, c, g, or t
  misc_feature (441)..(441): n is a, c, g, or t
  misc_feature (483)..(483): n is a, c, g, or t
  misc_feature (493)..(493): n is a, c, g, or t
  misc_feature (505)..(505): n is a, c, g, or t
  misc_feature (521)..(521): n is a, c, g, or t
  misc_feature (533)..(533): n is a, c, g, or t
  misc_feature (540)..(540): n is a, c, g, or t
  misc_feature (569)..(569): n is a, c, g, or t
  misc_feature (580)..(580): n is a, c, g, or t
  misc_feature (590)..(590): n is a, c, g, or t
  misc_feature (592)..(592): n is a, c, g, or t
  misc_feature (596)..(597): n is a, c, g, or t
caaaggcaaangaaatctgaataaactaaggactttagtagtaatgtatcaatattggttcattaattgtaacaaaggtaccacactaatatattaataataggggaaactgtgggagggtatgtgggaactctctatcttctcaatttttctgtaaatttaaaacttttctaaaaagtatctaattttttttaaaactagtttgngagtccatagnttttaggagccattggaattatatcaaattttaagtattggtcacaaaattgatttgtttccaattaaattatgatttatgaggaatattttctaccttttagaccttgtgtgaatgctgacttgttttaagagagggagagtgtcttgctctgttgccangacagagntcagtggtgcaatcacagcgtactacagctttgaactcctgggatcaagcagttntacctaagcctcctagtagctagcaatacaggcacaccccancatgccctgntaatttttaaantttttgtacagatggngtcttgctatgntgctcangctgatcttgagcttctggcctcaaatantcctgactagncctgcaaagnantggnntgattttttttttttttaaatggaagctaactcggctttaagctcctaacttctgagtgcttgattacagggatca

SEQ ID NO: 702099 - DNA, 196 bp, Homo sapiens
catatagtacagaggaagggcatctacaaaaccgtgtagtggagtgccatgcctgacggtacagaacgatcgcgtcttctgagaatgaacagccgaccctgggaacggttgtcaatggcccagcacaacccacacgtactagggtggatactctgtatcctagtaactttaatttttgaaaaactatttgataaac

SEQ ID NO: 702100 - DNA, 173 bp, Homo sapiens
  misc_feature (25)..(25): n is a, c, g, or t
  misc_feature (32)..(32): n is a, c, g, or t
  misc_feature (36)..(36): n is a, c, g, or t
  misc_feature (38)..(38): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (57)..(57): n is a, c, g, or t
  misc_feature (64)..(64): n is a, c, g, or t
  misc_feature (66)..(66): n is a, c, g, or t
  misc_feature (91)..(91): n is a, c, g, or t
  misc_feature (97)..(97): n is a, c, g, or t
  misc_feature (99)..(100): n is a, c, g, or t
tgtctttacacactatatagcatangtataancatncngtacntancancatgtctnggaagtntncccatatcagcacaggaattacttnctcatntnntcacagctgctcaggctcatatggatgtatcataattaatttaatcttttattgatgagcataaggagggatg

SEQ ID NO: 702101 - DNA, 195 bp, Homo sapiens
tgatgcggttcggacgtcatgaggttcgaatagaagccggcgtacagagtgtctagatcaccccctcccgcagagtaacaggcgtaaagactcgacctgacgttgaaaacgaactccaggtggacacaacatatagatctacgcaagagtggcattgtaacactatcgtgaatcgagcacgaatgagctaacgac

SEQ ID NO: 702102 - DNA, 1393 bp, Homo sapiens
  misc_feature (337)..(337): n is a, c, g, or t
  misc_feature (595)..(595): n is a, c, g, or t
ccagtgagtggcgacatggagagcaccccagcttgaataacccatgataaatagagctgaagtaccacgcacgtctaagtactaccccttactcctatcttccctgtatgtgctgatccctgtctatggagtggggcgcgtcgagcatggggtggacgcagtgaggcctcgaaacacgggattctcatcagagggtccttcctctcgcacctagtgtaggtacgaaaccgcgtcagggacccacccctcagaggactgaatgcgcacaactagctgcgagcgccacgctgtccaaggtgacgaacgcgacaagggagagctggtatgatacgcgcgngctgtgtgctcacgcgtgcatgctgccattcctgtccgtccactgttccgtgcacggcagcacgatgcgcgcgcatgggagccaagggcacgccgacaaccagcgcaagtcgtacggcgcagaccgtagtggatggggggcatacggtcagcggggatgggcgcatgcggagaggcgtactcgtcacgcccggaggcccccccatgcaccacgcaatcgcccccaagacgcatagagccctcgcacgaaggaacacancagaggaccccgtgtgggactctcggaacagaccacggctgagtcaacgggtcggtaccccagaggggcactcagagcgggccacgggggacgcaatcgacaggcgcgcagtcgcacccagttgacggagacgcggctcccacaaacgatacaccgaagtgggccaaaaaggcccagatacactacacgccggttatggacggtgtcacacaaggtcaccgccctggtggtgcttttcgccaatggccctctctggggcttttgtttctcggccactgtccgagttctcgtgttcggcaccaccgtgggggtctcaccggaggtgcgacttcatggggcgagaaaaaagcgccaacttcttgtgccgcgaggaccccaaaaaacttagggctcagcgcctggggagcaaacgggggcaacacgccattctgtatcacgggccaatgggccttctcagttccccccgtttggaatagtccttttgacacccccggatggaacgcctttgcacacccccaaaagcgaattggcatacggcgcacgccggtcggggtgggcgcacgttccaacgcagttgggaaatggcggtgggcaaacgatgaacaaaaaacctcggaaatttctggcactaaaactcccccaaaagttgggttgaaaagcaataaccctggggccgttccgaatggaggaccttggttccgtgccgatggccaaccctggacctgcggatcccttatccaggggacaagccatgagcaacttagattgttgacccgctgggaaagccaattggggccg

SEQ ID NO: 702103 - DNA, 1022 bp, Homo sapiens
atgttgtctcccaaaaattatatgtgttaaaagcccccccacgtaaaatatttagtgggggagacaacatcattggaaatgttttgaaactacccgcgcttggtttaacaccgggggtacgatttgtggggtagcaggccctccatatccccgatgattgtcggggtggggcctggaatggaacgcgccgccttctttccgcaaatggtggggtaggcacggaatgataggacctccggtcgagccatatggatggaattttgggtcctcgcgcttcttggatgtcccagcctgtgaggaagagggctgttttttgtacgaccaggtgctctttttcggcccttaaaagacccaagacagtagttccattgcaggtgcttgccctattgttgggctctccgcagacgagaaatcactggcaccctgatttggcagattagcgagcctctcctttccttgtcaattgaatgccctcgcccaactagtatgtctcgcttggggccctatctatagctaaatcagggaacactctctatattaaaggcccatggcctgctttgcagcacagcacctagcgcttcatattgtgtacttattcattcatagcgactcgcgcgccttggcctaaaaacaggcctcaggccatagaaaccatcctctatatgcgtggtaattgtacagtcccagtatcctgaaacagtgtttggtgacataatgtccacacgggtgagtgacatagccctcgattataaggcaacatagctttatccagggggcttcacccatgggattcccaaaacttatctgagtcacttgaaacttggttcccagtaaacacatgtctggtttataatctcctattatgctcacctgacattaattatcgtatccttgatgatgtgtttggagctgagtagcagaaaacagaggccacactttctgggaaattattaaaggaagcaaccatttttaatgagatgtctatatataacgatttaaaaagctaatgaccaggtgagaaa

SEQ ID NO: 702104 - DNA, 274 bp, Homo sapiens
gctgggattacaggtatgagccaccgtgcccggcaatgtatatattcaaattctaacagcctgggactccttgggaaaaacaggaggcaccagagacgccattttggaaaaaaaacctgttttcctcatggaaccacaggaattggagatggatagatgccccttcagaaatctaaggctctgttctttttgggattcaggatctggtataaaaatgggacccttaatttttggagacctgtgttgctttctgctgagcccacttattatattg

SEQ ID NO: 702105 - DNA, 120 bp, Homo sapiens
ctaaacacagatttcaatgtagatgaaatggcttctattggaagagatgcatctaggactttcatagcttgaagaggagaagtcactgtctgggtgtccaagggacaggctgacttcttg

SEQ ID NO: 702106 - DNA, 161 bp, Homo sapiens
  misc_feature (149)..(149): n is a, c, g, or t
acacagccagcgctgacttcgtcactctgctacgactggcaaagatgagggaggctgaagcggcccaggcagcaggcagagcgatgagcacgtatcttgacatcgttccgcgaccttctcccgtcatggctgtcagaccgacccggagnaagctgacgccg

SEQ ID NO: 702107 - DNA, 669 bp, Homo sapiens
agagtctctctatgtcgcccaagttggagtgcagtggcacgatctcggctcactgcaacctccagctcccatgtgcaagccattctcctgcctcagcctccagagtaactacagctcagcatccagcttggctgtgggaccagctgatccactgtgtggactcaggactcaggcagcaaggggtggcttcattaagaagtggccccagttggaagatgattttcctggtgaatcctttatcacaaactcagagactccctgtgacccatggccaaaggaggaccttctattttccgggagcatcaagaagggcttggtggattggatgagaacagacataggaaatatgcctttgccggaacactattattatataatgaaacctttggtaaatattcataaccaggacctttattggaatcaggcttggtgcctggccttcaaaagataatttcatctttagggcttttattagatttataggggaggggagagtggaccctcccttactggaagaaaagggctgattggaatatggaaaaaaacaattttatactctttacaaacaagaaagaccctcttggccctttcataattatgaaatccctgggcacattagggttggataaagaaaacaaaggttcctcgggggcgaaccgcggcgagtcg

SEQ ID NO: 702108 - DNA, 298 bp, Homo sapiens
aagctttgcgctttatcaggaggcaggactgtggcgggaagggtcccttaaaaatgggtttggggaccagtgggtcaggaagtgggagccaaaggttttactccctttgctttttttttcagggtccaaaacaggtcaaagacaatggcttataaaggtttagtgtggtttcaggatgtgacaggcagtccagcctgccctttttgccccctccagacaaacttccccgacaagctcctttgtgcctttacgtggaaagggggtggaaagttttccccttaaaaaatggggggtttta

SEQ ID NO: 702109 - DNA, 128 bp, Homo sapiens
catgatcttcagctgatatctgctgccggatgtcatgtcctgttgtcctggagggcgttgatggcctccgccagccacgtgtcacgctcgcgatgacaactccgactgtgtacctgagctcgaacttc

SEQ ID NO: 702110 - DNA, 173 bp, Homo sapiens
atacacctccgactcggatccagtgagaagcagcttgtagtacagcgtgtcgtattgctcaatgaagtgcaccatgatggcgaagctccttcttgacgtccgagactgtccctgtccctgcgctcctcacggatcgactcaaacgagtacttcttgagggagcgccgtagcat

SEQ ID NO: 702111 - DNA, 1317 bp, Homo sapiens
  misc_feature (288)..(288): n is a, c, g, or t
  misc_feature (335)..(335): n is a, c, g, or t
  misc_feature (387)..(387): n is a, c, g, or t
  misc_feature (403)..(403): n is a, c, g, or t
  misc_feature (409)..(409): n is a, c, g, or t
  misc_feature (425)..(425): n is a, c, g, or t
  misc_feature (443)..(443): n is a, c, g, or t
  misc_feature (453)..(453): n is a, c, g, or t
  misc_feature (480)..(480): n is a, c, g, or t
  misc_feature (488)..(488): n is a, c, g, or t
  misc_feature (490)..(490): n is a, c, g, or t
  misc_feature (500)..(500): n is a, c, g, or t
  misc_feature (522)..(522): n is a, c, g, or t
  misc_feature (536)..(536): n is a, c, g, or t
  misc_feature (556)..(556): n is a, c, g, or t
  misc_feature (567)..(567): n is a, c, g, or t
  misc_feature (570)..(570): n is a, c, g, or t
  misc_feature (635)..(635): n is a, c, g, or t
  misc_feature (679)..(679): n is a, c, g, or t
  misc_feature (692)..(692): n is a, c, g, or t
  misc_feature (797)..(797): n is a, c, g, or t
  misc_feature (1078)..(1078): n is a, c, g, or t
  misc_feature (1127)..(1127): n is a, c, g, or t
  misc_feature (1186)..(1186): n is a, c, g, or t
  misc_feature (1223)..(1223): n is a, c, g, or t
  misc_feature (1290)..(1290): n is a, c, g, or t
tctgttggcgatgatattcgcttcattgaatggatagttcagagactgacgtggtaggcaagacagtggcatgagtgctgggattgctacaaagataaacggtgctgaaagcatcggtgcactgagccagatgttgaagattcttgtgtcaattaaagcgtacctcgactttacaaggataagttaacacacgatttgttaacatgttagacattgagtggagtcccatcatctacagcgccacgataacatggtcggcttgtgatactgcagggtgcacgcaccatncatgcgcgagcatggccacctttacgaagatgaagtcgtacgtccgncttatgccatttcacttaagacaagcctagttagcagcgggttacgcaacgnaggcgagtccatgtgnttctcnatttgcgccctaatantttgaacatgagtactcncaacaccaantcaataatggtgaaggaactcgcaagngataacantntccatatctntagccaacgatagggctccaangatcttgtgacttnttgcgctatagcgatctcgngtgcaataganagnttgatgcgtaagctaatgagagctagatagcgctccgaccaatgccatttcgacaatttgatatntatatttagctcgagaaagggctccaatggtgtatagcaagcgnttttttgtccgtntaccaccgggtatacaaggggcgaaacaaagacaacggcaacaaagtaacgtattacatcacctattggtggatcgcacatcgtttgtcatctcaactcccgtangtacaaagggtaaagccactatgtccgctgggttatatcatcttagggacgaccagaaatgttatctttctcttaacctggaaccgaaccctaaagttaaagagttgaccccggtcgctttttcccagcttgggttctgtaaaggttctggtcggtattcccccacatttttaaggcgcttcaccccgcttgggccatatttggcccccatatatagaggctttccggagtggtctcccccaggtgtgtttcccttttcgcgagtgggcatacaccttaanaaagttatttagcgccccaaggtggcccttcgtctttttataaatgcangcatgtggcctatgactcgcttgcgaggacagcgactacgaggcgtcaatttccccaantgggagaggaatatcatactgtggatagttctcccancaagacttgtagaatagatacatgtctcgcatcaggaaggccaacgaggccacactcattcgcgctntgcattatctcctcacgagcagcactc

SEQ ID NO: 702112 - DNA, 398 bp, Homo sapiens
  misc_feature (235)..(235): n is a, c, g, or t
  misc_feature (242)..(242): n is a, c, g, or t
  misc_feature (247)..(247): n is a, c, g, or t
  misc_feature (264)..(264): n is a, c, g, or t
  misc_feature (279)..(279): n is a, c, g, or t
  misc_feature (314)..(314): n is a, c, g, or t
cagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggcnccttggnactgnacactaaacagaaaggnttaagacaaaatgtncccgagttgggggaaaatccatttgtgttcccccnaccctgcctcctccacgatgtgaccccgctcagagcccttgtgtctgtgaactttcaatgaaatacccatgcagctaccaaaaa

SEQ ID NO: 702113 - DNA, 103 bp, Homo sapiens
cctgttgagaggaatgtgagtcagtgggtactttctgagaattatagaatgttctacacaacggccatctagacctccctaatattgccttattcaaagagat

SEQ ID NO: 702114 - DNA, 128 bp, Homo sapiens
tgggatcacaccactgtactccagcctgggcgacagagcaagactcccacctcaaaaacaagaacactacttagcaacactattacacggaccaagacgggacatatcatgttacaacacacacttac

SEQ ID NO: 702115 - DNA, 524 bp, Homo sapiens
ggtgactctgaggatcccctaatggctgtcagaaattacattttaactaaatactctgtattggtgtgaacttatgtccctaatgtgtcacttcttccctgccttttctccttgttaattcaggtgattaatgtaaccagacgtgtaatgaccaataagaagatgtcacaccatatgccaatggttggaaaattaagcccagtagttggagctgtatattgggccggagtaatatgcagcatccagctttcaagcagatgtgtccctaggcaatgatagcaagcagatgccctatcaggaagagggggtatcaacacttacactcctttaatacattcctggcttcccttaacctactgcagtcaccacggcatgccgcttttcagaggagccccattttgaggggcaaagggcggacaagtatatggttgcattccgagcggtacctccaacagccattcccgcctatccaggaatagtcttacagtaaccaatcattagctgctaaaatacctcaagtgtgg

SEQ ID NO: 702116 - DNA, 234 bp, Homo sapiens
ctaaatcctggaggtcttgaattactgccttactgagacactggacgcacatatccatgtaggctttatgacactcttgcgtcactgaaaccagcctgacagacatcttcagctggccaacggttatggctatggactcagtgaagacctgtaactagctcatacggatttgacggatattgagttgctccaattataagtctgtactggaacatagaatgctacctagtggct

SEQ ID NO: 702117 - DNA, 589 bp, Homo sapiens
  misc_feature (51)..(51): n is a, c, g, or t
tctcgttgtcttaaattattaattgaaaattattcatggctaaataatgcntaggttgccatgagccttttctccttctataaaccgtgtcagcattcttttatatatatctttcagcacatctgcaatgatttctttggaataaatttctaaagttcgctggatcgaaagattcagggatttttagtgttctttcagtttggcaaagtattttccagaaacaagcccatttcagttctgaataaacaaattcttttttatgttgcattaaaatctacctccttgtagcatatgcagggaaaatgaattatttgtcaacatgctttcagatacttgaagattgttctatttctctttatgactattctgttttctggactatacattatctttcccatgattttacattgaatggtggtgattcagtctcaatgtattatttgctactccgaggtatataataaatagatagatgtgattagcttctaattaaagggatatagtaggtggaaatgtataatagtgcgtaagccagacacagcccactgggtttgacaaatctcttttcaagtaagattaccaaaataaa

SEQ ID NO: 702118 - DNA, 129 bp, Homo sapiens
atagcttgcctttttaaaatctgtaatccctatttatttccaggaatattgattatatctttttctcccactggattgtaaattcgccgaaggcacagcctgcatgtgttacactacttcacatatact

SEQ ID NO: 702119 - DNA, 180 bp, Homo sapiens
cgttaagacttcaggtctccaagtgagtgacttaaactcttgcttcattgggaggccgaggtggacagatcacaaggtcaagagatcaagaccattctggctaacatggtgaaatcccgtctctactaaaaatacaaaaattagctgggcgtggaggtgcatgcctgtagtcccagctac

SEQ ID NO: 702120 - DNA, 437 bp, Homo sapiens
cacggactgacgagatcctgtatgctaggtggagagagccacatttccccctggatatgttatgtaaaagtttgaggttgagatgacttatcttcacactctgttgttactctcagaagctactacatgtgaaattctaatgactgcattatcctgccaagtgaaagaggcaggcatgtagcaaggacagttaagaggggggagagcctcgtcatgatctgggagtctccttctgacatcttgggaaaaactgtccacagtgtgaagtcatccacttgttgtcctggtttacagtttgagcatctgttgttatggtgtcgaatattttggtgagttctgagtggctcatgcttcacgtacaagggttttcccatgaaatttacattgagttgtccacctccagcttatagggcttctggaacagagtgggtcttgcc

SEQ ID NO: 702121 - DNA, 80 bp, Homo sapiens
tggtgattccaagaaattggaatgaggacaaaattaaggattaaagaagaagagattacaagaaaatccaggaaaagtcc

SEQ ID NO: 702122 - DNA, 584 bp, Homo sapiens
ggccgatcccaacgaggctccctgtgagcccgacgcagagcagcgcccttgccgggccaagcaggagaccggcatcatggattccttcaacagtagtgctggacggggccaggcaccttgtgggcttccggactgcaatggggcaaggcacttcaatgtgcccctctccatttcccggctcactcctgggggcaaacgcggcgcaggccggagtggccgtgggctgactggtgtgctgagcatctgatggcgagaatgcgggtagcctcacactacatctgaagctcagaacaagatccgggcctgcggggtatcgctctcagcctggtgcctctatgcagggacccagccgtgttcagagacaaagcctgcagaaggcctccgttccccgccgcaggactcctccgtcggtaacacctttgcagcccatgcagtataccctcaatcaatgaccggcccgagcctttgggtgcgcccccgctcccgctgacagctgccccgcaggagaatggacaggccggtccgaccgctggtcccagattgccagcaagcaggcggcttgataggagaacacagaggactag

SEQ ID NO: 702123 - DNA, 170 bp, Homo sapiens
tacggatcttatttgcggtgcctttcactctgcaggaagtagtggctgcacagcaaagaggtggcccgcttggaagacttggatgcgcaaggcaggtgagcagcaggaaacatgcctcccgggagttagtcaaggagcctgcgatgcgcagtgagacagacatgcccgat

SEQ ID NO: 702124 - DNA, 1698 bp, Homo sapiens
ggcctggctacgctgctctgtgctggatgccagtgatctggccccaaaggaccgcaatggcacatctgaccccttctgtcctgagtgctgctacaatggtgcctggacactgtgtgagacctcgatctgtgaatgaatgtcatgctacccactgctggaatgatgactgttttgaattttgatgcttgcagtgaggtgtggccatggatgtgctgcttgtgctgttggacgtgccttggtgacttggtgaccattgtcatgcctgaaactgacttccttggtgcaacatgtgtgtcgatttgattgtccacgcagacttgcgtgggttggttgcaagcacggtgatgctgatgtgtgcttgtcgttctccgtgcttgcatgacccctgaaacccatgttcccaatccagccctgtgttgtgccatcgcaccgaagtgcgccacaccctcggtggcctctctttctcccagcctctgcgcagtcgctgccgtgccttgccgtcgcactgcacgcacccggctgcatatgcacacatcccaggcatcacttaccgccatggccccaaccttgtcgcatcgccacccctttgccttgctcgccccacctgaccgtggctccaactgccttctggagcccacttgccatcgggggctcgcaaagatggccacggccttgcattccccccactctcaatctcgcacgtgaaggaccaagacacaaatggccaaccccggaacgtctggtccgtgcacccagcggactccgcttgtgcgcccaccgggaagcaccccgttgccttccacacagccttaccttctctccttgtatctgccacgggttcggcctctggtgcccaaactgcggacctttcactcttcgtccaccccattggcctccttatcacccaatggccctctgggaactccccttgacgctaccgcgcaccccacaagtctgcaatcaatcctcaaccatccacctccccattcattctctcctctcctacgactccaacaccactcctctctctctctcgactctctcctccatccgtcatctccctgctctgtcacatccatctccatcatcctgactccttccacaagcgtcagtcatgccactctccgtgcacaatctccgcacacatacatcactctctcagccacacatctcgcctctgctctccttcgttcccctccccacacattctcacttctccaccaccaacctcgcgtacctccatcacctccaccaccacgccacccacccgcttcccacccccttctcatcccccccagaccacaacactcatcccacacctctcacgtccatcttctcatccgcttctccctccactctccccttctcctcctctccctcacactcacacctctcgatcatctcactcgctactctcatctcacacacactcacacctcgctcgcctacatgcttcatgatcctctcaccactctctctcccttcactctctcgactcacacgccgcacacactcacgcgacacttcactctatcccaccaccactcaccacttcaccctcctcctcactcaatccatcacacaccactccgcccacccgaccaccgctcactctcctcactactccacccaccaccgctccactcctcaccaccctactcactcctcaccctctatcctccgcctcttcctccctct

SEQ ID NO: 702125 - DNA, 216 bp, Homo sapiens
  misc_feature (142)..(142): n is a, c, g, or t
  misc_feature (213)..(213): n is a, c, g, or t
cggccatggctcacagtacgctagcagctggttgagcagcggatccgagcttccccgacttccccaccccaggcgtggtattcagggacatctcgcccgtcctgaaggacccgcctccttccgcgccgcatcggcatcctgngcgacacctgaaggcgacccacgggggccgcatctgactacatcgcaggcctagactcccgaggcttcctnttt

SEQ ID NO: 702126 - DNA, 124 bp, Homo sapiens
agaagagtcaactgtggagggggcacctgctgaatgaatcctgcgtgagctgctatcagagcagacttacacatcacaacatgactttcctgggcctgactcccggacctgtccccagcgcctc

SEQ ID NO: 702127 - DNA, 1803 bp, Homo sapiens
  misc_feature (35)..(35): n is a, c, g, or t
  misc_feature (266)..(266): n is a, c, g, or t
  misc_feature (371)..(371): n is a, c, g, or t
  misc_feature (1159)..(1159): n is a, c, g, or t
ccttcctggaatgagaacacatataaggactatancagcgattgatatcgctcatagactacataggctcaatatgtgtcggaattatgcatatatctgaatgatcaaggagaacctgtaaccagtagtagagtatcagatgcggtgtatacactaagcatggagattgtacgtctcaaagaggtagcataagtacgtcatgggtacctaaactcaccttgataccactctactggtctgttatagtgcacctaggatacataatncacacataaaaaccttgagcagaaggctccatggcgcaaacgggcttaggaaccacgcacgaccaacaactgtaggcaaagctcgtattgcatatggtaacactngcatacacacggaataaccacacacacgcacctcgtggtgtgtcgtacaaataagtacgcatgacggacatgatggttccatcgcgacatgcctgcatgtgccaaacatcacatcgtaacacacggggggcaccgttgtgtgccgtatgtacgcttggggcctagatcccaaaaggccatacacgatacaatacgctatcgtgtcatccccacacggtctatacactacatcctttgcctccgtacaaggaaacacccaccatacatttagcaattcgctccgatattgaatacattcatggtggtacgcccaatgtgttacttatttccacttaaccaaacaacatgagggccaagggcaatgcgtactctgtggcactccacattacaaagaaggcacgaacacccaagttagcctctcgcatgtgagtgcggattgtctagctccattatactattagggcttggacccaaagctacagatgcactgttccgcttttgcaaagacagggcaaaagaacgccaacaagacaaaacctttggggggcaacaaacgagggctctgttttacccccggcacgaccctggcgacacaggcacatctgccttcaacaaacggtaaattctcccttttatgggagacttatatttggccccacccaataggcacccttgtttactgacactcgggcggtacacgcgactgccgcataccttattggacgttacttcaccctagcgggggaagtcggccattacctccttttaaattctggttttcgcatttnaactcacttggtttcggaaacatccttaggtttcgcctggaactgttggacattcaccactggtcacacaccaaaacttgaacccgttacactatttcctggcacattttctggggcgcaatgaaaaggtcacctttggaacagggtcacagcagttatgttaacaacgcggaacctgcggtgcgggtacctctgggggggccacacactactttttccacccttaggggtcgcggacataactctcatcacaccaaaaattgcaacacaccagggtgtccagggtgtcagcccacactgggtaacattgcgtcagggcaaagagggccgggaggccggcgaacacaccgggtgggcgttaactcaccacgcagaaaaggagacggccccaaaggggaccacgacaccgggagatagcctgggaagcccacttatctggcgttcccacccacgtggcgaccgccacagtaatacacaaaacccgcaggaactatactaacaagcaaacaacgcatgaagagctcaggccagcagataacccacaacacgtagtagcagagccggtgagcagaccaccagcgctgcgcgccctgggtggacagcaaacctatggacgatggagaccacattatactcaatcaagg

SEQ ID NO: 702128 - DNA, 159 bp, Homo sapiens
tgctctagaggccccccgcgtgtgagtgtagtcccagctacgtgggtaactgaggtggtgaggatcactgacgcctaggagctcgaggctgcagtgagctatgatatgtgtcactgcactccggcctgtgaaacaagatcaagactctgtctctaattt

SEQ ID NO: 702129 - DNA, 207 bp, Homo sapiens
tattatttttaaaaatgtaactgaatctcatgaagcaattatttcaaacttttcggaacatgcgcacgtctttgtaaatcatacgagtaaagtcacttttgacttaccaatagtttgggcacaaagcacgcgttatttaaattcccaagattcagatacgctttctgccatggccgcaataaaggagaatagtaaattagatttagt

SEQ ID NO: 702130 - DNA, 297 bp, Homo sapiens
ccccggcccaggtctaacatgatgcagcgtatgcgctccccctttgtccctgttcctgtccagagcactccccaggcaaggcgtctggttgggtcgatggactcccaggttgggacccgaccgacttgataaactcaaaaatcaccactgtactgatctctgcattctgcctcttctagccagtaacgtactttccccagtgtctttgaaaggctgtctctctggaatatcccactcgtcactgatcgtcatatacttgtcaacatccgtaaagaggttgacccggaatgtgtgctg

SEQ ID NO: 702131 - DNA, 886 bp, Homo sapiens
gagcgggtaacgcaggtctctgatgctctgccctcttgtggctgctggctgtgcagctgcctgctcatccctctccatggtgtgtccttggcttcttcctgctgtctgtcccctggtggataactgtgcccctgtgccctgctccttgtttgttgtgtgtgacttgctgatgcctctagtgatgcctgcctggtgaatgccgtgatggaatgcttgagtgcagtggtggcttgtggctgggtgatgtggtcctggtgtgagtcctggtggctgatgtgccctggccctgcctggccctggctgatacctctcggcctaatgcacctgacacccctgggggacgtctctgcaccttgctgggccctggtggcacccctggtgatggtgagacaccccatgtacccgtgcaacacgggctgtagtggttgtttgccctggccctcgtggtccacaacctacccctgctaacacccctactgtgtacacctaatagctgagtctgcgacatcgcccgtgacattctgccaggacgatggcccctgtgcttaggcccgatttaacgggttagccacaatgataatacttgccagtaacagggcatgtttttctctgtgtcaagcgctttaagttctctctgaattgccgcaactctgggagccagactgagaaaactgaggtgcagggagattagagcccattgccaaggttttagagtgagtcagtagctcagctgcactttgcacctggaacccgcgctctcgcccaccctgtctagccctggcctgtggctgggacctccagacataaaccggatgctcttgcccagctctgggcccatttctgctgttctgctcagttcaacctgatggcttccttattgggtgac

SEQ ID NO: 702132 - DNA, 373 bp, Homo sapiens
  misc_feature (40)..(40): n is a, c, g, or t
  misc_feature (92)..(92): n is a, c, g, or t
  misc_feature (94)..(95): n is a, c, g, or t
ctcttgttgcccagttttgaatgcaggtggtgtgatctcnactaaccgcaactttcaccttccaggttcaagcgattctcctgcctcacggntnncaagtagctaggattacaggcatgcaccaccatacccggccaattttgtatttttagtagacagcgtttcaccatgttggtcaggctcaaactcctgacctcaaactcctgacctcagcagaccactctttaacaatgataaaaatccagactctgaatagttatgtaactggcccaacacttggacgtggagcgccacatgtgtgcctattgggttagcggccaagaatattgaccatcagatgaaagaagtgactgggaacatattaccagcaaca

SEQ ID NO: 702133 - DNA, 113 bp, Homo sapiens
gacagtcaccctgatatgtctctatggtccagaccttctgcagacatttacccttcattcacctattaccgttcaggagaaaagctcgactgtgtgcggcttcgtgagaatct

SEQ ID NO: 702134 - DNA, 461 bp, Homo sapiens
gaaatacaaaaattagcttggcatggtgacgtgtgcctcagccttccaagtagctgggattacagtgcccaccaccatgcccagcgaatattttgtatttttttttttagtagagatggagtttcaccatgtgggccaggctggtctcgaactcctgaccttgtgatttgcccacttcggcctcccaaagtgttgggactacaggtgtgatccatcacacccggccaacttttctttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccattgcactccaacctgggtgacagagagagactccgtttaattaaaa

SEQ ID NO: 702135 - DNA, 811 bp, Homo sapiens
  misc_feature (26)..(26): n is a, c, g, or t
  misc_feature (40)..(40): n is a, c, g, or t
  misc_feature (65)..(65): n is a, c, g, or t
  misc_feature (72)..(73): n is a, c, g, or t
  misc_feature (89)..(89): n is a, c, g, or t
  misc_feature (92)..(92): n is a, c, g, or t
  misc_feature (111)..(111): n is a, c, g, or t
  misc_feature (147)..(147): n is a, c, g, or t
  misc_feature (204)..(204): n is a, c, g, or t
  misc_feature (252)..(252): n is a, c, g, or t
  misc_feature (257)..(257): n is a, c, g, or t
  misc_feature (264)..(264): n is a, c, g, or t
  misc_feature (272)..(272): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (301)..(301): n is a, c, g, or t
  misc_feature (304)..(305): n is a, c, g, or t
  misc_feature (307)..(307): n is a, c, g, or t
  misc_feature (314)..(314): n is a, c, g, or t
  misc_feature (316)..(316): n is a, c, g, or t
  misc_feature (334)..(334): n is a, c, g, or t
  misc_feature (340)..(340): n is a, c, g, or t
  misc_feature (346)..(346): n is a, c, g, or t
  misc_feature (349)..(349): n is a, c, g, or t
  misc_feature (363)..(363): n is a, c, g, or t
  misc_feature (379)..(379): n is a, c, g, or t
  misc_feature (382)..(382): n is a, c, g, or t
  misc_feature (398)..(398): n is a, c, g, or t
  misc_feature (443)..(443): n is a, c, g, or t
  misc_feature (445)..(445): n is a, c, g, or t
  misc_feature (473)..(473): n is a, c, g, or t
  misc_feature (496)..(496): n is a, c, g, or t
  misc_feature (504)..(504): n is a, c, g, or t
  misc_feature (590)..(590): n is a, c, g, or t
  misc_feature (592)..(592): n is a, c, g, or t
  misc_feature (595)..(595): n is a, c, g, or t
  misc_feature (603)..(603): n is a, c, g, or t
  misc_feature (611)..(611): n is a, c, g, or t
  misc_feature (696)..(696): n is a, c, g, or t
  misc_feature (701)..(701): n is a, c, g, or t
  misc_feature (706)..(706): n is a, c, g, or t
  misc_feature (738)..(738): n is a, c, g, or t
  misc_feature (795)..(795): n is a, c, g, or t
tctcatttaacttttttaatgggtcncaaaattctgtganaaatttttggtcaaattgtttccantaaaaannactgattttaaaaacnaanaacttaaaactgccacacncaaaaaaaaaaaccaaagtgggccacaaaacattcncctttccttctgaaggttttacgatgcattgttatcattaaccagtcttttactacnaaacttaaatggccaattgaaacaaacagttctgagaccgttcttccnccacngattaanagtggggnggcaggtattaggganaanatncatttanccnncngagcctncngggcagacttggtgaccntgccanccccancanccttcttgtccacngctttgatgacacccnccncaactgtctgtctcanatcacgaacagcaaagcgacccaaaggtggatagtctgagaagcncncaacacacatgggcttgccaggaaccanatcaacaatggcagcatcaccanacttcaanaatttagggccatcttccagctttttaccagaacggcgatcaatcttttccttcagcccagcaaacttgcatgcaatgtgagccgngnggnaatccaanacaggggnatagccggcgcttatttggcctggatggttcaggataatcacctgagcagtgaagccagccgcttccattggtgggtcatttttnctgtnaccancaacgttgccacgacgaacatccttgacaganacattcttgacattgaagccacattgtccccaggaagagcttcactcaaagcttcanggtgcatttcgacaga

SEQ ID NO: 702136 - DNA, 398 bp, Homo sapiens
gtggctcacggcgctgccactgccttcatgtagctgcgccaggtggcggtgtgatgatgcagcctgacgactggcgtttggtggtcttcattacctgctttcgggacaagattcctaatttggagcgtgcaaggcgggcctgcaaagcatcactgcaggccagaaagtcattagcaagcataagaacgggcgcttctaccagtgtgaagtggtcaggctcaccaccgagaacttctatgaagtcaactttgatgatggctccttcagcgacaatctttatcctgaggacatagtgagccaggactgtctccagtttggtcctcctgctgaaggggaagtggtccaagtgagatggacagacggccaagtctatggagccaagtttgtggcctcccaac

SEQ ID NO: 702137 - DNA, 1035 bp, Homo sapiens
  misc_feature (109)..(109): n is a, c, g, or t
ggacctgttagtgacgtggggacgcacgacggggcactgaggggacgcacgcggggacgctgggggacgtgggggcgccgagggacttggagggcgccgagggacgtgngggcgccgagggacgtggggggtgctgaggggacgcccgccagtggccgctgagggacgtgggagtgttgagacacagacacaggaagcatcaactctgaggctttggccaggatgtgagcccgactttcgcagccccaactggcaggctgacctcatgtgaactccctggcgatggcatcctggagacacccacatggctgagctggcaccataggcactcataatccaggttcagtttctgccagcactaatttggtttattccacatggctggagccactgcgggactccatttgttccggggccaccttcctgtcaccttttactgtttcttgagtcagcaagaaaggcagatccgactgaagactccagcactctcctcagctgcagcccccacagagctccgcgaagtcctttctcccacaggacagatctgaggcacccaccattagaagaaaggagtggagaaatgatatgcaggaagaaggcccattctgattcaccaatcgcatggacgcactttcctaccaggctaggagggaggaaagtagagccccaccctgactgctaagccgtttgctttggtgtcatgaaaaaagagttcagcttcccaaatcagagaggaaaaggttttcaaggggtcccctatttctattatgtaagctttaaatgacaaagtggacctctggggccaacgtgggtgtgtgatggtggttttgtgggattctccccatagccccatcagacggcctcaccttctgggtctcagtggccccaggtgcaacacggctcctccagaaatgatgacagccctggcgaccaaggactccctgtgccactgggtttgcgctcagaagtatattcaatgatttccccagaaaattccaagtcatctcctaatactgtttgtgaaaactaaaaaaa

SEQ ID NO: 702138 - DNA, 845 bp, Homo sapiens
  misc_feature (109)..(109): n is a, c, g, or t
  misc_feature (836)..(836): n is a, c, g, or t
  misc_feature (840)..(840): n is a, c, g, or t
ggacctgttagtgacgtggggacgcacgacggggcactgaggggacgcacgcggggacgctgggggacgtgggggcgccgagggacttggagggcgccgagggacgtgngggcgccgagggacgtggggggtgctgaggggacgcccgccagtggccgctgagggacgtgggagtgttgagacacagacacaggaagcatcaactctgaggctttggccaggatgtgagcccgactttcgcagccccaactggcaggctgacctcatgtgaactccctggcgatggcatcctggagacacccacatggctgagctggcaccataggtgaggccacttcctgcgaaggtagctggatgctcctgcctggagctgcccccggaccacagagcatccaggagatgaatgcacttccagccccgccaccctggggagatatacagctgaggtggcagctttggagcaagcagggcagagatgcttccccctgaggtccctcccagctctgctaccttgtcactcaaggtatgggttggttgtgttccccaaaaatacatgttaaaatctgagtcttcagcacctcagaatatgacatcatttggaaataaggtcattgcagatctaattaccatagtgaccccttatcctggggaaaatgttccaaggccctggtggatgtctgaaacctcagatagtacctaaccctatatacactgtgtttttttcccatgtgtacagaaatacgataaagtttaatttataaatgaggcacaataatagattaataacaatgataaaatagaacagttataacaatatactgtaataaaagttatgngaangtgaa

SEQ ID NO: 702139 - DNA, 612 bp, Homo sapiens
  misc_feature (109)..(109): n is a, c, g, or t
  misc_feature (535)..(535): n is a, c, g, or t
ggacctgttagtgacgtggggacgcacgacggggcactgaggggacgcacgcggggacgctgggggacgtgggggcgccgagggacttggagggcgccgagggacgtgngggcgccgagggacgtggggggtgctgaggggacgcccgccagtggccgctgagggacgtgggagtgttgagacacagacacaggaagcatcaactctgaggctttggccaggatgtgagcccgactttcgcagccccaactggcaggctgacctcatgtgaactccctggcgatggcatcctggagacacccacatggctgagctggcaccatagggtgagggcaccagggccatggggaccgtggttgcttgcctcagacatggccagcaagggaggcacaacatggggctgttgagtgaatgtgtgagaggctgtgggtccccacagtccagccaccagcggcctcgcagcatcataggagtctgaggtccaagacaccggactcacatctcaaccctgccctgtgctgctcagggccaagtntaagctgctgtgacaaagaggcccccacatgcagcagctgccacagaacacggtcatctgtttttcatgcaaaaaaa

SEQ ID NO: 702140 - DNA, 110 bp, Homo sapiens
ccccggggggaattcccttttttttttacccccccaaggggtttgcaaaaaaggtttcccttttgttcccttttaaaggggtgttaaacccaaaccctttttggttccca

SEQ ID NO: 702141 - DNA, 347 bp, Homo sapiens
gcccccccccccaaaaaaaaatgacatcccctgctgctctaataaaatcaaaaaaaaaaattttttttccccccccctttccccatttccaaaaatttggtgaaaattttctattaaatttctaatttattgagggcccaaaggttgttttaggaatcacttccaaaattttgccttttaatgtttttaacaagggccaaaatgttcaaaaaccccccccttttattattgggaagttttggggtttttttttggggggtggacaaagtttgccctccagcctgggtggcaaaacaaaactctgtttcccaaaaataaaaataataaaataaaaagttttggctcca

SEQ ID NO: 702142 - DNA, 1234 bp, Homo sapiens
ggtaagccgccagaacacaggtgtcgtgaaaactacccctaaaagccacaatgggaaaggaaaagactacatatacaacattgtcgtcattggacacgctagattcgggcaagtccaccactactggccatctgactctataaactgcgagtggcatacgacaaaacgaaccattgaaaaataatagagaaggaggctgctgagatcgggaaacgggctacctatcaagtatgcctgggctactaggataaactgaaagctgatcgtgaacgtaggtatcaccattcgatatactccttgtggaaactctgagaccagcaagtactatgtgactatcataagatagccccaggaacacaaagactacttatcaaaaaactatgcattacagaggacttcatcaggactagactgtgactgtcctagataagttgctagctaggctgtacaggctagacatcttgcaaccactgattatactccaatgaataggacagaccctgagagcatgccctatctagcgcttaacacacttggcctgctgccaaccaacttaaattgtccaggcttgttcacgccgcacgactgggcatatcccaccttgagttctactcacatacactgtcctattaaccacgatactcgcagcgacacattggttcacaggacaggtccatgcacctcaacgactgtatgacacactgtgcgctcatctaccctcctgcataacaagactcgacactaccggtggccgcaactacacaagggcccagccaacagggagtgaccaacccctgccggaacaccccaacgtgcccaccaccatgacccagggggaaccaaacgagctacatgccacaaactcacagcacggacaaaggaaaggagtaaaacccaacacgacaaaccaaagcacgaacatgtacagaccataacaacaatggcacatgagtacccaccaacataagacccaccagcacacgcaccacgcagcccagccaccacacgggacaggaccaaacactactggacgcgataaagcacacggaccgcggtagaccacaagtgcccatcagggcagcaaaaacgcaagggaaacgcgtcactccccgcgacccgacaacggaccacccgaaccaaaaagaagacccaaaaccgaccaagcagccgagtgccctgacacacacgcagacacagcgactgtagcgcctcatccagccgcacaacaatcaga

SEQ ID NO: 702143 - DNA, 240 bp, Homo sapiens
aggcttagtttccagttcagactaagtaacagtatgtgtttcataagtgattaaagctatatcatcccagtatatcagttaacacaaatacagccacatactgagtatagtatgttcacctttcagacttggagatactggacctgtccgtgtaaataacactaaggtaaggatctgctaagtgtataatatgaactgctaagcccatccctgagtgtcactgtcatgagatgaggagct

SEQ ID NO: 702144 - DNA, 154 bp, Homo sapiens
gatgaaatctgtaactcttactggattattatcttaatagaagagttaaaatattaaagttgagaacctccgtttattttatgtgggactgcgtagccctctgtgggctgggatattgtggttggtaactgtggcatctggagggaacccacgg

SEQ ID NO: 702145 - DNA, 539 bp, Homo sapiens
gtttcaccatgttggccaggttggtcttgaactcctgacctcaggtgatctgcccacctcggctcccaaagtgctgggattataggcgtgagccactgacccagacttatggttcctttttaaaaatataaaaaaatttgaaaggtttccttctggtacttgtccttatggtatgtatgtatatctatttttacggtagcacatggcatacgatatgtatacaaccatggtagtcatatataagcatatatagcataacaatatgtatagtctatatataacactacactcgaccagataaccattctcccaactctctgatcctagtcttcctagactctgctaaaggggcaaatctgggttcgagcttcacacacctacagtactatttaccctacaacaagttccgtgtgcgcgctcttacaccgaggctttcgacgaccattgggcctaaatgtccatgtagtcgctactaacaacatagttaactctaggattgacattcacgtctacccttgtctttgcctgtgcagtccccc

SEQ ID NO: 702146 - DNA, 187 bp, Homo sapiens
attcgcggccgcgtcgacttttttttttatttaaaataactcctgagtataagcaatttatactgattactgatagaataaaatgcaccattaagcctacaaatgtgagaaataattatctcatatgcacagaaggccaaagtcaatagtctaatagtactgcttaccactgtagtgtaaacttctt

SEQ ID NO: 702147 - DNA, 175 bp, Homo sapiens
ttacgctgaataaatgccgtcttctaatgaggcgtcctgatcaccttgctctagactgtacctcgtcgcaaaacctacctcatattgacccagtccttgcaatatttttttcttccataacatatcatactcctgaattttgctacatacttaaggttatttatacttcatactt

SEQ ID NO: 702148 - DNA, 650 bp, Homo sapiens
cacggtggctcacacctataatcccagcactttgggaggccgagtcggacagattatgaggtcaggcgttcgaggccaggagttcgagaccagcctggccgacatggcaaaaccccatctctactaaaaatacaaaaattagccaggcgtggtgacgggcacctgtagtcccagctacttgggaagctgaggcaggagaatcgcttgaacccaggaggcggaggttgccgtgagccaagatggtgccactgcattccagcctgggcgacagagtgagactctgtctcaagaaaaaaaaaaaaattggcagggtacagtggttcatgcctgtaatccagcactttgggtggccaaggtgggtggcttgcttgagcccaggagttcaagaccagcctgggcaatatggtgaaacctcatctctacaaatacaactagctgagcatggtgatgctcgcctgtggtcccagttactcgagaggctgaggtaggaggatctactgagcctgcgagtcaaggctgcagtgagtcctgatcatgccagtgcactctagcctggcaacagagtgagactctgtctcaaccagaattcgcccagtcgatttagattcggcaagctttgcatgcgcccgaattcgagctcttgccttggc

SEQ ID NO: 702149 - DNA, 132 bp, Homo sapiens
tcccttgggtaaggaatttggatcttttttggggtttttaaaaaaggtttttttaaaaaaggggacccttttccaatggggattttggatttttcccctggtttttaaaaaaggtttttttaaaaattggga

SEQ ID NO: 702150 - DNA, 334 bp, Homo sapiens
tcggtaccccagaacaatacacggtgaactccattgctgatctggctcgccagtggctcggcgatgattcggcgatcaaccgcagtttccggccatcctttggtcgcaagctggctgggtgacgtgcaccgtgattggcacgtgaaattccaacgtcaaggtcatcatcgaatgcggaggttgcagtagggaatcgactctactcggtcgtgggtccgtcctgatcgttgagcgatctggggatctggcgatgggcggacgggacggcgcgctgccaaaacaaacggttctgtcagcacgtgaccagtgtgaggggttgaggctgcacatgtcg

SEQ ID NO: 702151 - DNA, 429 bp, Homo sapiens
  misc_feature (98)..(98): n is a, c, g, or t
  misc_feature (145)..(145): n is a, c, g, or t
  misc_feature (169)..(170): n is a, c, g, or t
  misc_feature (173)..(173): n is a, c, g, or t
  misc_feature (178)..(178): n is a, c, g, or t
  misc_feature (181)..(181): n is a, c, g, or t
  misc_feature (208)..(208): n is a, c, g, or t
  misc_feature (286)..(286): n is a, c, g, or t
  misc_feature (343)..(343): n is a, c, g, or t
  misc_feature (352)..(352): n is a, c, g, or t
  misc_feature (380)..(380): n is a, c, g, or t
tcagaagttcagctggggagtgctcttgccgcgatggaccgacagctcatgaggctggcagacaccccgtggctctgccagtccgcagagcccggcgncgaagagagtgtgatgctggttcttgccaagcgcagtcgcagtggtnaattccgcctcgtgaccaagtttnnatnggggnttntcagcgtgaacaaagaagctcacagtngcctgggagccccggttcacctctgggggacagaggaggttgctgcctggctggagcacctcagtctctgtgagtttnaggacatcttcacacggtccgacttccggggctctgagctcctgctcctggatcggngggacctcntggacctgggcgtgaccaaggtgggccncttgaagaggatcctgtgtgggttcttggttctgtgccgttgtgccccc

SEQ ID NO: 702152 - DNA, 103 bp, Homo sapiens
agtagagattaacagtaaaggagatcagttgatgaggcacaggaaggagcagatgacccatcagaagcatatgcagggaaagggcagttactgggcttctggg

SEQ ID NO: 702153 - DNA, 355 bp, Homo sapiens
ttgaagaacttggagaatgggggccctttaaaaggccccccttctttttttttggcgggaaagccttccccccccggggcccccataatccatttaattttccttactgggcctttagcttggcccgttttttttcccacccgggccctggggggcaaacttgggcccccctgtgaggggggtctatttttaaaaaaactggtggggcccagggcccgggccctttcccattggctgattctgtttaatccttttctaaaaaagcttccccgccttatattccccccccgaaaggcccaaaaaatggcccgtttttctatatgtgaaaaaaaggggttgggttgtttttctccca

SEQ ID NO: 702154 - DNA, 81 bp, Homo sapiens
ggcggcttgtgctgagagctaaacccagcatattctatgattttttcagatatagataactaaacttactgaacagcaact

SEQ ID NO: 702155 - DNA, 181 bp, Homo sapiens
cccctttcccccccccccccccctggggggttcccactttgtgcccctttgggggggggggggccccccccccctccccaggggcccggggccccgcttcttttttttttttcttttgggcccctggggggggggggggtttttccgggaattttttttttttcttttcctggggccccga

SEQ ID NO: 702156 - DNA, 709 bp, Homo sapiens
tgccgctgcgaagcacggtgggcctagccctactagtctcaatctccaacacatatggcctagactagtacataacctaaactactccaatgctaaaaattattcgtcccaacaatttatattactaccactgacatgacgtttccaaaaaacacataattggaatcaaacaaccacccacagctaattattagcatcatcccttctactatttgttaaaccaaatcaacaaacgaacctatttaggctgttccccaaactttttcctccgaccccttaacaacccccgctctaatactaagtacctgactcctaccctcacaatcatggcaagcaaacgccactttatccagtgaaccattatcccgaaaaaaatctacctctcttatactaaatcctccctacaaatctccttaattataacattcacagcacagaactaatcatatttaatatcttcctacgaaaccacatttatcccaacctgggttatcatcacccgaatgaggcaaccagccagaaagctgaacgcaggcacatacttcctattctacaccctagtagggtccttcaccaatcatcgactaattaacactcaaaaacctaggctcactaacatttactatcactccatgccagactatcaatctggccacattatttgataggtacacagaagttaagaagatctcttggtcatatgtctagc

SEQ ID NO: 702157 - DNA, 147 bp, Homo sapiens
acgggcacaggagggagaaggcagggagggaagaggaaggagggatgagcatccctcctcaagtatacttcaaaggacatttaactaaaaccccctacgcatttatataaaggagggatgagcataaggagggatgagcatatggag

SEQ ID NO: 702158 - DNA, 1260 bp, Homo sapiens
  misc_feature (450)..(450): n is a, c, g, or t
gctggcttagacgctgacactaaggagaaagtcctacaacagtggggcgtgcaacatggcggcttgagaaacggatgacgacggggacttggttgccttttctcctagtgacgaggcacagtagacaaatggctcactgtcactacgctgaacggagtgacatcgttccgaaatcgtacatctaaagacgaacacaagaggaggtgccgagcgggacctaccgtcccaccggtgtgcttcatggaggcgctcccgaaaacatggctgcaatcccacatactgatggacttctagcgtactcggccttgactagactcggggccttgttagcggtaagccaaacacgcagactaatcatagtgtcgaagccgggtcatgctcgcaggagcatgagcaggaccttgtgtagatagacgttgcgtggccgaaagcggcaatatggtgctctgncgaccggagaggaggcatcaccactagaaggcgtacgactattttctcgcacaaagttcccacctcattaccgcgggggcgaacgcgttgatgcattgaggttgaggcttgtacctacgttccatcaaggaacgcgggctggggtcggttcgccgtggaaaggtgtaggataaccaatcgggcatcgaccgttccgagcgatggggctccatggggaatcgggggagacaaatgggggattccccatctctatagggacaacaccgctcgggagagccctcgacccaggtgcgctatctcctctagatggccacggggggggacttgggcccccagcacctatggggccacccccaagcgtggggcaacgaaattccagggccgtttcgatgggggttcgccaagtccggaggaggggaggttcgcggacccgatggtcgaaatttttcacctttgaaaacggaaaactggctactggcgggcgagagaaagggatggttggtgccaattcattggcaccccttgttaaggcaccctgtccgtgtggggctaggtttgacaatagtgtggaaatacttccggaagtcgctggggaaaggccaccgggggaacggggcgcacaacacaaggaaacgggcccggtcgttggaaagcttccccaggataaattccttccctacgcgaaatgaacattttctcccaaggactacacaacggacacgggagtaacagggagagtgcaatgccttacaatcaaaggtggacacaaggccagggagttgtgcttgagcttccttcaacattccgccg

SEQ ID NO: 702159 - DNA, 612 bp, Homo sapiens
actctagcggatcccctcgatttggtggtattcgggggtattcgtcagaggagtttgttattacccaccttttgaagcctccttctgtcaatttgtcaaactcattctctgtccagttttgttcccttgttgttgagttgtgaacctttggaggagaagagacattctggtcttgcaattttcagcctttttgcgctggtttctccccatctttgtggatgtatctacctttggtctttgacattggtgaccttcggatggggttttggtgtggacgtgctttttgttgatgttcttactattcctttctgtttattagttttccttctaacaatcaggcccctctgctgcaggtctgttggagttttctggaggtccactccagatcctgtttgcctgggtatcaccagcagaggctgcagaacagcaaagattgctgcctgttccttcctctggaagctttgtcccagagcggcacccaccagatgccagttggagctctctgtatgaggtgtctgtcgatcactgctaggaggtttctcccagtcaggaggaatggggatcaggaacccccttgaggaggtagtctgtcacttacgaataccaccaaat

SEQ ID NO: 702160 - DNA, 236 bp, Homo sapiens
ggtggagaactctatgacagacgaatgtcttcatgaatatcacggtatgtatcacatactgtctccatggcccatacaaggactccttacggtactctctaacatacaacctatcccccacacctcagtagagaggtttgcttcccactggaagtcgaaagtccttcgctctcacttattacagtctaaaaatccacactggactatatgatatgctttctacgcatgaggctcag

SEQ ID NO: 702161 - DNA, 503 bp, Homo sapiens
  misc_feature (493)..(493): n is a, c, g, or t
gacgttggcgatcccaaatgcgtgggaaaaaataagaaggaggcgaaaggattctgggtgcggctgtgagctgaatggcaccttctacccatgattattgatcctgacacctgggcttataggacaagaggcctccctaccctgatactccacaagccctggggacaagggagccagctggaggaagagccttggggcttccagggcacaagcatgtgacagtgacccctacaaaactcgggaaggaccacaaagttccagcctctgtttgtttcagagcggcaagcacagcatgggagtcagggggtcttcagcctcagagacaagggcagggctgtgggtctgtcttctgggcctgcgaatattggggagcccccagctaggctgtccgggtcacccttctggaatcaccagctctctcccctctcctcagtgtgccaggagagagggtggggggcatccactcggcatgggcccatggtgggagcccagncccccttccc

SEQ ID NO: 702162 - DNA, 1296 bp, Homo sapiens
  misc_feature (430)..(430): n is a, c, g, or t
  misc_feature (434)..(434): n is a, c, g, or t
  misc_feature (438)..(438): n is a, c, g, or t
  misc_feature (441)..(441): n is a, c, g, or t
  misc_feature (452)..(453): n is a, c, g, or t
  misc_feature (474)..(474): n is a, c, g, or t
  misc_feature (485)..(486): n is a, c, g, or t
  misc_feature (493)..(493): n is a, c, g, or t
ccctgaggctccagcacgttgagagtagatcaaaagatcctttcagcagggtgccaatgcttagacgccatctgggagtctgggagccttccgcagacctgtcagtctcttccacgtactttattctcttaaaaactcagtctgtagtgtttcaagttcttagaaaacacaaagtcctcaggaaagcttagggagctgcctctgccctgttgcctcttcctgggcagctggacggaaccctgcctgcccaccccagggtttgcttccggctgcctgtgcctcttcccgggtagctggacggagtctgcctgcccgtccccagggttgttcccggctgcccgggctcttgtggacccagctgtgccagaggtgattctgctccaggtaatggctccagagtccaagcacagctttgccagagcacagtccngtcnctgntgngtcttcatgtnnacgtgcatctgtgctgtcacncttggagctgnntgacatnccccatcctgtcctgtgctgtcccctccgggggtggggactccaaagagaaaggctcaggcatccctctcatccgtgctcatcttgttccatttcaacttcttgtcttgagtcgtatttgtgcatcagctgtggccccggggatatgggggagggcgcggcacccctcgggggacaggtggctgagcccacagcaggtgaaccactgtctggcccaggggatggccagctgctctgcagggcccatgggtgtccatctgcagccctgcgggagccgtgagcctaacctgccttctctggatgcccccatgccagggctgggctggacgctctgccacgctgtgtccctgggtgtgggcctggcctggtgggggagccacaaactggtgtgtgcccggttcaggcctgtcttgaatccccagctcagtggtgatgtccgcccctcactgggaggttgtggctggcctgccccggaccaacacccgacctgaccctgcacagaccacaactgctgggagggtgatggatcggggatgggggcaacctgacttgtcatagaggcacatagtggacattgggggtcaggcagccttgcagacagcgccatggtactccctgacacagaaacgcagcgtctatagtcatgtgagctctgtgcccagagatcggaccgtaggcatccagcactggggaatccctgaggcatcgggcagaccaggtggcacaattcacccatggagttacgccctaccaaattaaaaacacagtataacacttacagagactcccattagaccacgtcca

SEQ ID NO: 702163 - DNA, 196 bp, Homo sapiens
ctatgctcatctgattgtggaagttctatcagactttaagttccgtggtcctttgatcagcagctcgtaaaactggggttctattgctccaacagtcataaataccccatctgctgtcctgtatgtcttatagaagggtgctccaacatccaactatgtcagtcctcgaggtgcttcccacagacatcaagtttct

SEQ ID NO: 702164 - DNA, 484 bp, Homo sapiens
gcaggtattttattaacttttttcccagaccatatgactatcttcagtggtctcccagcaatgtttagaggcatagaaaattattttcatgttatggactgaatgtttatgttccccaaaaatttatatgttgaagctttcaatgtgatagcatttggagttggagactttgggaagtaattaggtcatgaaggtggagccctcaagaagaatagtacccttacaaggagaggccagagagctagctagctatctttctaccatgtgaggatacagtgagaagttagcagtctgcagcctggaagaggtcttcaacaaaagccagccacaccttcaccttgatcttggaattccagcattcagaactgtgagaaataaatttccgttgtatataagccaccagttaatattatttcttatagcagcctgagcgaaaacacttcatatagagagaagatctgggaagcacatatcaaatattaaa

SEQ ID NO: 702165 - DNA, 115 bp, Homo sapiens
ttgtccccactatgcggcctagccgccgcattacagattattctatttcccccatctattgattctccgaccttccataatatctacatacaatcgaagcgacgtgacaatctat

SEQ ID NO: 702166 - DNA, 378 bp, Homo sapiens
attcgcggccgcgtcgacaaagattacgtgcgtgcatgtgtacgtgtgtgtgcacgtgtgtgtgtgtgtgcgtgaatgattgaagaatgttgtataatgagactggaggtggtggctcacgcctgtaatcctaaacattgggaggccaaggtgggcagaatacctgagatcaggagttcaagaccagcctggccaacatggcgaaatcccatctctgctaaaaatacaaaaattagctgggcatggtggcacgtgctggagttccagctactcgggaggctgaggcacaagaatctcttaaatctgtgagacagaggttacagtgaaccaagattacaccattgcactccagcctgggtgacacagcgagactgtctc

SEQ ID NO: 702167 - DNA, 534 bp, Homo sapiens
cccctcccggtgggtgttttcccccaccgggggggaggaggttctccccccccctctctttgtgggccccccggggggaggggtggtggtgggggcccccctttttttgtggggccccccccccccttttgttttttgttggggggggggggtgggctccccaagatgggggccccaccccccccccccccccttttttgggggtgttttcccgtggggccccccgccccccccccccccccctctgttgggggggggccccccccggggggggttggggtttctgtttcccccacgtttttggggccccccccccctgttttttgtgggttccccccccccgggggcggggagggggggggagtttttcccccctttttttcccttgccccccccccccttttgggggggggttttttttccccttttttttttccctcgggggtttttttttttccccttttctgggggggtttctctcctaaaaaaaaaaaccaacaaaacaaaaaaacataaaaaagggataaaaattta

SEQ ID NO: 702168 - DNA, 806 bp, Homo sapiens
tgtgtgtgtctctctgggggtcttttttttccacaaatatggcgccccaaaaacaaaaaaaaaaaacatcactccgcgggcccccccgggggcgccccccgcgaaaaagcgaaggaaaaacacccgacaacacgcgggcccccaggggtgtactcctctcgcgacccgccccaaccaggagagactaaggggggcgccacctaacccccgccgacaagagagggtgggggcggcccacaccacaccgcgcgggcccccccctcccgccgcctcgcgggcgacgtccgcccccccccccgcgcgggggcgcctccccaacacaccccaccccccccccccccgcccggcccctcttttcttctcctctccctctgtctgcgctctctctcgccggcgctcgccctccccgcgcggcagcgcggcggccgccccccctcgcgcgccggcgcctcccacaccagtctctctctccgcgcgccccgccgcgcgccactctctgtgcgcccccccacccgcgcgcgcccctctctctcccccgcgcgcgagacccctctccccccctcgccgcggcgccccccgcgctcactctcccgcccgcgcgtgtgtctctcttctctctcccctccccctctcggcgcgagaccgcgcctgcgccgcctctccccccctccccgccccccccttcttccccgcggcgcgcgcgcgccccgctcgcacgcgcgcctcccccccctccttctccacccaccgcccccccggcgcccccgcccgcccccccccctccccccccccgcccgccccccccc

SEQ ID NO: 702169 - DNA, 722 bp, Homo sapiens
  misc_feature (272)..(272): n is a, c, g, or t
  misc_feature (333)..(333): n is a, c, g, or t
  misc_feature (362)..(362): n is a, c, g, or t
  misc_feature (411)..(411): n is a, c, g, or t
  misc_feature (435)..(435): n is a, c, g, or t
  misc_feature (471)..(471): n is a, c, g, or t
  misc_feature (494)..(494): n is a, c, g, or t
  misc_feature (498)..(499): n is a, c, g, or t
  misc_feature (502)..(503): n is a, c, g, or t
  misc_feature (507)..(507): n is a, c, g, or t
  misc_feature (511)..(512): n is a, c, g, or t
  misc_feature (533)..(533): n is a, c, g, or t
  misc_feature (547)..(547): n is a, c, g, or t
  misc_feature (622)..(622): n is a, c, g, or t
  misc_feature (628)..(628): n is a, c, g, or t
  misc_feature (631)..(631): n is a, c, g, or t
  misc_feature (635)..(636): n is a, c, g, or t
  misc_feature (640)..(640): n is a, c, g, or t
  misc_feature (642)..(643): n is a, c, g, or t
  misc_feature (645)..(645): n is a, c, g, or t
  misc_feature (647)..(647): n is a, c, g, or t
  misc_feature (669)..(669): n is a, c, g, or t
ggagtggcgggaaaagcgaccttttctgagcgcgttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgttgcagcgaaggaccgcatgacccgtgctcctcaggtctgagagcacagacaaaacaacaactcttagaatataaatcaatggttgatgcaagtgaagnaaaacactccagaacaaattatgcaagaaaagcaaatcgaagctaaaattgaagacctggnaccaatgcactttgacagaggtaaaagtntgcttttgagataaaaaagcttgcattagacaggatgagactttcaacntgcacttaaaaaaaacctggaganaaattagcagacagtctagtgtgctcatggataacntgaaacacctattagagctaaantaannttnnctantganntcacagcaggaatcttgggantttagaggaaaaanctgcttgattattagaacagaagagattgggcaattaaaacaagcttcagaaagtaagctttaagaaatacgacntgaaangancaannagangnntngntttggacagtatggaaaactcngagaggatccaagagtcctttcggaaaacctaaaagatggagataaggatttc

SEQ ID NO: 702170 - DNA, 350 bp, Homo sapiens
gtcagtagacacttttgcatctgatggcttgaaatagttttctgtaatcaaatcctgactaaaatccattttaaagcctatagagagttaagaccaagtataaaacttgctagcggcgctctattgaccgagcatattacatttgtctgagaagagatacgcacactaaagtcccctacaagaactaatgggaaaggtcaaaaggtaactccactcttaaaatatgtcatgaaggtaattgtagttggcttatgggcatctcttgagggggaaccaccaactctcaattgggtcagacataagcatcagttatgcagccaaacctctttgttggtcattctagggaactg

SEQ ID NO: 702171 - DNA, 1444 bp, Homo sapiens
gagttctggttcgctgtcatcaaagtcgtcgcgattcttgcgatgatcgtgctgggtgtccttatcattgcaactggcctgggtggtggccctccgaccgggataggtaacctgtggcgacacggaggattctttccaaccggcatcagcgggatgctgtgcggttttgtcgtggtgatgttcagctttggaggggtcgagctcatcgggattacggcaggggaggctgacgatccgcgtcggtctattccgcgagcgatcaatcaagtcgtgtatcggatcctcattttctacatcggtgcaatttcggtcatgttgtgtctttttccatggaaccagatcggcaaggcaggcagccccttcgtgacgatcttcgacaaaatcggagtcgcaggtgcggcgaatatcctcaatgttgtggtgcttaccgcttccatgtcggcctacaactcgggcctatactccaacgggcggatgctttacagcttggccgctcagcacaacgctcccgggatcttctggaagacgaatcggctgggggcgccgtgggtgggagtgctcgcctcctcggtggtgacggcaacggcggtgctgctgacgtacttgattcctggaaaggtgtttttgtacatcatctcgatcgccttgatctctggggtcatcaattggacgatgatcatcatcaccaacctaaagtttcggcgaaggatcggtcctgaaggtgtcgcagcgttggaatttcggatgccggtaatcccgtcaccagttacgtggtgtgggtttttctggcgctcgtggtggtcatcatggcgatgatgccgagctaccgagtggcactcgttgttggtcccgtctggttggcgttgctgtgggtgggttatgacgtgtcctgcctggtgcgacgccgtcatgcctgaggggacgagcgtactgccccggtagcggggagaacagagcctagagcgcgtgcgggcccggcgcgattccccatgtgggttattgatccgggctgtgcacgcaggttttgtccgtgcgccctggacatggttcatcgcaacgggacggtccagctcagtggtgctccatgttggttaaacgttagtgccactggttggccgttagtaccggtcgtggttgtacgtcgagtgctgtgatgtgtttgcggttcaactctctctctcccccccccccccccccggtggcgtgtgtcgcgcgttctgtgttcagtgaaatgtcaagaaatggtgatcgtcttgtcggtgtctccgggcttgctggtccgcgatagcggcaggatggggacagtaatcgaggaaggatgagatcgatggccgacaacttcccccagttgtccgacgtgttgcgctgcccacaagctcccgttgacgtcaacagcattaataccgacgccactccgcaagctcctggaggcaaaagggagacg

SEQ ID NO: 702172 - DNA, 960 bp, Homo sapiens
gccgatcctacctgttggccccgatctcgtgtgctcggtcatctctgagatcttttgtgggacgccttggcaatactattgttctcgtcgcgcttctccccctcagggggtggtgtgccgcccctcacactgtctgtgtgacgggcgtgtacctccctcctcccatgtgcggtattctttgaggaggcctctttcttggccccggccaattttgtgtgggccccgccctgctcccatgctgtgtgaccccgtgtgaggcacgtctcgggtagattcttgccctcccggggctgttcccccttttctcgttatagtgctgtcgccccaaatacccgggcgcccctccttccatgcgggtgtcaaccaacccaacctctatagttccctccatatttccgagaccagatttttctgttctcctgccaaactcccctctctggtcgagagtaaaatatacgcgggtgtattaaacagctaaaagcgcatcccactaaacggcgcccctccatttagcgccccatcttggccgtctatccggttcccctcaacaagagcgctgccacatcacacactgtagacatacatatgtcaccaaatacttccccccactctacgtccgacacaagcgtcttcttacccccctccaccgctattcaatgctatcgctcttcatgttaaaatccttttagttcgtcaccaccttcctaatagtgtacagcagacccaagtttcacaccatattctccgcgtgtctttatacacaatgagtagaacacatcttcttaggaaaagtaccgaactaaataacacaagccaccctctccgcctgcccccgcaccacctctgttgcccaacccctttgttctcttccccttcaagctccctgtctccccttcctccctgcctcctcatctccactccccccccccagaccccctttccccctccccccacaaaaca

SEQ ID NO: 702173 - DNA, 303 bp, Homo sapiens
  misc_feature (58)..(58): n is a, c, g, or t
  misc_feature (64)..(64): n is a, c, g, or t
  misc_feature (105)..(106): n is a, c, g, or t
  misc_feature (236)..(236): n is a, c, g, or t
gtctaaaacttgccttgcaaatgttttagaaagttccccagtcggcccaggctatggntgtcangcctgtaatcccagcactttgggaggccaaggtgggtggannacctgaggtcgggagttcaagaccagcctgaccaacatggagaaaccgcgtctctactaaaaatccaaaattagccgggcgtagtggcacatgcctgtaatcccagctactcgggaggctgaggcagaanaattacttgaacccgggaggcagaggttgtagtgagctgagattgcgccattgcactccagcctggc

SEQ ID NO: 702174 - DNA, 420 bp, Homo sapiens
  misc_feature (115)..(115): n is a, c, g, or t
agcgggaagcccaaagcagatcaaagtggtgggactcgcgtcgcggccgggagacgtgaagctctcgagctctccgctgcgggtcggcgctcgcctcgctctcctcgccctccgncccgtgccccggcccggcacgcatggagagatgagctggatccagaaggcccaaagctggtggcccgaggcaggcgcgagcgcgtacgacgacatgtgcacctggattaaggcagtgagcgcgacaggggcccagactgtgccaagagagagagcgcactgtgctctgcgtgcctaacagagcgtggtcgggcggccgatgtgccggctggagggtcatctcgtacatcgagcagaagaacgacacctccgacaagaagttgcagtgattaagactatcgggagaaagtggagtcgagtgagatc

SEQ ID NO: 702175 - DNA, 129 bp, Homo sapiens
cggtgccttagctatggattatacatcagtctacacttatctacatagattacaagtgatgatataattttagtctttatcataagtacagggttttaatacatcattagttctgttaaacattaagtc

SEQ ID NO: 702176 - DNA, 716 bp, Homo sapiens
tgggtggagcacggggtactttatggagggtacatgacaaggtgcggctccctaggcccctcccctcttcagggggtctacttggcaacggtgaggaggggaaatccagggtggggggggactgattgtggcagggactccccagcagtgagggtctctctcttcctctgggtgctctgtgcgggggctgggggtccaggggtctctactcctgggaggccattgtgggccatgaggctccaccacccgtgtggctgtacgccaaatcggtggctcataccaggaaatgagcttgacaacagtggtcgatagagggcaagtgccagccccagcgtcaaccggtggaggacgtgggtgtcgctgtgcgaagccagcaggaacaccaccgggcggcccaggtggtacgccacaggatgcccttgaggggcgcccatccggacgccggcttcaccacctacgtggacagtcaccactactcgggcaggctccccaaaaaccggcaggtcaggtccaccagtgaacccgtatggcacgcgggcgacccgcggaaacgccacggccagtgagctctcccgaacagcaccagcgaatggacacttgacccaacagccttggcagggccagcaagagggcagggacagatcgacccgggagacgccccggggacatacaccccacagctcccgaagggggccaacacagcactccaggagtga

SEQ ID NO: 702177 - DNA, 111 bp, Homo sapiens
aaacacaccaccccccgaccaccaccacacgacacacccgcaccacagatgtaagaggctgccctgtttattcactgaacgagcgggcgctcgagttactgagctgaggaa

SEQ ID NO: 702178 - DNA, 1026 bp, Homo sapiens
tattgctgtagctcgagaacttcaaccttctataatttttatagatgaagttgatagccttccgtgtgaaagaagagaaggggagcacgatgctagtagacgcctaaaaactgaatttctaatagcaattctgatggtgtccagtctgctggacgatgaccgagtacttgtacatgccgtgcaactacactagcgccacaacgagcttgcatgaggctgttctcagcgcgtttcatcaacacgggctatatgtgtctttaccaccctgcagcgacgacccacgactaccttttgacttaaccacactctgcttatgctaacaccagcgcacagtccacttgaccccacacccacgaacctagcccacacaccttgcctcccacctgcacctgactgcgcctcactcacgcgacgctgaccctcaccagtccttctggccaccaccgcactgcccgcccaccttgcggctccctacttctccgcagcacagcctacgaaaaacgcaaggaaaaccaggggtgcccccgcaccctccttgctcttcgcccacgcctgcaggccctcgcacgcacccacctaccttccgcagctccccttcgtgtacccttctccgccgtgcgcacctcccgttctgcacctgcctcccatcctcacctcacccgtcccctgccgctccacagccccccttccccccccccctctctagccacaccccgcctccccagtacccgttcaggaccacccaccgcgcagcctctctgcgccgccatctatcccaccctcgtttctcccccccacatccttcaccccctgtcggctcctcccccctgcccacgcacaccctccttctgctcccgttccgcctcctccaccggccctgccttccccgccaccccccattcccgactgacacccggctcgctcccagcccctaccgcgcacaccgcccggccctaacagccacctccccccgcgaccccttccccctacacaccgccctctcccgcgtgcttccgcgggcctctc

SEQ ID NO: 702179 - DNA, 210 bp, Homo sapiens
accgtacagctcagatcccagagaaaatatgaagacttcgaagagtagcatgaggaaggagagatacaaggtgtctaaaacatgacggaggtgagatgaagcttctgtcatggagtagaaaatgtatttaacatgacaatagagatacaaggactacagagccccgaacttactaccaataagaagggcaaagtcttctacgattaaaat

SEQ ID NO: 702180 - DNA, 371 bp, Homo sapiens
  misc_feature (114)..(114): n is a, c, g, or t
tgtgaatgatccttcccggcccacagtcaataagggctcttgtgaaacttggagtacacttattatgggttgcctttagtcctgttgtctgggccctgattttttagatccggnagagaacgctccctcaggggtctgagttctaacccttggccctatcgttaactccctgtgccaccctaacaggtgacgccttcctattctaggcctcagtgtttctcatctgtgtgcaatggtttataatgcttacctcacagtgttactgtaaggattaaagaagatagtatatttgaactggggaggcggaggttgcagtgagctgagatcatgccactgcacgctagcctgggtgacagagtaagacttgtctc

SEQ ID NO: 702181 - DNA, 1147 bp, Homo sapiens
ctttcgcttcccttcccgggagaggctgggacccggactccagaggcagtactgtggccgcgtgcgtatctcagctccgactgagtcagggttgcgtgagcactccaggcacgcttccaggggcgagtacctcctgatagtcgacatcacagtacatccccatggggcgaatggatgcttgatcactgggacaggaatacgtcacgatcgtagagtagcctaacataggatgggttactggcgagaagtctcttcagctggcactgcagtggaggcgatcagggggtttggagccttgtgaacatgggaagctgccccccaacacttggacaggacctgggtttcacgtgcatgagacatggggtatgatgtaacccgtttccacgggggaatgttgacgaagatcttatctgccctattggcagtggagtcttggaggagccagtacaggcacctcattgtgaacatgctttctgcaacgcctgcatcacccaggtggttctctcagcaacagacatgtccagatggaccgtagtgtagtgacggtaagcccatctgcgcccagtacctcggatcatgcggaacatgttgtcaaaagctgctagatttgcctgtgacaacgctgtgttcggctgtagtgccgttgtccggacttgagaaccctcatgtctcaacctcagcgactgtgagcacaagccgaagcgggctgtgaccttgtgaacaggggcctgtgggccttggaggatgccccaaagatgaagctgaccgaccattaattggcttagcaactgggctcaatgggtgcacagccaagcagagagacgcatcgtctccgagaagccggacaagaatcctcaggcttgaaaccaacacacacacttgggcgaggagaaaacgggacaccccgaccggctaaagaccatacgggggtaaaaccccggggttatacccgctcctttggaaaccgcggcgagcgaacaggagacgagacgaccaacacacggggagaacaacccatcacagaaagaaaacacgccgaggaggaccaaacacacagaagtgcgccgagaagagcgacggcggcagagacaccctcacatacaaaagcagcaccgagcagccggcaatgacagaaccagtcactgct

SEQ ID NO: 702182 - DNA, 366 bp, Homo sapiens
tctctgtgatgcaacaagcattcatttggattagtctcaagttgcgctcagcagtgatccatgtcacagtaggtatgagcaagagttgcaagctgtgcataatctgtagcaccacagcgtatatagtgagcgtctcaagcctcacgttgattcatcagcaacgcatgtgcccgatcattcagtcaattcattcacggagtttacatgatcttcatcttctaccgaatctttaatccatagagcagcttaatccgtgtgtgcattacgagggatcacacccgtgcaataagttgagctaaacatcaacagaacagtaattaaggttacgcacttcattgtgccaaaggcgtggatggtgcacataag

SEQ ID NO: 702183 - DNA, 440 bp, Homo sapiens
ccaagaggacccggtgtccttgtctcaaaacgagttatatttcaacggtttttacagctaagacttgtacttactgcctgctgtgacagtgtatgcttcatttgtatcccaccagcaagtctacataaaactttaaaaccatcatgactggattgtcaacatcgtgtattggggcagatgctttttaaaactgtcggggtggagaaaacttttatattaagggccatttgggattttattaaggtggtaagggaaaggagggcttacaaaaatggtttcggtaaaatattttaatactggtttaaggtggttaaaacaccaaacccctggtcttttctttttggggttgaggcttttttaagaaaagtcgaaggtgaaatggttggcccagaccaaaggggaaaaccaccggggtaacccgcagctccgaaattccggta

SEQ ID NO: 702184 - DNA, 1062 bp, Homo sapiens
cagcgtcgtgatttatagggcgctgggtgcctgtcatggatggtgtggcagagattcaagctccctggcagtggagaagcgagtgtgacgttccaaggaagggtctttgagaaaggggtagggagactgagatcaggagaaggctcccagtgaactgtctcagtgggagcagacagtgtttgtgagggtgacagctggggtctccaggtagatagaccacggtgcatggctgagaggaggtacttcttggcgacaagggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctacctacctcctaccatctctaatgtagctctgacccctggttacctgtggcctgggaacgaacaaggaccagtctctgagcctaggagtgaaaccaaacgctggtgattagcacttcgtcttagtttctgggaatttggatttatgactcttgtatccacgtcagagggtagcactagacatgctgctatcatatccacccgatctatggattgctggctggggggtctgcctgccttccaggactgactgctgacaaataattcctgaggttctacacaggtctcatggtggctgcaacctagctggaccctgtaagcctagacacattgtaacagaacagtcaggagcctgacaaggagacgaacaagaaggaggaagacgacagagaaaggaacatggaagaaccaaaacagttagccgaactctgacatctatccgaagaatggagacgcaacagaacacaagagcctaaccacaagagaggatcggaagacaaaaagggaatgagaacggaccagataatgtacccatgatgagagccagtccagagccagtcagcgacatgagcgaggacagagtcggggcaccatgccatctctaccaaaagcagcaggacaaagtcgagaacaagcgacaaacatacga

SEQ ID NO: 702185 - DNA, 332 bp, Homo sapiens
  misc_feature (1)..(1): n is a, c, g, or t
  misc_feature (107)..(107): n is a, c, g, or t
ncggcgagggaatggtggggaagctgaggaaacttcctattatcattattttttggagacagtctcactctgttacacagggctgaagtgcagggcacaatcttggntcactgtaacctccatctgtcaggttcaatcgattctcctacctcagcttcccgaacagctgagattacaggtgtgcgccacccgcccggctaattttcgttttttcagtagagacaggtttcgccatgtgggccagactggtcttgaactcctgacctcaagtgatctgcccgcgtgggtctctcaaagtgctgggattacaggtgtgagccattgcactccgg

SEQ ID NO: 702186 - DNA, 111 bp, Homo sapiens
gagcagacaggagagtgctggtacaaggtgactttgaactgtctacagagactaatttcttgctgtatttaagacaaggcatctcacatcttgcacggaggtagaactgag

SEQ ID NO: 702187 - DNA, 1151 bp, Homo sapiens
gttattatttctttgtgtatttggttgtgtgtctttatatgttttcatttattattgggttaataaatttgatgttgtggtgtttttggggatgtgtgttatttttgtagtgtgattagtttttttttggtgtgattgtgcttttgtttgttgttttgtggttatgttcaatgattttttttattttatctaggttattttgtttttttattttagtgtcttatttgttttttcgttatgtattactaactctttttttgttagctctggttttaattagtttgttgagcctattctttatttattgtatttggttctttacggttgttattgtgtagctttctctttgggctttattggacgttcttatagggtcctgtgtttaagatggcattgtcgtttgttttgtgtgtgtcgtttttttttttttcccttgttttgtgatttgttcagttggttgtttatctcttgtattttgtgttgagatgctctgcgttattcgggtctagtaattttgcttgttatcagttagtacacattaggtgatttatgttatcgccttttttatcttgtagtactttactaggtagtctctattatctatgtctttttctatctcttcgcatgtgtggttaattcctgtgctaggttccctgtgttctgttgttgttaatgttttgcgcgaagatactgttgattgttgcatatgtagcagtggttatgtgtctattggataaatttgccgttgagtttcatatgatatattagaaatttttcattttctttcttgttttttcccccctgctccacacttcaaaactcccgttagatgcagcagttctactacaagagtgaaaggaaaaccctaacagatctgtcctagtgatgtgttacctttgttcgtagaaggcgctcctttcagggttgtcggtattcttaggtatagcggagctgtttgtcctgcttattccccacccatgctcgccgcaatattgcaccagttagttaaattaacctctttctttaggttggaagccgtggcagttctgctcccttcctaggagtctgcccctgcactctgtagcttgcttaacggagcacttctcctttttaccaaaggtctacattctagggtaagggcctgagttgcc

SEQ ID NO: 702188 - DNA, 610 bp, Homo sapiens
  misc_feature (404)..(404): n is a, c, g, or t
gattattcctctgaacctcataattttttctttgtaaaatgggaatatgtcaacccaaactaaggtgattgaggcagaaataatttgatcaagttttgttggaagctggatgtgaggatcggccaggaagacacacgcaccaagttaggcatgttccagaagctgttacaagtgggaatgctttcataagaaagtagaagggaaggggactcctcagatcagagttgtcctttgtcattggagggttacaataattggctacagattgcaacatacagactaaaatgtctacatgccagcaatcggtacaacttcatgattcagaaatgaatcagcattttttcatgtcaatagattatgcattaatcagtacatcagcaatttgaggagctcagataagattnttcactcgggcaggatattgccgtaaatcacaagacctccctgaagcaggttaatttggaagcctggcaaatgtgaactgtagattatcaacgcccatagtagtaagatgtattgaaagtgcctgattcgtaatatgcttttctacgcatcaccatccctatacacacaccaagaagtgcaaaaaaaaaacaaggggggttggggc

SEQ ID NO: 702189 - DNA, 406 bp, Homo sapiens
taggcccttgctacacgggcactcactaggaggacctgtccacactggggatcctgcaggccctgggtggggacagcaccctggccttctgcactgtggctcctggttctctctccttcccgctcccttctgcagcttggtcagccccatctcctcaccctcttcccagtcaagtccacacagccttcattctccccagtttctttcacatggccccttcttcattggctccctgacccaacctcacagcccgtttctgcgaactgaggtctgtcctgaactcacgcttcctagaattaccccgatggtcaacactatcttagtgctagccctccctagagttaccccgaaggtcaatacttgagtgccagcctgttcctggtggagtagcctccccaggtctgtc

SEQ ID NO: 702190 - DNA, 368 bp, Homo sapiens
  misc_feature (11)..(11): n is a, c, g, or t
  misc_feature (289)..(289): n is a, c, g, or t
  misc_feature (313)..(313): n is a, c, g, or t
  misc_feature (331)..(331): n is a, c, g, or t
attgactccantatgctacagagaaatctttcatgaaaggaagagtcaactcatgcgaaaagcttcaccgatgtcttattttaggaaattgccacagccaccccaaccttcagcagccaccaccctgaccagtcagcaaccatcaacctcgaggcaagaccctctaccagcacattactattgcatcttcccataacttatgggaccccatgagccattgatctcttcttttcctcctgccatccagcttacagcaaccctcttaacaccttccagagatgtaaaattnttaaatccaaccaccctcctcccnattaagtatttccaattntggaatcccccatttttgcctaggaccttttagggct

SEQ ID NO: 702191 - DNA, 532 bp, Homo sapiens
acgttcgcacaccggatcttcgccgagtgccagggcgcagcgcgtggggcgtgtgcctcgcttggtcccctccagcgtcaccatgctgccgccacagctgtgctggctgccgctgctcgctgccttgctgccgccggtgcccgcgcagaagttctcagcgctcacgttcttgagagtcgatcaagacaaagacagagactgcagcctggactgcccaagctcccctcagaagccactctgtgcctcggacgggaggaccttcctgtcccgatgtgagttccagcgggccaagtgcaaagatccacagctggagatcgctcaccgtgggaattgcaaagatgtgtccaggtgtgtggctgagaggaagtatacccaggagcaggcccggaaggagttccagcaagtgttcattccagaatgcaatgatgacggcacctacagtcaggtccagtgtcacagctacacaggatactgttggtgtgttacaccaaatggaagacccatcagtggcactgctgtggcccacaagacc

SEQ ID NO: 702192 - DNA, 404 bp, Homo sapiens
acgatgcgtgacgtaatggagtgaggggtgtgccgtagtataaggcgacacgggccttgagcgcatcggagagggcggctgcatcctcaaaaccgttcagcacgtcgaacatgccgaggcctttactggcgtccgcaggaacggcgagcatgcgcacctccataccggctttcagctccttgttggcatccgccatgtgctgcgccaacgtcttctcgccggccgagagaaacagcaagcgccactcctgcacctgtcggcccgcttgtccttcgatcattcgcccgggctttgccggtgccattgccgagcatgtacaccgtctcgccgataatgcgcgggtcgcacatgccgatttcatccagtaccaggaggccgtctgagtgcgcagcggacattgactc

SEQ ID NO: 702193 - DNA, 167 bp, Homo sapiens
tgcagaaagaaaaaaaaaatccaaaaattagaaaggcataggggtagtagcacatgcctgtaggcccagctactcaggaggcttaggtgggaagatcaaggctgcagtgagccgtgattgtgccccctgcattccagcctgggcaacagagtgagaccccattgcca

SEQ ID NO: 702194 - DNA, 293 bp, Homo sapiens
cccaattttatttttttaccctttttttatttcttaaaaaaagaaagctgaaatttaaagggagatctatgggggattctttgggttttttaaatggttaacccctaaaaaaatttgggggtccggatttatggttttgttaaaaacaaacgaattgttaaaatggaaagcaagtttttcaaaagccccggtttaaaaggaaagggtggttttttgttttataaccccagcccctctttttttgtgttaatcataaacaataaacaaaaaaaacccgggggccctttttaata

SEQ ID NO: 702195 - DNA, 390 bp, Homo sapiens
  misc_feature (48)..(48): n is a, c, g, or t
  misc_feature (147)..(147): n is a, c, g, or t
agcttcacccgctggccttactgacgcgttctgaaacgcggcattacnggtggcgtaccagccagcgttaaaatcagcaaaacggtatatcggtgcgctataactggcgggataattcagtaaatggtaagtaccaaaccacaaccngccgcggcgactgaagacttcctgacggactgtaccgtccattttccacggataccctttggtatgctgttcggcaaaagcaatgctgacctgcatcggcccaccggtgcgcaccggattgagcgaaccaaacagcgtctgccccattggcaccatgttgatcagatcgtcaaaaatcgcgctcaattgcttttctgtacgcaccgaatctaaccgttcgctataacttttgccgtttggcga

SEQ ID NO: 702196 - DNA, 1266 bp, Homo sapiens
caggctgccgaagtgtggtgtggcgcacaactctgttcgtaagcccctagaggggggaaggtccccctgtttgggttataacgccataaacccctcttgtgagactttcttgcgcccagaggggaattttgcgtccaggaggctatacaccatatggtcgatgtcgacccctctgtttgtggtgcctaaaagcacggggggtgcaccaacggtctgtgtgcaaagaaaagctgtctctcctgtttgggtttctggggaattactccctggtggtggccgccggcttccaaagagattgtttcccctttcccgcgtttttttttcttggggccttaagaagaaaagccttccaatgccccggctgttgttccgggcgttgtttttttatatgaaggttctcacagatgttaccacagatggggtcaacggaagatgctccacatcacaacggggggagaaaataagctggtgaagcgcctcttctttcgggggggggttctggtattgtgaagccccctgcgggttttaaacccttcgggggagggcacccaccctctttttcgccctctgtccccgcgatttggacacccttgggggaaattggttgggtctcacgcgccggtgggcccctctgcctgttgtcgcctgggcgacaacgtgtgtgcctttctttcgggaaaaaaggggagagataggcccccccacggggggtctttatggggcaagactggccagaaaacccctcgttatagagcccctggggcctctctccgaggggccctctcttttctggagcctctcacaagggtgtcaccacacgcccctctctcaagagttctcttctgtcacacgccactcggtgaaatgtggctcggctctcgtgggttcttgtctggtccggtgcacccgaatgcgaccaccacccgcacccccacaccacctgtagactcttgagaaattgggcgagagtgagagttgaggagacgccacagcttttcgtctggggtcatatacacacgcacagccacatgggttgtggcctgccgttcactggtgggtctttcacggttattcttggcaacaatgaccacgtggttttattttttttcttttttgctttcattggacacagtgcacgtgatctataaaaatttttcttttgaggttttaatacctttgtagcattttagatgacaattgggtttgtactttgttgtgtagagctggaagaaattgtgttgaaataaacccaagatcggaaagcca

SEQ ID NO: 702197 - DNA, 337 bp, Homo sapiens
cggatccctacgaggtgtctgctgctgtaggcagagcctgagtaggctgaataaggctggatcatgaaccattctttaaagcataggcctttggtatagcagtctagttgacatacatgcatacctaccggtgtgggtgcccgtgtaactgaagaacagctttcacaaaataataatttagcacactgtggaattttctctgataacaggctcttctctttccatggataaaaataaattccgtggattatcacacccaatttgggacccttttaaaaaataaccacttaagaaagttgggataagcccagggtatcagaaacttaaaaatgggacc

SEQ ID NO: 702198 - DNA, 760 bp, Homo sapiens
ccacgctgtctggccgagtctgagtgctcgtgacttcgctgatgtcatggtggcaacccggtgtgagaggtaggatgtccggcggcgacgggccgagtcaccagccgccgggcagtagtcgaaggccggcgcggatgtctgggtgccgcggtgcgggcgtgacgcgcgccgggcggatgggccggcgccgggcgccgagctgtccgggctcgttcccgttgtacgcgcttcaggtcgaccccagcatgggctgtcatcgctggggcggggaggcgccgccaatgacaggcataaagaatggcgtgcactttctgcagctagagctgattaatgggcgcttgagtgcctccttgcttgactcccatgacacagagacacgggccaccatgaacttggcactggctgtgtgacatccttgctgcaggcaggatgcccactgtcagctcctgcgcttccaggcaacatcaaagcaggacaacaaggcagagacggccggttccaaggagcaggggcctcgacaaaaggactgggagcaggccccaagcagaagaacgaacatgtggcggcggaaaccccagcaacgaggggctaagaactccagggtagaggaatacggcaggcggtgcagacaagacattagctccgatccacttgcagaaagatgggtgctacaccacgataatacctgcttgccgtggacggaaccgatggcaagtccgtgctggaacgtgccagctgggaaggtctggagttaaagcca

SEQ ID NO: 702199 - DNA, 110 bp, Homo sapiens
  misc_feature (98)..(98): n is a, c, g, or t
gtgtacaaggaggctgctctgagttgaggacatttgaactaaggcctgacatgagaagaaatcagctatgcaagatctggggaagaggcattcctggnagagagaacagc

SEQ ID NO: 702200 - DNA, 123 bp, Homo sapiens
ggctccccctgactccccctgactcccccccgtgaccttctcctggacggtcgtgcttttcttactactgtcaccctggtgccggtggtctcgctgggtaccgacgctcgccttcgtcctcct

SEQ ID NO: 702201 - DNA, 217 bp, Homo sapiens
ttactcatgcaccccaatgtatccaagctgtagttgagccctacaactccatcctcagcagccacaccactctggagcactctgatggtgccttcctggtagacaacgaggccatctatgacatctgacggagaaacctcgatatcgagcgcccaaactacactaaccttaaccgccttataagccagattgtgtcctccatcactgcttccctgaa

SEQ ID NO: 702202 - DNA, 369 bp, Homo sapiens
gttggcagtcgaatgctatacacatatatcactgtctttcttgctcccatgagacacagagccgattcaaatggtgtactcatgggcagctctaatgtggtaaggtggatcaatgggctcttcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtga

SEQ ID NO: 702203 - DNA, 413 bp, Homo sapiens
gtcaacctttatttcaaggcagcccaaaaggacggctctcccttctctttcactctcttctctaggtgtgaagctgatgcagcacaggcgagccccaaaattgaggcttagccgggggggttcttggcttctcctagaaactaattcaagaagccgggcgcagtggctcacgcctgtaatcccagcactttgggaggctgaggcggatggatcacttgaggtaaggagttcgagaccagcctggccaacatgctgaaaaccccatctctactaaatatacaaaaattacccgggcatggggacgggtgcctgtaatcccagctgttcaggaggctgaggcaggggaatcgcttgaacccgggaggcggaggttgcagtgaacagagatcgtgtcactgcactccagcctgggt

SEQ ID NO: 702204 - DNA, 268 bp, Homo sapiens
ccgagcagaatacagcgccagagttagggtttgcgactccgcactccctgggacctggatagggtcagaatgcctgtcctatggaggggacaaggttgactgcttagagagagcgcgacagcacagaggcatgccaggccatggacccatcatctgggcaaggttgagagctgagcatgggcagcacctgctcccttcactaccagcatccgtactaggattctttatcacaccgataatgtatacataacagccttgaaagcagaca

SEQ ID NO: 702205 - DNA, 747 bp, Homo sapiens
  misc_feature (13)..(13): n is a, c, g, or t
catcgaactcccntttcttcggaaggcgcgccattgggtgggtccccggaaattcggccataatggccgagggtaccacccttttattaaataactttttccgttgtttaagttgaagatttaattcaggaaaaaaaaaaaaaaaaaaaaaaaaaaaaaaaccaaaaaaaataaaaaaaaaaaaaaaaaaaaaccttgtggcccccttggcccaagcggattttgaattgggcaaggttatgccttgggcccgaatttggggttaattggccaatttgcccttatggggggccgatttaaatttaatggcccgcgttttaaaaccgtgggactgggaaaaccctgggggttcccaacttaaatggcttggagcaaaatccccttttgccaggtgggggaaaaaccaaaagggccggaccggatggcctttccaaaaggtggccaacctgaatggccaatggaaaattgaagccttaaaattttggtaaaaatcccggtaaaattttggtaaaacaggtcaatttttaacccaaaggcccaaaatgggaaaaacccttattaattcaaaggattgccccgaaaagggtttaatggtggttcaatttggaaccaggggcccctttttaagaacgggggcttcaacggtaaagggggaccggtttttagggcgaaggcccaattacggagaccattccccttataaggtttttggggtccaggggccctggccttaattggacccttggg

SEQ ID NO: 702206 - DNA, 104 bp, Homo sapiens
tagatcgagctcggccctgtttaggcatgctgttggcaggctcgcttgacatactctcctgcgcagccttcaggttctccttcttcccgccccaggccttcagg

SEQ ID NO: 702207 - DNA, 159 bp, Homo sapiens
ggtctcaaactctgactcgtgtccaccaccttggctcccaaagtgctgggattacaggcatgagccaccatgcccggctacggttcaccatttaaatcctggccacggctcgtgcatttctgctcggttggtgacagagatgttgacattgtttgagac

SEQ ID NO: 702208 - DNA, 104 bp, Homo sapiens
gtcacacccatttcctcctctttccctctccccgctgccaaaaaaaaaaaggaaccgtttaccaggaattaacagggtttcagcccttatcaagggagttgtgg

SEQ ID NO: 702209 - DNA, 348 bp, Homo sapiens
ttacaggtggtaaacccgaagaaatgttcattatagatgtctgatacatgtatggtctcggtagtacatatgaaattcactgtggggaatacacagaaagaggcagcctttctcaggagaattaaactgatgttgggaaagatgcccatatgagggaagagagagacctctcatattattttatattgttttatactcagtacctgttttaagaaaaaacaacaaggaagtaaaaccaagagacaggcagcccggcgtcaggcccaaaaccaggcctgggcctgcctggcctaaacccagtagttaaaaatcaactcataacttacaaaccgatgttattcatagatt

SEQ ID NO: 702210 - DNA, 547 bp, Homo sapiens
  misc_feature (259)..(259): n is a, c, g, or t
  misc_feature (283)..(283): n is a, c, g, or t
  misc_feature (311)..(311): n is a, c, g, or t
  misc_feature (315)..(315): n is a, c, g, or t
acctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattanttgattctgtcttctgtataactntgaagtccaccaaaagtggaccctctanattncctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaa

SEQ ID NO: 702211 - DNA, 143 bp, Homo sapiens
tgtattctgaggatccctcatagcttcgggctaccctcatcctcacgggactcctcgccaggtttctctaaggagcttgcagctgccctggctgcagtgcctggctttgagtgtgtccgcagctggattggagctcgggcttg

SEQ ID NO: 702212 - DNA, 296 bp, Homo sapiens
atgccgtcctctctttcgtagtgtgtaacagttatgcatgatattgaacttgtggcagtaaatatctacatccatgtaattgagatgtattaaaattactttaaatattataattatatctcagagttaaaatatatttatgttgttttgttcaattgtgtactaccaataacttgtgatacttcgagaagatgtttttcttttacatttagagcctagtagtcagaggaaaaaagtttcactcacatatatgttacagagtacaataagatggtcaacaaaaaactttaacacat

SEQ ID NO: 702213 - DNA, 132 bp, Homo sapiens
ggtggacagggtagctccccgccagtgtcgtttgagagctggggcacatagctatgtctctggggcggccacgtctgtcccaggctgacacgggacattcccagctgctagtgtcgctgttgctgctactgt

SEQ ID NO: 702214 - DNA, 228 bp, Homo sapiens
  misc_feature (59)..(59): n is a, c, g, or t
ctcgggctgctcctgagagcctgtctcatttctagttgtgtgactgtgctgtcacttcnctccttggtcctcacttccctatctgtatgtgaggctttgcaagatgagtgccagggtgcctcccggctcagaaagcctaccttggttctagagggagagattcccagactggaggggaagggaaaggagggcagcaagctaaattcccgcggacctgagcaagccagg

SEQ ID NO: 702215 - DNA, 322 bp, Homo sapiens
ctcagcctcccgagtagctggaactgcaggcatccaccaccacgcctgggtaatttttgtatttttagtagagatggggtttcccatattggccaggctggtcttgagctccagaccttgtgatctgccagcttcggcctcccaaaatgctggggttacaggcttgtgcaccatgctctgccttgtgtgtgtatttctatgtcaccaaatcttcctcttataaggacaccagtcattggattttagaccaccctaatgcaatatgaccttatcttaatttgattaaatttcttcaaagaccctattttgaaataaggtcaca

SEQ ID NO: 702216 - DNA, 107 bp, Homo sapiens
tctccaccgtggaacatgggatgcaccggttgcacatctgtgtcgctgtccctctcatcgtggtttaactgacaggaagcacagagtacgatatggcacacaaatgt

SEQ ID NO: 702217 - DNA, 201 bp, Homo sapiens
ccctaggggactcttattaaaaatcaattgaggataagtataatcggttatataatctaggactctgatatctgttccgagtatagatctgtgttttcctttcttttgccattatccactaactactgttttcatataactagtacctatcgtaggtataagtatgagaatttgagacatttggaatccatccaactttca

SEQ ID NO: 702218 - DNA, 374 bp, Homo sapiens
taggtttctttttaaattaagaaataataacaattaaaggcaaaaaaccactgtatcagcatagcctttctgtatataagaaacttaagcagccgggcatggtcgtcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctca

SEQ ID NO: 702219 - DNA, 328 bp, Homo sapiens
  misc_feature (46)..(46): n is a, c, g, or t
ggagtcggccctgtgtgtagcacaataaggaagggccccaggtggngagagccccaagtgagaacaataatgaacaattatgtatgaacaatagttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 702220 - DNA, 455 bp, Homo sapiens
  misc_feature (119)..(119): n is a, c, g, or t
  misc_feature (154)..(155): n is a, c, g, or t
  misc_feature (375)..(378): n is a, c, g, or t
  misc_feature (383)..(383): n is a, c, g, or t
  misc_feature (386)..(388): n is a, c, g, or t
  misc_feature (391)..(391): n is a, c, g, or t
  misc_feature (393)..(393): n is a, c, g, or t
  misc_feature (399)..(401): n is a, c, g, or t
  misc_feature (404)..(405): n is a, c, g, or t
  misc_feature (407)..(407): n is a, c, g, or t
  misc_feature (414)..(415): n is a, c, g, or t
  misc_feature (417)..(417): n is a, c, g, or t
  misc_feature (429)..(430): n is a, c, g, or t
  misc_feature (435)..(436): n is a, c, g, or t
  misc_feature (443)..(443): n is a, c, g, or t
  misc_feature (445)..(445): n is a, c, g, or t
  misc_feature (453)..(453): n is a, c, g, or t
ggcgcggcctggaagaggccagtgtcccgggggaggcggcggcagcggcggcggctggggcagcccgggcagcccgagccccgcagcctgggcctgtgctcggcgccatgagcggcggngggccttcgggaggcggccctgggggctcgggcannggcgcggactagctcgttcgcggacccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggcccctgcgcaggcactagcttcccgccgcccnnnnttaancannnccntnacatcnnnaanntnaccacanncntatccacccaannccaanncccatancncacccaanaa

SEQ ID NO: 702221 - DNA, 433 bp, Homo sapiens
gatgtcagcactaaggcctcaccccccagagcttcccaggacattccttgcttggacagcagtgccccttgagagtgggcacacctatgtggtgccctgggcgactggcctgccccctattgaggagcgtgagagcccggcagcccagcccctgctggaacaccagtactgagctaccttgcgcccactggaccacctcctaggattcagtaacggacctgctctcctgcctctctcctggaccacagaactgagtggctttgggctacatgtctgaaccctgacctttggctgccttggcgacgagtaacaaaaattagttacccagaacctcttaccttgacccctgatcttttttattcccaggtcaggggctggggtcccagatgagggaggtaggcttccagcaggcctagagcaaacatgggtggtc

SEQ ID NO: 702222 - DNA, 502 bp, Homo sapiens
atgtatcatgtagcttagcagtgaatcacaatttgagattgagaggcaggtaaaatggtggatattgatagtttccctgtgtaaggctagtatgcttatctttcttccccaagattgttaagtgacttctacccgtatccatgatgtgtttgataatggatgcagtgggctgccattgagccttctgtttcttatatttcagtttcccacgtgatggtacattcttaaattcccaagaaatacccattgttatttcaagcagaataatcattaataggtgaccatgacagctctgttttctcacctagtgctggtgttctgtaccatgtattaggggaataatgtgaggagggggacaaaaatttgcagaaggtttatacaaaagaggagttgtcaaatagggtccagctactgataagagtgaagagaaaagcattacagatattcctcaataagaaagcaaatgacatgaaagaggacctgggaatacaagcatagtgta

SEQ ID NO: 702223 - DNA, 924 bp, Homo sapiens
tccattaaattaccctttatttataaatagcatttatctcagtgggctctatgccagtgggcctgggtatgggggtaggggggtatggcagggtaaaaagagggtgaagcaaatttcgtggcttcacagttctcttatagcctcaaaaattcccacgcaatctcccgtgtgtagtctctgtgtgcatctcccctctccccaccctcgtggaattagaagagcagggtctcttattaaattatgtcgctgtagaacaagtggttcacctcatagtttattccataaccctcctgtgtgtgtcaagaagccgccagaagggtttcctcctctcataggagatatattttctatagtgggcctctgtggacacttggactcatgtagaggttttccccttctcctcaaattttattacatttctccgagagaacacaactctactctcctcagaggtgtgtgctcccccccctcgctgtgagagaagagacgcccacaactttctccccctgtggaaccacaatgtgtgggtgggccccaatgaggcgggggcgagagatggagagaaaatccccaagacgtaggccctgtgaccgaggggggaccctctccgctgtggagagcaccaatatgggagagactcctcggtgggatcactccccgaaaaactgcctcgaataggtagtgaaagagcgggggaataaacgggggggggtgtttacaactcctcttccctctctattctattaagaggggacataatagagaaagaacacttcggcacaacagtactgtgtgggtacaaaaatcagaggagtatccataggaggaactcttggaactttcaaattcagactgtgagctgaagcgttggataataatccaacatttacccgggggggaaggactccccattttatacacaat

SEQ ID NO: 702224 - DNA, 343 bp, Homo sapiens
gccgcctctagaggatccaccttatgttctgacccacctgctagggggagtgtagagagcttgattgatgtaataggccatccacgcggcgaagccccagtgggaggggcagttcttgaagatgttgcgcaaaggcatactgccatgggagaagcggtgcacgaagggcgattccagcaggcgcttgatgtagtggaatgagtgacagatgcagccgaggctgttcggggggagcagcctcagctggggctgttccggcaggtcttttgccttcccctaccttcctcccacctgccccatttactgcaccactgtgtgccgactgcacttaaagtcatatttg

SEQ ID NO: 702225 - DNA, 193 bp, Homo sapiens
ccatgtcttcgagtttcgactcgatcagatgtgattggcccgtaccctgattctcgatcctaacagcacaccctcaggcccgggatccaaaagtggaccccatctcctctggcctcactcccggggctgccctgccccaccgcccggccgcccgcccggcctgcgggcaccgccgccgccggggcggccgccc

SEQ ID NO: 702226 - DNA, 859 bp, Homo sapiens
  misc_feature (1)..(1): n is a, c, g, or t
  misc_feature (62)..(62): n is a, c, g, or t
  misc_feature (134)..(135): n is a, c, g, or t
  misc_feature (137)..(137): n is a, c, g, or t
  misc_feature (139)..(139): n is a, c, g, or t
  misc_feature (153)..(154): n is a, c, g, or t
  misc_feature (188)..(188): n is a, c, g, or t
  misc_feature (192)..(193): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (274)..(275): n is a, c, g, or t
  misc_feature (278)..(278): n is a, c, g, or t
  misc_feature (288)..(290): n is a, c, g, or t
  misc_feature (292)..(292): n is a, c, g, or t
  misc_feature (295)..(295): n is a, c, g, or t
  misc_feature (303)..(305): n is a, c, g, or t
  misc_feature (307)..(308): n is a, c, g, or t
  misc_feature (395)..(395): n is a, c, g, or t
  misc_feature (431)..(431): n is a, c, g, or t
  misc_feature (516)..(516): n is a, c, g, or t
  misc_feature (520)..(520): n is a, c, g, or t
  misc_feature (525)..(526): n is a, c, g, or t
  misc_feature (533)..(535): n is a, c, g, or t
  misc_feature (537)..(540): n is a, c, g, or t
  misc_feature (560)..(560): n is a, c, g, or t
  misc_feature (782)..(782): n is a, c, g, or t
  misc_feature (789)..(789): n is a, c, g, or t
  misc_feature (825)..(825): n is a, c, g, or t
nacatgctctggggcgcagactttgttgcttgtaagtgcgtttccggagacccctggaattnaaatcattagcaccgcgcccttgcccccgaagagtctctcgaagggcttgccgcttttcggtggcgcagttnncngnagaacgcgtgactnnctttctgcggtatttcctggttgtccagaatccntagnncgaggcggaaaaaanatntcncccaccttgtgttgatgccgcgattttgactcgagactcccttcccacgatttctgtttnngcngggggggggnnnanggncccccccnnngnngccgccggcgacaccaaggggatgcacgagcccctcctcgctttccccgcctcggggcgaccgaacccttctggtcaggcacctgcnggctgagcttactgctgaggagaaagaggacttgcngaagtacttcggggctcagtctgtgcgggtcctgtcagataaggggcgactggtaagggcgcgcccctccggagtctcccgggantttnttttnnaagtgannntnnnnggggagcgctgacaagagtnaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatctatcctgagagctcacaacttntttgaanttgggggtatttctcctggactcaagagtatcttanaaatgtgcatcaagggatttttgaaagtcctact

SEQ ID NO: 702227 - DNA, 159 bp, Homo sapiens
tatacaccagtaacaaactagctttaaaaaatcaagaaaaagccgggtgtgatgcttcatgcctgtaatcccagcactttaggaggatgaggtgggtgcattgcttgagcttaggagttttgagaccagcctgggcaacatggtgaaccctatctctgc

SEQ ID NO: 702228 - DNA, 984 bp, Homo sapiens
  misc_feature (18)..(18): n is a, c, g, or t
  misc_feature (39)..(39): n is a, c, g, or t
  misc_feature (42)..(42): n is a, c, g, or t
  misc_feature (61)..(61): n is a, c, g, or t
  misc_feature (87)..(87): n is a, c, g, or t
  misc_feature (585)..(585): n is a, c, g, or t
  misc_feature (633)..(633): n is a, c, g, or t
  misc_feature (644)..(644): n is a, c, g, or t
  misc_feature (647)..(647): n is a, c, g, or t
  misc_feature (653)..(653): n is a, c, g, or t
  misc_feature (663)..(664): n is a, c, g, or t
  misc_feature (685)..(685): n is a, c, g, or t
  misc_feature (689)..(689): n is a, c, g, or t
  misc_feature (692)..(693): n is a, c, g, or t
  misc_feature (698)..(698): n is a, c, g, or t
  misc_feature (700)..(700): n is a, c, g, or t
  misc_feature (707)..(707): n is a, c, g, or t
  misc_feature (711)..(711): n is a, c, g, or t
  misc_feature (723)..(723): n is a, c, g, or t
  misc_feature (727)..(727): n is a, c, g, or t
  misc_feature (816)..(816): n is a, c, g, or t
cctggagtgctgtgtcgnctgctcaccaccatcggcaanganctggactttgagaaagcanagccacgcatggaccagtactttaancagatggagaaaatcgtcaaagaaagaaaaacttcctccagaattcggttcatgcttcaggatgtaatcgacctcagactgtgtaattgggtgtcccgaagagcagatcaggggccaaaaactatcgagcagattcacaaagaggccaaaatagaagaacaagaggagcagaggaaagtccagcagctgatgaccaaggagaagaggagaccaggcgtccaaagagtggatgaaggtggatggaatactgtacaaggggccaagaacagtcgtgtactggacccctccaaatttttgaaaattactaaacccaccattgatgagaagattcagctggttcctaaggcacagctgggcagctggggcaaaggcagcagcgggggagcaaaggcaagtgagtccgatgccttacggtcaagtgcttccagtttaaatagattctctcctctgcaactccagcaccttcagggtccccgtcggcacacccttagagtttgntcccgaagggcgttaccagtcgtgggagcatggcagggagaaagagcnaaaagcaattncantggaanagccgtccannacgttctgagggggcaggaangacntgnnggcancngtccagnagancagcgcaaaagntgtnggaccgggaacagtgaagggggctgatggtgagggccacattgggccggccgagaaaggggcttccaattggagtgtgggtgggagccncttaaacctgctgtaaaggaggtgggagccctttctgtgagttcatagattgggggacgtattaagccgccctgtttggggtggtccaccgcacacgaagcactctcgtgtaacacaccatatgatatagtattttggccgagtaatctgtgtctgcgtcgcggcgag

SEQ ID NO: 702229 - DNA, 679 bp, Homo sapiens
gaactataggaatagctctaggagaacaaactgtgctttctgtaaaaaggcagaccaggcatgtcatgtttttaatgtttcagaagcctaactttttacacagtggttacatttcacatttcactaatgttgatatttggctgactggttgagcagtttctgaaatacacatttagtgtatggaaatacaagacagctaaagggctgtttggttacgcatctcatcttgcattctgatcaattggcaacggaaagggcacgatttcaaacattatatttcttgatggtatcttttcaacttaatgtatctgtccaaagtttctttgtaaatactatgtgttctggctgtgtcttacaattccaacacaaaatgatccctgcactttcctgaacgcatgctttacacgtgagagtctggtaggcacacagcagtctgacgacaagaaataggaaatgcagacacataggttccgtctggttgcatataactcttcgctcttttctaagctctgctgagctctgaaactactacttccgggttacttcagtgtgtttgacaagacagccttgatatttctatcaaacaaatgactttcatattgcaacaactctttgtaagaaccactcaaatcaaagtctcttaaaaaggcaacacaaaaccccaccacccaacacaagc

SEQ ID NO: 702230 - DNA, 814 bp, Homo sapiens
agcgggggtgtcattgaggcaggtccagagcctttgctgaccctcggggctccttcacccctgccccgaaccttccccgtcttggcctgggcagaccttccatgctagccctgggctccacatcagctccttacctgcagctgctcgctcatgtcagatctgccgacagccccaggaccatcgagccccaggccatcgtgacagctaggtcccagctcgcccagatctgaatgcatgatgccgacaggggaacccgtctgcttgcatgtcccacacctctgcaaggagctgctggccagggacaccgtgcaggtgcgagctcattccggagaagaagggcctcttcctgaagcatgtggagtatgaggttgtccagccagcggcttcaagtccgtcggtatatcaggacggtacaatgacttcgtggtcttcgcaggacgatgctcctgcacaagttccgcctaccgatatggtgcctgccctgccacccaagcagaatgcttgggagcttgacaggggatgttcactcggaggccaggaggagagcccgtgaagcgcttcggcaacctggtggcgcgatagcccccatgttctccgaggatgtggtcctcaagctcttcctgtccttcagcggctcggatgtgcacgaacaagttaaaggagtcagcacagtgcgtcggggacgaattcctgaacttgtaagctggataccagggccaaggacttcctcccagctgacatccagctcagtttgccatcagccgggagctgatccggaacatctacaatagctgtcacaaagctccgcgacagg

SEQ ID NO: 702231 - DNA, 294 bp, Homo sapiens
  misc_feature (21)..(21): n is a, c, g, or t
  misc_feature (103)..(103): n is a, c, g, or t
  misc_feature (222)..(222): n is a, c, g, or t
  misc_feature (230)..(230): n is a, c, g, or t
gttcctttttgtaaatatgtnacattcctgattgatttgggttttttttgttgttgttgttttgttttgttttgtttttttaagatggagtctcgctcttgtngcccaggctggagtgcagtggcgccgtctcggctcactgcaacctctgcctcctgagttcacgtaatcctcctgagtagctgggattacaggtgcctgccaccacgctggccaattttngtactttnagtagagacagtgtttcgccatgttggccaggctggtttcaaactcctgacctcaggtgatccg

SEQ ID NO: 702232 - DNA, 322 bp, Homo sapiens
  misc_feature (22)..(22): n is a, c, g, or t
  misc_feature (75)..(75): n is a, c, g, or t
cttttcctggtgttcataagtntagactatttccacttcagaaagttaacttttaggctgggcacggtggctcantcctgtaatcccagcactttgggaggccgaggtgggtggttcatttgaggtcaggaattcacaaccaggctgacaaacatagtgaaaccccatctctactaaaaataaaaaaaattagttgggcatggtggaacatgcctgtaatcccagcactttgggaggccgaggtgggtggttcacctgaggtcaggagtctgagaccagcctggctaacatggtgaaacccgtctgtactaaaaatacaaaa

SEQ ID NO: 702233 - DNA, 164 bp, Homo sapiens
tccaaagaggagggtggtctcagtaccatggagggtctggagctgcctgtaggatgaggaggagaagaagaagattgcagaagaagcacggcaagagtttgagaacctccgcaaggctcatgaagagaaatcttagataagagaggttgagaagcgtgacaact

SEQ ID NO: 702234 - DNA, 259 bp, Homo sapiens
gctcaaccggaccatcctcatgtgtgggctctcatcaaagaggagactcacatggttagtggagcctcgtctccgtggagatatgggaaggggcccctgactctgtacacataggggggtgtgagccagatgtgggtccattccgacctgggaatatgctctggagaagggtagagtggtcttggggatgtttccaggtgtgctctgtccttttccgagactgcatgacctggtcctccctctggtcatgggtgtacag

SEQ ID NO: 702235 - DNA, 186 bp, Homo sapiens
gtaatactctttggagtttgttgcctcaggagtatttggatgtggtagcaggagggccccgtgcttgtttgcctacctgatgccagagcagggagtggattcgtgggtacattccgtggtgagcagtcacagggtaactccttttacaacaccagctgtggtcattacctttactctcttgaccta

SEQ ID NO: 702236 - DNA, 533 bp, Homo sapiens
agccttgaagggtattgggaactaaggagttttcctctgacccgaaaaatggtgtccagatcaaaaattgcccttttggacattcgaacagagttcaagaagcattagggctattccctatattcagcaattaaatcggatacttttggagactatgaaatcccccttttaaaaatctgtggtggagatgactgaaccaagaaaataatctccaaaggtccacgatgggcttttccaacagctcccccttattttttttcatactatttaagagaacaagcaaaaataaacagcaacttgtgttcccaacaggaattttcattgttctaaaacacccaccacaaaaggcggatttatttttttagggcttttcatttataatgtagcagctcataaatgaaattgaaaatggtattaaagatctgcaactactatccaacttatatttctgctttcaaagttaagaatttttatagttttaatccattaaaaataaagcaagataataaaaattgttgcttttgttaaaagta

SEQ ID NO: 702237 - DNA, 225 bp, Homo sapiens
gcagtattagtgtatgatcaaatcaggctatataggatatcatcaccttaccatttgtttgtgttgggaacatttcaaatctgtcttctagctattttaaaatatacaataaattattgttaactatagccacctgactgtgctatcaaacactagaatttattcctttttttttttttttttgggcattctcatagtgtggtgggggactccctcatagagtct

SEQ ID NO: 702238 - DNA, 172 bp, Homo sapiens
tgagcgcaagtcccgtactcccatttggcggcaggacgaggtccgtgtgaacgatgacgctgtgtacggcccggtgtaaagcgtgagcaggccggccgccgagggggtcccgttctaccccagcccggtcgtgtgtgggttgacacaggaggccatctccctaaagaaatta

SEQ ID NO: 702239 - DNA, 280 bp, Homo sapiens
tttttggtcgattaaggatctcagactaaccaccacaccagcagtggataatgaatgatgaggaggctgcagtatgttcatgtataatgatccatatgcagatggggatcctgcttgggcccccaagaattatatttgagaacagttgttgcacatatactgattatacaacaagacaaggactgatgagctgtcatttatgagagggtgcaatcactttatgttgataaacgaagaatgactgatggctgtgtatgaaaggagtctgcaactcgaagtg

SEQ ID NO: 702240 - DNA, 416 bp, Homo sapiens
  misc_feature (290)..(290): n is a, c, g, or t
  misc_feature (407)..(407): n is a, c, g, or t
  misc_feature (415)..(415): n is a, c, g, or t
atgtagtagtttgtgtgatcctcatttgtaaaatggaaatactatttacacccttatgggttgttgtgagggtcagaatagattgtgtgcatgacagtgctttgtatacgcagacagaaggaaaaaagcggctgttattggctcaacttatttgacctttattttcatcatcatcggccactatttgatgtcaatctactatgctgtgagcaaacattaaaattagggaagccagggggtatggggaaccactggattaggcattcatatgcccaggatgttgcttcccntcccaaaggcacatggaacaggaatggattatttaaatttaccaagcctattcaggggaaccaggacccagcttttcttggcctccccttttctatgggattacccaaggtcccccntggaaccnt

SEQ ID NO: 702241 - DNA, 118 bp, Homo sapiens
ttgcagaacagatccgcacataaggtctcctgaccacactctcactgattaggccccatcaccaggctcactaactagattcccgctgccaggcccacagtgtcaaggaccccacgct

SEQ ID NO: 702242 - DNA, 428 bp, Homo sapiens
gaggagagagagagagagagagagagatatatagagagagagagagagagtgagagtgagagagacattgctagagacacctagtgctaaccttctcatgttcttgggttagagattatgcctgatcactatgacatccttccattagcacggatacttcttggctgattccttgcggtagaactcaatgtggcgcctgactgcgcttgcagaagttgtgttctagattcttgcagtaacggacttcgtttaagactattactggcttgaactctttttgcacttcataacagaagaagacctttttcctgattggttgagagacacttgccacgacctccctgagcaggcccgtgactgatcctattgcctacatgagagtagtgacacttttatgggatgctctgtgcgccgctgtcctccccgcc

SEQ ID NO: 702243 - DNA, 341 bp, Homo sapiens
aatgaaacatttggatttgaaattcagtcttacaggccccagaatcagaatgcctgctcctcggaaatgttcactttggatatgcaaaatacaagggggcaagccagcttcaactgtcttggcctcaaggttggtattgtccttccaaattatcattgggtgtagagcaaagagggtttaccctccacacaggtcgttgacctgtatcagatcgtccggaaacctgctaaccgatagagactctcaatggcacactgattctgaaaagaccggagcttgaggcatagctgcaggttttaaagcacactctgacacacaattggggtggagtacagatctct

SEQ ID NO: 702244 - DNA, 288 bp, Homo sapiens
  misc_feature (188)..(188): n is a, c, g, or t
  misc_feature (216)..(216): n is a, c, g, or t
  misc_feature (235)..(235): n is a, c, g, or t
  misc_feature (253)..(253): n is a, c, g, or t
  misc_feature (256)..(257): n is a, c, g, or t
  misc_feature (267)..(267): n is a, c, g, or t
  misc_feature (269)..(269): n is a, c, g, or t
  misc_feature (272)..(272): n is a, c, g, or t
aaaaattggctttgaaaagaatggttttttgaaaacccccagttccagtttgttctcccctggaaaaagcccttgcaaagcagagtttgaggattcagcccccgaacccagtaccagtgaaacatcaaatgccgatgcctggaagtaggcatataaatgctcccagttaaatctgacccagtaaactntgtgtgtttagggagtatacaaaagaantcgttctttcccttttctnatgttgttgaatacttantcnnaagggaatantnatntccaaagggagagaat

SEQ ID NO: 702245 - DNA, 281 bp, Homo sapiens
agttggcgggacttcctgggccagtttggggatttttacaaaagccccccatgactcagggttttgagtttttaactgatcgaatgaaggattcaaaattaccccctccaaggggggattgaaggaagaccccctcttaatggccaaaaagaaaaaaaggggagggggtaccagggatatgagctctaccccgcccaagttagcaatggccccccttcggggtccccttccggggtgtggaagttttcctttggattcattcaataaacagctgcggctca

SEQ ID NO: 702246 - DNA, 557 bp, Homo sapiens
  misc_feature (557)..(557): n is a, c, g, or t
ggagagaggaaagaaaacccccttgtggtttgggggggaaaaaaaccccccgggcgtttttttttttcccccccccccaggggggtgtggggaaggggccccccccgggggggggggggggcggggggaaaaaaagggccccaatttttttttcttccccccccaaaaaaaggggggggggggaaaaaaaaaccccccccccccgtttttttttgggccccccaacaacaaaaaaaattttttttccccccccccctccaagaggagggggggagctccccctcttttttttttgtttcccccaggaaaaaaaaaaaaaccacattttttttttaaaaaaaagggggggggggcccctctttttttgtttttcttggggcccccccaaaaaaaaaagggttttgaaaagggggggtttttagagaattccccaaaggggggggtttaacaggggaggggggcctttttttttccccccctggggggtggaaaaggcccaagctttaaaaagcattgccttgcctgggaaacaaaaagggtgggaagggctcaccatn

SEQ ID NO: 702247 - DNA, 138 bp, Homo sapiens
ggcaggcccatgtaggccttccaacagcagttgctcgaggacggttagcctgaaggcctcagggtccttcctttgcttgtgtttgagacagccatggcgctaccacactgcagtggctcctgtgtgggaggccctgac

SEQ ID NO: 702248 - DNA, 168 bp, Homo sapiens
cctagagtacaacccgctgagcctctctggtaaactggagcggattttttgttgtttgtttttatgtttttgttcaattggctattcctgagatgaatgacaaatttccttgattccattgtatatcaatttatactataatatcaataatagaatgttgaccatgat

SEQ ID NO: 702249 - DNA, 238 bp, Homo sapiens
agccatatttgagcataccaatgaaaatattcatacctatgccagttgcacggtggctcacgcctgtaatcccagcgctttgggaggccgaggcaggtggatcacctgaggtcaggagttcgaggccagcctggccaacgtggtgaaaccctatctctactaaaaatgcaaaagttagccaggtgtggtggtgcctgcctgtaatcccagctacttgggtgatgctcaaagatcttgg

SEQ ID NO: 702250 - DNA, 328 bp, Homo sapiens
  misc_feature (230)..(230): n is a, c, g, or t
  misc_feature (286)..(286): n is a, c, g, or t
tgagagggagtctcgctctgtcgcccaggctggagtgcagtgacgggatctcagctcactgcaagctccaccttctgggttcatgccgttctcctgcctcagcctccctagtggctgggactgcaggcgcccgcaccacacccagctaatgtcttttttgtatttttagtagagaggggtttcactgtgttggcccaggatggtctcaatctcttgacctcctgatccgnccatctcggcctcccaaagtgctgggattacaggattgttctcaaatgcttttaantaagtatcttgccctgcacatgtgttaatgggtaaaaagcca

SEQ ID NO: 702251 - DNA, 263 bp, Homo sapiens
gggcacgtgtgaattgtacatgtgtgaatgtggcggtgtgtgcatgtgtgtgcatgtgtgggtgtgtgtatgcatgtgtacatgtgtgagcatgtgtgcattgcttgtgtgtccgtgggcatgtgtgcgtgtgtgcatgtgtgcatgtgtgtgcatgtggttgtgtgcattagtgagtgtgtgcatgtgtgagcgtgtgcatgtgtgtgcgtatgtgcgtgtgctgtgcgtttgtgtgctgtgtgctcgtgtgtgtgctgtgt

SEQ ID NO: 702252 - DNA, 261 bp, Homo sapiens
gaaccccaaaatctttactggtttaactttaaccgccccccttggtgaaaatttaattttttccttaattcccaaacatttgctggtttggaaaaatagttaaaatacaaaaacaactgttcttggaatcccccaggactgcctcaaggactgggggggaccctttgttttccatccacacacagtgaaatggatgggagggatgagggaacaacccatcttgggagacaaagggaaaaccaaggaaagggctggcagtct

SEQ ID NO: 702253 - DNA, 106 bp, Homo sapiens
agtgtgactctatagcgatccccggttttacattcatttgcagtgaccgctgtcccaggatttggggcacagcccgtgagagagaccagtgtggtcagcgagtggt

SEQ ID NO: 702254 - DNA, 161 bp, Homo sapiens
gataaccatggagccgctcggcccgatggtccgtcacggcgacgaccagtggttcgacatcgtcaagtggcgcggtttgcgatgctcaacgccgaggaatccggcgtgacccagaagaacgtcgacgagatggccaagtgccgcgggttgtttgacgcaat

SEQ ID NO: 702255 - DNA, 847 bp, Homo sapiens
  misc_feature (503)..(503): n is a, c, g, or t
gtgagatgtaagttctgtcagatgcagatgtggaactcagccactggaatcaaatgtctgaaaaatcacattaatattatgcccagtattagaacaatatacaagatggttggcgaatgtgaaatgaccacatgtaagaccaagttcttctttgatggtcatgacaaatatgagagtaatgaagtaagctgtttcactgatacagtcatagtgtctaattgataatactacagttaggggctagagtgttaaaatactatctatctatgtgctaattgttgaaaccctaaaaatatggattgagaattgacgatgagagaagaggtttacggatagcatgtaaatacatgatgcgaagaagagagatgctcgagtgcaaaagtatagtatgctcacgacacagggtgggatggtataagacgcgatggcgtggttgtacggcgttgtgtgtagcagaagttgcatcaagcatttccagatttctaatttgtattggtaagcanacgagtatacatcggtaatcgactagagaattatttgagctataggtgtagggaattcttcatctcccatttggtcgcattgctcgattactaaaacagtgtggtactcttggatcatcaagacatcatcgttgcatagaagtcttaactcgagagcgtacgagtatgaataacgcagtgacgaaaatttatgggacctaggaagcagtttaagaaatccttaggaacgatctctactctcacccatgttaataccctgcttcctgggtagtccctcatttcgaacgtcgtggcgaacattatcgggagtgtccgaaatggcaaatatggaggctaatggatca

SEQ ID NO: 702256 - DNA, 606 bp, Homo sapiens
  misc_feature (33)..(33): n is a, c, g, or t
atctgttgatatttttgtttctttgttttgggnagataggtaagaaatagttacccaggaaagttgaagcatggtttgatggctaagaattttaaattgtttctgaaactagcattatttattttgctgctgccaggctatttaaacttaatgattttttcccctgtgtatgaaatatgatgctacttgggttcactttagagcttgcatttatttatgtatttattattttagctttagcttgtaattttccagtgatagaaattaccaaaatttgtgtgtgtcaatatgtttttgtatattttattaagtatatttttaggtagctaggtgaatggcagcataaattttctctttaataattattttatattgttcaaaactacttggctaatgagtatttttgctctagcatggaattctggaggagaaggttgcaatgtgatcagtatagacagtgtcttaatcttgagtttaaaagagaagaaagaaaaatacccattcaagtgaagatgataccaagcagtaggatgttgccagtgctgctgtacttatcaaaaagtgtttttaaaaactctttgtttattgtgtgcagctgaggagaaa

SEQ ID NO: 702257 - DNA, 271 bp, Homo sapiens
taggtgactctaaggatcccttgctttgggacgggccagaggacaagcgaaagctttgcagaattttcttaatcaagacgaaagtcggggtcgagacgatcagatacgtcgtattcgacataagatgcgacggatggggggtaatatcctaaccggcgggagcttccgggaaacccaagtctttgggtccccggggggagtattgttgcaaagctgaaacttaaaggaattagacggaagggcaccacccaggagtggagcctgcggctgt

SEQ ID NO: 702258 - DNA, 106 bp, Homo sapiens
aacttagtcatcccttccacctcctactgtgaagacaggccctgggtcccacactgaatcccctctagtcacccattcgaccccccaggagctgcctccaggcagg

SEQ ID NO: 702259 - DNA, 110 bp, Homo sapiens
gaagaccactaatgtattatggtatatgagcttccaataatgcccttgacagctaacacaaggcaaaatcatgtcagtgtatataaagcatcctcctgtgcctctttgtt

SEQ ID NO: 702260 - DNA, 223 bp, Homo sapiens
aagggaggttggacaaatggcccccccccactgttttcccctttcctttcccgtcccccggtgctttttcaaggcatttcccgtgggataaccgtggtttggttctttttacctgaatgtgttttttctgtttgggggttgtttttttttagtttccctggtttaaagtgttttaaaaaggggggccgggggaaattcttttaaaggccctttttctcctgga

SEQ ID NO: 702261 - DNA, 105 bp, Homo sapiens
acgttctctactacggatcatccttatgccagaaatcacatataaatcaaatcatataatgtatgatattctgtgactggcatctttcatttaatcatgaggttt

SEQ ID NO: 702262 - DNA, 395 bp, Homo sapiens
cgttttcacagggaaacaggtcttatcgtattgactcgggaataacctctcgtgcgtggttttctcaactactaacagactctatagatgttctggataaaagctcactgtgcgttgagtaaaacgctacatacacgattctgatctgcttcagtctggactagtttcttccaggtccctgaaacttttccttctgggacctccactgaccttcttcctggagattcttgtcaactcctccttgtgccagattacctgtttccagggttcactactgagaaagtgtgcacctaaggagaattctgaggactttgtctatttagaaacatctttactcttatcttgaattaattttggctgagtgttgaattctaagtttacaatcatttttgatc

SEQ ID NO: 702263 - DNA, 799 bp, Homo sapiens
ctggacaagaacttgtgggcaacaactttttgttttatcagacggacactcactctgtcgcccaggctggagtttagtggggcgatcttggctcactgcaacctctgcctaccttgttaagcaatttcgtgccttggcctccaagactgggactgaggtgaacattaccacacttgggtaatttttagtagagacagggtttcaccatgttggcctgtctgggtgattttttataccattttgttagtggtagggtggtatttattaggaattcttagctttgtgtctgtgtactaattatacagtatactttgtttctagtttcctccaaaaagcccagtatttctaacggcctgatgctctgtgcgacatataagtccgtttactaccttaacctgtgaacaccaaacctatttttctcgttctgtaatgccgaacctattcgcttttctgacatcacttcaatccatcgtctgttctttcatctataactaaacgtacttcataaaacaaatgtactctcttcttaatttgttccctaccataattttatctttactttgtccgtcgtagctgacgacgtctttcctagtcacacaccatcaacacgaagtcttttccttcttgcaattaatctgttttgtatagtttcatccgttctcgtgacccccccccacggcacactccacaccacctcactacctccacgcatccgcaccacccacccacgcccaccctaccttcccaacaatcacactgatttccttatcgcacaccccccgccaaacactcctcaccg

SEQ ID NO: 702264 - DNA, 893 bp, Homo sapiens
cgcccccagcccagagggccgcctgcgctctcgcccccggccctggccgcgcgtgccccaggtcccccagtagcgccccagcgccgctgctgctcagacacaccgaaataggaatgatttaatccaacgacacctcccagggctgcccagtcccggttccgccggctcctgagattggggaggggcagaattgggtggaactcgggctggggggcggaaatggcccgagtgggagggaaggcgcggagtcggacgctaccttgtaaccgagttagatttctgcagaagaggaggacgaaggtcgcccacggaccctcgggtgacctcgtgtgcggcctggtggccgggcacacccgcgcatggacgaggtccctcccaggggtctccctgcaggggtctccggggaggtagtgggcacgtgggtccttaacctctccattgcatcatccccatcccggtgggtacagaagcgcagcaaccccgcggttgctcccggaagacaccgcgtctccaacatttacacggagatgctgctcggctcaggtcgggtccgtacgcttccgaggtgcgtactacgcgagccacacacatcactaccgatattcctgagaaagtcggtgccacagtaagtcagctgcaagcgtggggtggccggtgacgcgctgtgcccgtgaatacgcccattgtgccggtcagacgcagccagggcgcagcgttcaggaggcgggtgggcagccgaactttcactggccacgagcgcttcaccttctagaatttgccagggactaggcatcaactcccagtgagaaaatcacatgtgaagttggaagacacatgctgcccttcacttttctacggagttcacatcagtttcagcatctccgctttggaaa

SEQ ID NO: 702265 - DNA, 384 bp, Homo sapiens
ttggtggtgctcgctgtatcggtggtgctcggttgtatgggtggtgctctttgccagagtcaacagtctccaggttgggccggaagtggtgtgtaggcgttctcaaggccgaatcgtgctctccctcagattctggtcttcccagatggccgtcttctggaagatgccaggtgtgccttcctttcgccactcttgaggcacatcatactgttccctgtgccgttttctctgggataggctgaataagatgattaggatgatcaatgcgagcagcagcaccgccatcacagcccccacgatcccatacacgaggctcgtggggatgttgaattcacaggtctctccccagtaccagtgtgtgttcgtatttgggcacaggcagcg

SEQ ID NO: 702266 - DNA, 196 bp, Homo sapiens
tcacaaaaaacggaatagcctcatcgagtccccacgcatcatagccagcatcaccctccttaacctcgtacttctacctacgcctaatctactccgacctcaatcacactactccccatatctaacaacgtagaataaaatgacagtttgaacatacaaaacccacccctctgacatccggcctgcttcttctcac

SEQ ID NO: 702267 - DNA, 450 bp, Homo sapiens
  misc_feature (24)..(24): n is a, c, g, or t
  misc_feature (314)..(314): n is a, c, g, or t
  misc_feature (345)..(345): n is a, c, g, or t
ccctaatttatcgcccaacacagncaacataacagtaatgactataggtctaacagcagacagaaacagatatgatcttgactcctaaacaagctatttaatctttcttagtttcaatttctttatctgtaaaataaagataatattacctaacccatagggccaacggggagggagggggcaaatgacttaatataaataaggtatacagaatgacatcttacagttagtcaaaagcaagcacgatatgtacacaaaatgccagttctttttttttttctttggagatggagtttcgctcttgttgcccaggntggagtgcaatggcggatctcagctcaccanaacctccacctccagggttcaatcgattctcctccctcggcctccccagtagctgggattacaggcatgcgccaccacgcctggctaattttgtattttaagtag

SEQ ID NO: 702268 - DNA, 383 bp, Homo sapiens
cgggttccccttcctgctgatgctcgtctacgcgggctgctgtcctgcatctccctcgtactggccgagtgtagtggctcacgcctgtactcccgaatacttggcaggtgaggagggaagatctcttgagcctaggagcttgcgaccagccgggccagcattgtgagatccccctctctacaaacaaatcaaaaattagttgggcacagtggcacatgctgtgtaatcccaggagttcatggctgcagtgagccatgatcagaccaatgcactccatcctgggccagagagagagatcctgtctcacgaaagaaaaatctccctccttcagttccccaaggatgagtcaccctgagggctccccaagagccatcaaccaggcc

SEQ ID NO: 702269 - DNA, 174 bp, Homo sapiens
tgtgtattagaggacccattctgttgtagtgcgttgaagtgaggctgttgtcagtgcgttgtagtgaggctgttgtagtgggcaagatatggttctgtatgtaggtaatactgtgtctatgggcatgtcatggtagaggagtgtgatgtaaatatgactcaatagccagagctg

SEQ ID NO: 702270 - DNA, 259 bp, Homo sapiens
gtgactgtgtctgatagtgccggcattggggatcttttgacatttggccacagcctgttcaagacctgttccccggcctgccctatcccagaaggcgtcaatgttggtgtggcttacatgggcattagctgttgccatagctttctgtgcaatttcagtgctgccaatggcgggctgctggcaagcgtcaccctgctgggtgccgagctgatgttgagcctggtgccggtcctgctgtagtatggcccctgaccgacca

SEQ ID NO: 702271 - DNA, 169 bp, Homo sapiens
gcagtgtctcattataggctaggagttgtttcacatattgagcatgtctagaatatattagggtctcaccatgcgaaacatgatcacacatctcaatctgtcacgtgctccctagccatactgggaacctgctgtcccccaagatcccctgtgctatcaagaaaccatg

SEQ ID NO: 702272 - DNA, 167 bp, Homo sapiens
  misc_feature (9)..(9): n is a, c, g, or t
  misc_feature (62)..(62): n is a, c, g, or t
  misc_feature (79)..(79): n is a, c, g, or t
  misc_feature (94)..(94): n is a, c, g, or t
  misc_feature (107)..(107): n is a, c, g, or t
  misc_feature (111)..(112): n is a, c, g, or t
  misc_feature (136)..(136): n is a, c, g, or t
  misc_feature (159)..(159): n is a, c, g, or t
ggcttttgnccccccatttttactatttgccaaaccctttttttaggaatgggctttttttnggacccatttttatccnttttccattttaaancagggtaagttgnaaannactgttttttatggccaaggaccnccaataaatcatatggaaatttnttttttta

SEQ ID NO: 702273 - DNA, 905 bp, Homo sapiens
gggatactgcgagtatggcggcgtcaaaggtgaagcaggcatcatgcctccgccggggggctatgggcccatcgactacaaacggaagcttgccgtcgtcgaggactgtcgggctacagcatgctggccatagggattggaaccctgatctacgggtcactggagcataatgaagtggaaccgtgtagcgcaggcgcctacaaatcgaggcacttacgatggtctcgcagtcgcgctgttgcacacgtgtcacagtgcagaaacctgaccggaggacctttgcacgatgcttcgggagagcctggaggaggaggccatcgtcatgaaggacgtgcccgacgggaaggtgggggagtctgtggttccacaaaaaccggtgggtgcacccacctatgagtcggggagctgtacctgggctgcgcagccacagaggaggctcatccatgccagaccacggcgttcaatgtggtacactgtagggccctgtgccctccggtccatcgtggcatcgcctgaccccgtcccgcaatggtggagcggaattaatatgctcctgcaggaacctaggggacaagcaccagaagagacaataatatggaaggcacatttttgcacgtgaacattccgtatcaccgagaacgagttttaaaaaaaaagggggagggagaggcgcgggacacgagagagggcgaacaggcgaaacactgggcgcaaaacgggggtgccacaccaaagagagaacgctcggggcgacgaggagcagagaggcaggggaacgaccaacccgcggctgacgacacgcgccgcagggcagggagcacgccaacgggggtaggaggagcgaaaccacgggagagggagggcccagaggagaaacacacgggggcacgacgcaagcagggggc

SEQ ID NO: 702274 - DNA, 206 bp, Homo sapiens
  misc_feature (62)..(62): n is a, c, g, or t
ctcggaccagtgattctctgctcagcctccagtggctgggattacaagcacgcacaccatgnccaactaatttttaatagacacggagtttcaccatgttggccgggctggtctcgaactgctgacctcaagttatctgcctgcctctgcctgccaaagtgctgcggattacgaagtgtgaaccactgctgcccagccagcgactt

SEQ ID NO: 702275 - DNA, 1918 bp, Homo sapiens
  misc_feature (726)..(726): n is a, c, g, or t
  misc_feature (1266)..(1266): n is a, c, g, or t
ctcgtcgtcggtgttgtctctactgctcagttgtctccgtctatcgttcgtctttcctctcgaccgctcctgttgttttggtggtacttctcttgtggtcgcgtctctctattggttgctcgttgtgtgcaacttcttcgttgtgttttctctaccctccgtgggtcctgcccacgtgctacttcgctctgtggtgttaacacaccggtggtttccgcccaccgtcgtaggtcttttgatcgggtcgtctcgtttgttccccgctgtggttgtgccttcccgcctcttagtgggccctcttgaggcattatcttgctccaccgggtgaccacgatgggtgccgacgtctctacggtgggtggtggttgttgtatcctcgccggtgacccacttcttccccctcggtgtgtgttgtcccacacggccgggggtgtttgttcgtcctcgctccgtccgatgtgtgactcccttttccctagtaggggtatgcgtctttgtcggtgggcacccagttggtgcccacatccgtgttgtcccacagagcccgggtctcgctgctcctcggggtcgccctcgccggaacgtagtcccgccgcgccccacaggctttgtggtgggagaagtccacacacttgcggcgagttgtttagaggtcccgccccgatgtgcccgccgtggggcgtgcccacagacgcgggtttcctctgtcttctctttaataaggcncccacggcagaatgtttgctgtggaggaccgccccccgtaatacgggtgataagtccttctcttttgttggggtgccccccgtggtggccccccgatcttatttgaacccccacgcgtggcggtgggggaagaaaccacggcttggggcaacccccgcgacatgtttgttgggcgtgagcccccggtgggtgtgtcaacgcttcgttggggcccacttatgaattatggcgaacgcccccccttgtgtagttggagacgccccgtctctctttatatcctcgcgcctctctgtagggagtttttgccccccacgagttggtgtttgtttccctcggcgcgtgtattttcccccccgggggagaatccgccgccccccttggtccccacgacagatggtgcctctgttcccacacggctctgttctctgagagaaaatatcttataggggtggaaatcacactctggagtgaggacataccctttattaggtagatataaattcgagctgttcgtagagagagatatgtttcgcgagaggncgctttatagacacacacaacattatttgagagcgcctgtctgtacgcctacatacccgcactctgggaaattacgagagttgtctctgtggttgataaaacgcgcctcttccctgttatacgactcttatatttgtgagagatacagttattgttgtctctctctgtgaagagaggagatagagaggagatagagtcctcacatacacctgtgtggacgccaccgagaaactgacacctctctcgaaaggctacacacctctgtgcccacagtgtttcacaggattgggcgcttctcctcgggacgcctcttataactctttatagagtcactcgtgtagctcgaggaccactataaatgtgtgtgtggtggtaactaaccgttgtggtattttggtctttatttgtgttcttcttatctatagagacagtcttttctttataaatggtgggtgttggttacctggtagccacctgttgttaccacctgagaacgtagtacattggcaccaggttccccacctggacacaaaccagtacctgtatgaagccttgtcctctgactaggtttttaatattctatgtgggatttcctattcttgccagcctcccgtaaataacaccattccagtcccccccttttttgaccttc

SEQ ID NO: 702276 - DNA, 1006 bp, Homo sapiens
gctaaaccatagccccaaaaccgcacgtccacgcttactaccgagacaaccgttagccaaaccaatttacccaaatcaacagtcataggcgcatcagaacatggaaacctggcagcaaatagatatagtcaccgccaagggacaagcatgcaaaacattcatcagccaaagcgatcacatcatagccacaggactaaccccgtatcaccttctgccatacatgcacattcaactcagcaaatcaactttggcaaaggcagcagccaagagcttaagaccccgcgaaacccagacgagactacctcaagaacagctaaaagagcacagcccgtcatatgtacgccacaatagtgggacacgactttatacggtcgaggcgcacaaacctaccgagcctggtggatagctggttgtccaagatagaatctctagttcaactttacatttgcccaaagaaccctctaaatccccttgtcactttaactgtaagtccaaagaggaacagctcattgggacactaggcaaaacagcctgtagagagagtaacacaatttaacaccatagtaggcctaaaagcaggcaccaattaagaaagcgtcaagctcaagaaccaatacctaaagaatccgaaacatcatacgtgaactcctcacacccaatgggaccaatctatcaacctatagcacgacctaactgtcagaataagtacactggaaagccattctcgttcggacattaacgcctgcgtcagcattcaaaccgttgaagctggccagtagcagtcccaaatctacaacaacgcacaagtcatagtaccccgacggggaaacccaaaccacacgcagtgccaacgggacaggtataacacacgaacagggactcggacaacttaccccgcggtacgcacaaaacacgctgagaccaacagaataaaagccgccgccacacacaccgccacgacggcgcaaaccgcggagcaacacggcaaaagccaacaagaccgagc

SEQ ID NO: 702277 - DNA, 100 bp, Homo sapiens
cccctcccacagtcggcctggaagtgcactgaatggaacgctgagcttatcctgtgtggcctgcagccgcttccccgacttcagcaccctctgagaatcg

SEQ ID NO: 702278 - DNA, 510 bp, Homo sapiens
gatccttatggcatggggtctgtaggcaactcagtatacttcccattctcatctcatgcgaggaatttggtcttgcccggttcaaaagcaacgtgacccagactatgaagggttttgaatatatcttgggtgaactgcaggtgagtttctgggtatgtggatattcctcctaaggagaagctcattcaggctagcgggcgtggagtctgggttagtccttgtccgactcccagaagctggggcccactgagttccaccagtatttattgagtgtctattatgtgtctagatactgagacacctcagagaaccaaagccaaaggcctggccttgtcgggcttacagtctagcacttaacggcagttaaactgcagggtacctggagcccccggcaagtcaaccggacctctgtgcctcggtccctcagttgccccatgggagaataagcagacctgggtcagaccttaatcatgtgcttggtgtactgcaaatgccaaactgtgttccccc

SEQ ID NO: 702279 - DNA, 1068 bp, Homo sapiens
gctgtccttccagtcagcatgcatccagaccctcaagactgcagcacgaggagtttgtcaccagcctggcccagcagcagcagcagcagcaacagcaggcagcagcagctccagatgccgcatgatggaggctgaagtctaaggcctacgcctccagccgtcctgctccagccccggtgtcctgcacgtgcctctgggatacctcgatcatgcagccagcctgtatgagcaggtcaagtctcctcagtccagggactggccgtgtgggtcattcagaagttagcgaagacgtcccagagacgagggatccaaggattccgtgcagacgtgtcggccacccacggttgccaccgcgagtggccaactcagaagcaaggagtcaccagccgaaagcatatggcaccccctttggatttagaagaaagactcgacagacccgatggtcttcctatgaggtgccccaggcaatggcaaggctcgcacaagacgactagggaccatgaccttagcactcagaaacgcaagcacaagagggccgagggaccagactccccaaagttggacaccacagcgaatagagatggccacgggtaaaggccctattggtaccgtgcgccaaaattggattgcgatgtgccgtgaaggcctccgcattgacggagttggtaaacgcactcaggcggtcaatagtgggaacccgggaggcaagggcagcgacgacatcgagcctggtcccccaagtgttgaattcatcggaacaccccttgaggggaacacttggacgctagccgcaaaggcaccaataggggacgacccaaacggctcgaatagggtccttccaggatacgaaagatcgcaacaccacaaatagcggttacacataacaatcgaccccataagcaaggcaagaagggtacaagacggttctccggcctccccacttgttgggggaggcaaggtgatgggaggagtcttataggagagtgccagaaaattagcgccaatagacacacagatatttcgcccttgtacaacaatttggctcatagcgcaggacgagcaccccct

SEQ ID NO: 702280 - DNA, 1273 bp, Homo sapiens
gaccgcgtcgccccgcgagcacatgagcctcgcctttgcctgatcctgccgccctgtccacacccgccgccagctcaccatgtgatgatgatatcgactgctgctcgtcagtcagacaactggctcctggcatgtgcaaatggcctggcttctgctggtgctgactgatgcccccccagggcctgtcttcccctccatcgtgggtgctgccccaggcaaccagggctgtgcatggtgcggccatgggtccagcaaggcattccctatgtgagcgcgcactgcagagcccagcagccaagcagcaggcatcctcgacccatgcaagttacccacatcggagccacggccatccgtcgcacaacctgggaacgaccactggacgacaaactctgcgcaccacaaccatatctacacatgagctgcagtgtggcctcccgcaggagcaacccccgtgactgcatgaccgagggcccaccatgcaaccccaaaggcccacacccgccgacgacagatgaccccaagactcctgtcctgagacacttacaacacacccagcccatgtacagttgcctactccagtgcttggtgctaatccctgtaacgcctctgcgccgaacccactgtgcatccgatgatggcactcccggtcgaacgcgcggtcaccccaccacttgtgacccaatctacgaccgcgctatgccctcccacaatgacatccctgacgtctcggaccctgcgcctgggactgggcaccctgactgactacgctcaatgaacagcatccctcaacagcgccgctggcctaaccagactctccccatcaaggtgccgagaccgggaacatcgctgcgcgacattcacgggagccaccgtgcccacaggcccccgtggcactacgcaccaagagaagtgccactgccggctctccagctccctcctgagcaagagcctacgcaccgaccgaccggccccggtccctcccatcgcgcacgtcgacgaacgcagacaccctgaaggaacaaatccacagccaacaacccgggtgccatggggcccgcggcgaccacccgacacgcaacccagcaccccaccacgaccagaacagccaccacgcaccaacacgcctcacaacaaggcgagggcgcacacgcttaccccatagccacgcaagagaagacagtggaccccacaagacaaaacgtgaccatccacaaccgacacgccacacacgaccaacaaaaaccgactgcacgccccagaacgctcaccagac

SEQ ID NO: 702281 - DNA, 345 bp, Homo sapiens
taccattgaggaggtggattaggggcctttgttctttagtatgtttgtctttgaggtggactgttgggactcaaggactttgctgctgttttcctatgtcatttctgcttcagctctttgctgcttcacttctttgtaaagtttgaacctgatggaaattagctggcttcattatttttgttgtacaaccgatatgttcattagaattttttgcatttaaaggttgatacttgtaagggtgtttcttttcccttataatgaatcaaatactgcacctttctgaccgagttaggttggtcatttttttttttttttatgtgctggggaaaaacccttcaaaggctt

SEQ ID NO: 702282 - DNA, 258 bp, Homo sapiens
ttcccccccccccccccttttggggggttgttcaaaggggcccccggtttaacgaaaaaaaggggggaaagggggggggttttttttttccctttttaaaaccccccccccccccctaggggggggatcaccttttttaaaaggattttggtgttttgggccccgggggaagggggtttaaaaaaaaccccccccttttttccaattccccaaaggggtggtccaaaccccttttaaaaccccaaagtttttttttta

SEQ ID NO: 702283 - DNA, 107 bp, Homo sapiens
cagattagctgggctccaaagtggtcacagttgtaccgacagatggctgagatatgctgtgaatgccgtcctcactgtagcagatatggagcggaaagaccgacgat

SEQ ID NO: 702284 - DNA, 1074 bp, Homo sapiens
caaatgctagtcgcgtaacgtgccccttctagtgtcacccccaagcgcggcaagatctctcgtcccaattaggagtccatggccgaccctaagtcccgctcgaagtaatccctgagaaagcatcaccccggtccacttcgtttccttgattaaaacaaagaagacaggaatgtcatagtcccacaaatatggctgcagttattgccagcacggccattatagacggtgggccattaagaacgtctgtgaccggcacatatgcctccagacttcctggaaccagaaaaccgtgcaaacaaccaaagaacgacaaaagaagaacaacgggttatctgtgccaactggcttgatcaacttcttgaggtcaacaagtcccaagaaccatgttgtaactgttcacacccgccacgtttgctctgtaaagactgctctcccgtcacacctccgggctgacatcccgttgacacggattcaagcccagctaaagaaccgaagatgacatcaaaccggccttggtagctcaacaagagagaaagacgaaagaagaaaacaaggcgcgagaccggagcactaagagaggaacccccacacagagggacccaagacaaacacgagataccacaagcgctcacagtgggtacacaaacaggggaggccccgataagagaagcgagcacgacaaataaacagacgcacaaggcaaagatgacccgcccatgctactacgcaagggaccagagcaacgtgcgccaaaccaacgagcacgacccacggcgcaacacgtcggagagaaacgcgaaacccgaaaacgatcacagtggagtgttacaccacataaagttttggcgaccaaagagagtagccccgaaagcaacaaacaaatagacaacagcacgaaacagcgccaacagacagagcaacatgcacaaaagaccgcgctaacaagcgggcgacaaacaaccaactagggccagcaaaacgaaagcaagaggtgggaagacaaagtcgcgcgacaagcaggaacaactagacccagggaacaaacagaatacaacaggggccagagacaaaacg

SEQ ID NO: 702285 - DNA, 186 bp, Homo sapiens
tctcgtgatacttggtctctagacctgccccgcgcatcatccaaatatggaattggaccctcttgtctggtgcccggcaacggcggagcacagtcgcgggccatgtaaagttcacccgcccacgtgtagagtgacaggtccctgtgacgttccccgcgccccacacaatgcaccctttagactcgg

SEQ ID NO: 702286 - DNA, 327 bp, Homo sapiens
gacagagttttgctcttgttgcccaggctggagtgcaatggtgcaatcttggctcaccgcaacctccgtctcccggtttcaagcgattctcctgcctcagcctcctgagtagctaggattacaggcatgcgcaccacacccagctaattttatatttttagtagagacggggtttctccatgttggtcaggctggtcttgaactgccttcctcgggtgatccgccttgtctccgccttgctgggattacaggcgtgcgacgtgcctggccagcaagccatctcttttgagagagtgggctctccagcaaggttaaaagccaaactgt

SEQ ID NO: 702287 - DNA, 175 bp, Homo sapiens
catttatgacattgtgcttcgtaatcaacagcgaaagtcatatataaaaaaccacatgcttttataatctaaacgagtgaaaatgatgcaaaaccgattaaagtagaatgcatgccactggttcatggacgtcatcggacaagaaaacgcaacaaaatcccaaacccagaacacc

SEQ ID NO: 702288 - DNA, 997 bp, Homo sapiens
catgttcgtcacgaattgttcgcgagaccctgttattagtctccccgccgtcattttaaagggcggcccctttgatgaatcctcggcccacacacattttgtctgtccgccgtctctccgcttgcccttgtgtttgtctgcgcgccaccgtgtatgtttggtgcacccccgcgcccgtttgcctccttataacccgccctggccggcgacccttgccccagggtgttccttagacaccccccatgcgggggtggcaccccaccccgggagcaaaacaggcggcacacacatcttgaggggacgccctcctcgccaaacagttgattctgcagataaaaacggtctccacaataaatggacccctgttccctcatacacatgctcccgatcccccggggccctccccctccgcactcctctctgtatttggcggaaccccactcgcgtggtgaagccacggagtgacaaggaccataatcccccaggggggaggatcgggggcaggataaaatagccaatatcactggccctcgtcccggcctcttcgcgccaaacgccggggccaccctcaagcgcgccctcttggcccaacaaagtgcagggaccccggggagcagcctagcacaattagggtagggaaagctttgataaacaaaacaatacgagaccaaacttgtgaggagtgttccccaaattttaaagccacggggtctcctcgccagttgcaaactacagaaatttttcttcctctgtgagactgcaaccagctcgtctccctcccctaaggtccactacgcccggagaagtctcccgcatctatcattttgaagagaacacgtattgtcccccctcgtgagctaataaaaaaggaggtgctcctccacggacttcttttacaagaatatctgtagacattctttgtcgagagcggttctttgaaaaagcatagaaccattttccctctctaaaaaaaaggccaaaaacacaaacaaaaaca

SEQ ID NO: 702289 - DNA, 401 bp, Homo sapiens
ttaaaacgactcacgggataggtttatttcttgactgatattcaccactttgaaatttaaagcttcaatctccttttcatagcaatccgtgtgagacttttaatggctctccaaaacacgtctttctttctttagtccttcataagcaaaccaaagttctccatcctcatttaaatgttccagatcttccacagagagcctgcttcttacatcttcaatgtcatagctttcgagaagttgcttggtgatctctgacatcttttctctcatttcccgttcttgtgactccacatgtttctccacatctatcttctgtgcctgaagtagttctatctctttttcgaactcagagattgtctttgacctgcttgctcaggcgtgccacttcctccttcaagcca

SEQ ID NO: 702290 - DNA, 842 bp, Homo sapiens
  misc_feature (21)..(21): n is a, c, g, or t
  misc_feature (81)..(81): n is a, c, g, or t
  misc_feature (163)..(164): n is a, c, g, or t
  misc_feature (169)..(169): n is a, c, g, or t
  misc_feature (215)..(216): n is a, c, g, or t
  misc_feature (218)..(218): n is a, c, g, or t
  misc_feature (362)..(362): n is a, c, g, or t
  misc_feature (397)..(397): n is a, c, g, or t
  misc_feature (405)..(405): n is a, c, g, or t
  misc_feature (413)..(413): n is a, c, g, or t
  misc_feature (416)..(417): n is a, c, g, or t
  misc_feature (421)..(423): n is a, c, g, or t
  misc_feature (425)..(425): n is a, c, g, or t
  misc_feature (428)..(428): n is a, c, g, or t
  misc_feature (434)..(435): n is a, c, g, or t
  misc_feature (438)..(438): n is a, c, g, or t
  misc_feature (463)..(463): n is a, c, g, or t
  misc_feature (478)..(478): n is a, c, g, or t
  misc_feature (495)..(495): n is a, c, g, or t
  misc_feature (522)..(523): n is a, c, g, or t
  misc_feature (525)..(526): n is a, c, g, or t
  misc_feature (543)..(544): n is a, c, g, or t
  misc_feature (548)..(549): n is a, c, g, or t
  misc_feature (572)..(572): n is a, c, g, or t
  misc_feature (633)..(633): n is a, c, g, or t
  misc_feature (638)..(638): n is a, c, g, or t
  misc_feature (640)..(640): n is a, c, g, or t
  misc_feature (645)..(645): n is a, c, g, or t
  misc_feature (700)..(700): n is a, c, g, or t
  misc_feature (720)..(720): n is a, c, g, or t
  misc_feature (830)..(830): n is a, c, g, or t
ggtcaatacaatgcattaganctatgtacaacgcacagtttagtatcaaaatcgtttctacactgtagagttttacgaaantgttaatgacatcaaacactaagcacttaagacaccatttgttttttttctgctaccacattaggaacgtcaatggacaggnnatttnaacttgcagcatccatccatttctagtatgaaattaagtaattttnnanttatacaataaagtatatctacacggttcttttgattttgatccatagcagcaaaggcactgtacatcagcagatccacagacttaaaagatttttaaagcattcaaacaaaaaataataaaaaaagaagtcacatattatagnttaacagcaacaacaacaacataaaagataacacnatgtttcnggggcagnggnncggnnngngtncatttnnggngcatccaactaagacatgggaaggnccgggggtagaaggnagcgagtcctcatcccnggagagagtccattctttgtgtttttnngnnggaggtctctgcgaacnntccnntgctgtccttgttttgtaaaagncttaacttgcacagcagtgggagtcctccccataactgtgcagctcccaaagagcatgccncgtgntngcccntggtttctcgtggcggcaaaactgactaaagatatatatatctccttttgcaaanaaatgtggcaaaaatatccngaagggagtaagttctctctttgaggccaaatttaatttgttcatctgcctataatacaacaaaaaaagggaactaaaaacatattacaaagacacttgtcaacgagtcnaaaaaagaaaaa

SEQ ID NO: 702291 - DNA, 259 bp, Homo sapiens
  misc_feature (153)..(153): n is a, c, g, or t
cacagccccagtccaacccatctccaggcaatacatgcccctgggacgggctcagtcccagcaccaccctggaggctccaacaaggtgggtttgtcccctcgtgctcctcctctgtgctgtccacctcctctgtgcctcctctgtctgtccanctcctctgtgctgtccacctcctctgtgctgtccacctcctctgtgcgtccacctcctctgtgctgtccacctcctctgtgctgtccacctcctctgtgctgtcca

SEQ ID NO: 702292 - DNA, 328 bp, Homo sapiens
tggagatggagtcttgctctgtcgcctaggctggagtgcagtgggtgtgatcttggctcactgcaacctccacctcctgagttcaagcaattctcctgcctcagcctcccgagtagctgagattactgatgcacacacaccatacctggctaatttttgtatttttagtagagatggggtttcaccatgttggtcaggctgatctcgaactgctgacctcaggtgatccacccatctcagcctcccaaagtgctgcgattacaggcatgagctactgtgcccggcccagtatcatccattttttgccatgaggatacttccccgcccc

SEQ ID NO: 702293 - DNA, 280 bp, Homo sapiens
attcagcttccctctttttccaatttgggatgtcttttatcttttttctcttggcctaatgctcctgctaagacggtccgtacctatgtgagatatagagatggagagaaggttggcacatcctggctcttgttcacattctctacacagagaaactctttcacaactttctctacatcacagtgtagatgttgcgctgtggggtttgtacatatatgggatgggcctctattatttgagagccatgtctcttctatcgcctagtttgtagagggtttat

SEQ ID NO: 702294 - DNA, 556 bp, Homo sapiens
  misc_feature (52)..(52): n is a, c, g, or t
ccctgcatgaattgaccttatttacttcctatcaatagatgccttacagatnaattcttaccctgcagaatgggttaaactgtgcttaacagctttagtttttgtgagattaacagattgtgaaaaataaacttagccaaatctcatgtgaggattaaaaaaagcgatgtcccagataagtcaatgtgacactaaagatctaaacaattttttttaacttttaagttttttatcaaatttcagcacccagcaaataataggcactgttaatatttgcttaatataacgtagctgtgaatttttgcccacatttaggcggacgggaaaattaacgccagaatatcccgaaagtcaaattttgtcatcttacacttaggaagttacgttaaaaaattctcaagtctcgtagtatttttcttaagcgccatttgggaatttcccgttacctcgtggtttccgtcatcaggttcttggcaaagattgcaatacagtagttttagaactatattaactaggtattccattaactaggtaaaaaccactcgactgacctcgt

SEQ ID NO: 702295 - DNA, 347 bp, Homo sapiens
  misc_feature (60)..(60): n is a, c, g, or t
  misc_feature (80)..(80): n is a, c, g, or t
tgttgtggcgcggtgccctgcgccgcgcgaccccaaaccgagccccttagagttttacgnggccttcgtcctagagccanatgatttgcatcgaccaccaaactgggcaacgaaaccagcatcgttttccgggggcgtggggtgagagacataaaacaaaggtgaactttggcatgtacctgatgcatgcatcattggatttatcctccccatgtttcctgtctgtaagatctcacgtgctccctgtgttgaaagagaatgtggaaggtcatgatttacctgcatcgggggggggcagcatgttacctcctaaaaaaaatttttagcatacattaaagctgctcttt

SEQ ID NO: 702296 - DNA, 274 bp, Homo sapiens
agactaggtgtggctgtggctgtgttaggagggttcttatatgctgtaggtggctctgacgggacatctcctctcaacacagtggaacgttacaatcctcaggaaaacagatggccactatagccctatggacccggagaaaccctaggctgtcagtttatcggactgatctatgccgtgggaggtagagttaccctacgagctagcgtctgaggtccaccccgaaccaaccagtggtctcgtggtgcttacttccctgtgagttgcctcagtg

SEQ ID NO: 702297 - DNA, 226 bp, Homo sapiens
cgcacagcttctcaagtagctgggattacaggcacgctcaccatgcctgggtatttttgtatttttagtagagacggggtttgaccatgttggccaggctggtcttgaactcctgacctcagctgatctaccccccttgacctcccaaagtgctaggattacagaagtgagccatcacgcctggcctctaaaagacctgatgtttgtggcggccgagaagctgtgg

SEQ ID NO: 702298 - DNA, 158 bp, Homo sapiens
gagagaggcaccctggatctaagacgtggttcacgtaaaagatgccaatgcaacagctttgccactcgactttccaacattattgttattggcaagggcaacaaaccatggatttctcttcccgaggaaagggtatccgcctcaccattgctgagaga

SEQ ID NO: 702299 - DNA, 162 bp, Homo sapiens
gcaggcagtgtgcttactggtagagttgaatgcagtgtgctgtgccatcagccccactgtcctgcattggaaacacctccacaaactccttcttgaagacatgacatgcagtgtgaaatggtgggtgatcctctatgatgtcgaccgtgcagtgcactgcaa

SEQ ID NO: 702300 - DNA, 552 bp, Homo sapiens
  misc_feature (299)..(299): n is a, c, g, or t
  misc_feature (301)..(301): n is a, c, g, or t
  misc_feature (490)..(491): n is a, c, g, or t
  misc_feature (496)..(496): n is a, c, g, or t
  misc_feature (503)..(503): n is a, c, g, or t
ggaggccgagaccagacgcggagccatggccgaggtgttgcggacctggccgtctcacaggtccttccccaggtccaagaggctcttctgtgtcctgatgacaagtagctgcctagccgtggtggcacctcctatcacatgttaagggacccctccccagggccacacctggcagaaggtggcttatgatgttcgcagcttgaaagtagtgtaaaccaaagataaaattctaagcccactcccccagccatcggaatggacccctcctcttggccagggcactccaaagttaacctgananaccggttcaggctgtgaagagaaggtggagtggacatgcctcatttatgtcctcctcccttttggaattcagcaaagctgaccagcatgaacattaacacagaccttaagtctgattagtggcatttacaatctatactctctgaagcgtgctacctggagtcttcctttgcatgataaaactttggtnnccacnacccctnatcaggacactagacacgcctttctagtgataataactctttcaaccca

SEQ ID NO: 702301 - DNA, 265 bp, Homo sapiens
aaggttgcgctgcccatcctctcgcccttcggaatttacccctggccgctcagggtctcgcttctagaagaagatgatggatactagggcgatcctcctattgcctttatatttaacaggcccgccgaggaggggctcccgctggtgcccacataactctattagaccatctgaggcgacttcccccaccccctccaacgcgcctcacgcacgactctagcaaaagacaggttccgcggtggtcacgtcgtttgagactatactg

SEQ ID NO: 702302 - DNA, 282 bp, Homo sapiens
catgtccatgcaaggagagattaagattgggaaacggcaggtgttttcccagtcaggaagatgaaaacgacggccagtaaatttgtaacagaactcactatggcgatttgggccctacgtagtataaaaacagtggctggcaggtgacttggaagtacaataccacttcagttgtccggtaatgtcagccatcagaagactgaaggagttgaatgaccagtagaccgcttatactttatagagaatattagctggcctataatgaatgggttaatttttgta

SEQ ID NO: 702303 - DNA, 432 bp, Homo sapiens
tagaggcaatcacgagatatctacgaattcccgaactatgctaaccccttgctgtgacgtttttatccgaaatcagtcctggcatcttatgaagataaattgtagacacgaaataaggttgttctccattgcttgcagcaatagggcaggatgtgagagaacccatgaaaagtacgatgtatggcagtaaacagtttccccatatttacaatctggtgctccaggactcttatccatggttccgtatatatataattctttatcttggttgccatgccaacctgcatcattaagggtccatttgcctcactatattctgcaagaataagatcaccatctttgcctgtgagtgtcctgtggtgtgcgcaaaaaaaacatctctccaccacctgaagcttgcctctcttgttctctcatcttggccttatcgag

SEQ ID NO: 702304 - DNA, 131 bp, Homo sapiens
aaggggagagatcgagacaggagtacagacacgccaggtcagatgtcagctggggctttactccttcccctcaaagacttccggggcggatacggggggctccacaccatgtgaacgagcacctgctgccg

SEQ ID NO: 702305 - DNA, 306 bp, Homo sapiens
gttctataatgtctttaaaaatattatctggtcgagtgtggttgctcatggctgtaatcccagcactttgaggggcaggcagatcaattgaggttatgggttcgagaacaggctgggcaacatggtgaaaccccatctctactaaaagtacaaaaattagccggatgtagtgatgcatgtctgtggtcccagctactcgggaggctgaggtgggagagtcccttgaacctgggaagcagaggttgcagtgagccaagattgcatcactgcactccagcctgggtgacagagtgagaacctgtctcc

SEQ ID NO: 702306 - DNA, 1330 bp, Homo sapiens
tataacagacgaggagctgctgaaggcatttggcagacgagtgtccaagataacaaatcactaacacccttttttcagtgaaacttagaagaagcagctgtcagtggcacagcgaaacacagacattaatactggatttgaacagactgagcatcccacacagtatcaggtcctcgttcaacatgtgccactggtcatttcactcaacaacaatgcaacaagtccacccttgtctttctctcagacaaaccttcggttggtcacatgtgtatgtggccaaattgaactctctcaaacaaacttgggcacaacacccatgacacacagttgggcaaaaagcgcataattcacagaccttgcacctaacatggtatacccatcgtgatattataaccacacacttgcattgggcaaagcccccaagcgttgaacgcactcaaatgagacttcggtccaggagctattcacaacacacttccggtagtacacgcggagaattgacaccaacaagtgttgtaccccagataaaggccatttgaaaaccccaggctgctctccacaggtcccagacctctctagggtctcctctacttccctgggaagcctccaaaaccacacgccattaataccctttccttgtcgcataactagatctgtcctactacctaataaattcacttcacccttggaaacggcaacgttcacaacaagccgtggactccttctcgtgggacacacccttatgcccccccttaaagtactcacgattcaaacaccacacacagagccaccacacaaaacagcgacggctctgctctcaccgcctatacttgtgctcactcgctacaccaccgcacagacacctctagattagcacctgtcgtgtgcacaacttgccaggtttacataacgagtattatcacccattaattgcccaccacccacaacgctgccgtctgggtcaatcactaatcatctgtcgcccaccccatggcgcggagtcacacaattaccccaacaacctaccgtggctcgcaccctaccacactcaccgcggacacaaactcatacacacaccgacaccaccccgtgcatcgcaactactatcaacgcatcacagccagcttcctcacactcatttcagcgcgaacaacatgggtagcactagcacttacaagacacagacacggaagcagacgcaaacgccatctcgtttccgacacacaacacctcaattcagccccccaccaaacaatactacagcgtagacaaaccacccgagcgaacgcaccacttacgactggcgcatccacaacaacatactgcacac

SEQ ID NO: 702307 - DNA, 219 bp, Homo sapiens
ttgggaggtgaggcaggtggttcacctgaggtccggagttcaacaccagcctgccaacatggtgaaacctcgtctctactataaatacaaaaattaaaaaacgagcatttccctttttttttcccctcccatcaacaaggctgtaaatgatcaacctcatgcattaaatcttggtctgaatcccgggtcatttccttagaataaagtccaagaagtgag

SEQ ID NO: 702308 - DNA, 179 bp, Homo sapiens
tctttcagaatggctattattaaaaagtcaaccatgaaggaaagatattgaggagacccctgacccaaaggaaatagactgcagcaccgaatggaagactttggagtcacggaaacttttcttttgagctatttacagcttttaaccattaagtaacagactaggatacagtagggaga

SEQ ID NO: 702309 - DNA, 308 bp, Homo sapiens
ttctcagtgaggatctttcaagttgacatgaagacatggccatccgctggaaacgtcgtggatctgccgtagcgctcttgtaatttgtgaggcaggctcctgatgaaatgcactgcgtaagtgggaaatggtaggatgttctcccatcctccccttgccgaaagtgctgcctgcgcaggttggtggacggtcctttgagcaggaagaaacacggagcacattcctgttagctatgacagagaggggcagggtacacactggggaaggacctgagctcactgagaatcagtggactagtagtagtagta

SEQ ID NO: 702310 - DNA, 298 bp, Homo sapiens
gacttatcccaaaataatcactgcacaaaatgtaaagggtggcggttatgctcgtgatattacattttcctcaattaatgtaaaactatgactagtacaagaacaaattaaagtttcccacggcaaatttgtattcaaaatgccgaattgcgaaacaattgctggcttcacgtttctgaatacctttaatagtttctctgcgttgcagttagtaagtttccttgtcatgacacagtcgattactaaagaaacccaggtaatcaatgttttcaatgcgatcattgagcccctagatgct

SEQ ID NO: 702311 - DNA, 1600 bp, Homo sapiens
gtcgggactgttctttagtctggtaggttctcccccgtgggtggtcttgtagctcgccgtgttttttccctgtcagtagttgtttttgggtatactagcgcgagcgctggcacccctgttgtccctctgatgatgttctgtttttctgtccccctctgtgagtctctatcctcttttgcttttctatcgtgggtgatgcccccgcggatccctgtgtgttggttcatgactgtagggtggttgtgtaatgtggctgtgccataaccatccttatagttgatggtatgtgtgtgaaataatatggtggcataatttgttctgtcgggtattgtgtcataataatctcatatatctcctttgtttcgtctgtatactatggcatggttataatgccgcccccccttgtggcaaatctcaccctcgtgtaaaatcccactgtagttgattgttatatttgtggtagaattataaccctcccaaaggggttgtatgttcgctagagctcacacaccatgtgtgaaacgttgtggaatggggatgttagctaatcgccagctgtgtggtccgcacacaagggagaggtgtaaggttagagaagagttggtagtccctacaaaagctgtcccaatattggccgcccagatgttaatgtgattggcagtatgataaagagaacgcggggtggtgtgagattgtttcccccctgtggactcccagagacagagatctcaatttgtttttctcgcctcacatggagagcgggatatagataatctctgttattatggtcgcccgacacacacagactttgtgtctgtagtataaataatcccgtgtagtataagcgctctcgcccggatagtgagagccacgggttggttgaggtgttgtgttgtcaagataaattatatatagcctccctcagagatagacgctcttaggagccgctgtgtagatagtgtgaagatgcgccatgtcggggcgctcacctctcacacagagcgcgtttgtagtagcgctcagccctctctttttactcacccttgtgtatagttggtgcccagaagagcacatagcgctcacatagagcacaccttgttagagtgtgtgagtgtgacacaagaaggtctacatgttgtctcatctcgtccggtgttgtgtcccaacgcgcagagcccatgtacacccactctaatgcggtcttctgtgagcttgtgtgccccaagtgggcacaacccgctctctcgttgctccctctatgggattgtgaacatgtcacacctgctggtgccatggtccagaaaaagaagagcctctggtgccccaacctgtattttcttgctctcccaggagacccagatgacacatagaggtgtccagaaggccccacacccagccccctgacactacatgccccccattttatcctggcgtttccccagaaccccctctcccaccaccagttgcacccctgattctccgggttctttgatggggtgaaggtagggggaaccatttgttaatgaatgactggactgtttgtgcccaaagaaaagagaaaaaaaaactcgagcattaacgtcagtgcgagaatatgaga

SEQ ID NO: 702312 - DNA, 646 bp, Homo sapiens
aggctctcatcgctgctcagtacagcggggctcagtgtccgcgtgctctccgcaccaccccacttccattttgtgccaaaccaaccgcacccctgaatttctccgcaaatttcctgccggcaatggtcccagcatttgagtggtgatgataggattcttgtgttgttttgatgatgcaactgccatttgcctaactatgtgatgcaattgaggatgcttgcggtggaagtactccatgatggcatgcatgcccagtgtggttgcagtgggtgagctttgcttgattccgatatatgtgcccccagccagtacctgggtgttccccaccttgtggcaatcatgcaccacaacaaacagtgccactgagaatgcaaatgtgaggaagtgagtgcgaattctggtgtgctgctggatgcttacttgaagacgaggacttttctgtgtggtgctgaactgagtgacatatggctgacatcacagtttgtctgcaccctgttgtggctctataatgcatggttctagatgccttctttcctgccaggcctttcccaataccaacctgctgggttcctcacctgcattaaccagcccccagttcctgggctgtcttgtggcgaagtgaaactgttgtgagaagatggcccag

SEQ ID NO: 702313 - DNA, 274 bp, Homo sapiens
ctgcaacgatcacgaacatgaacatcaaaggatcgccatgggggtccctcctgcgcgctggttacgctcagtgccctgatgcgggcggagacttcactgcggcgctcgtcctttacctcatcgtcataggtcatgcggtctacgctaggcatctccctgcccagacaggagcgcagttcagtctgacgttgttggctagcccgtcgtcgtctgtgcgaccggtcatcggaatggcacaggtgtgtattcctccgacgatgttccggtgttcgct

SEQ ID NO: 702314 - DNA, 153 bp, Homo sapiens
  misc_feature (43)..(43): n is a, c, g, or t
ataatactaatatatatgaaaataatttatgtatgtgaattanttatatgtaatatatatacttacagatgattatatagtggtgagctcatactgtatatacagtttttgtgccttctttattattataaaataaacgctttcaaagccatt

SEQ ID NO: 702315 - DNA, 153 bp, Homo sapiens
gtctaatgtttattatacaatgttacaaatatgcagaccgtgttgtttgctccagtgataccttgataagctacgcagtgatgactgtccgagccccatcgagaaagccatctccaaagccaatagggtagtgaagtcgtcgctagtagtgct

SEQ ID NO: 702316 - DNA, 266 bp, Homo sapiens
tgacgcactatagtcccagctactcaggaaactgagacagaacatcatatgaacctgggaggcggaggttgcagtgagccgagatcatgccacttcactccagcctgagtgacagagtgagtctccgtctaaaaaaaaaaacaaaacaggaactagaaaagaaccaaatggacatttctaacaggtacacagttaccaatgttaccaatacaaagggtacaggtcagatatagataggggactcctctaaagctcgaccatgcagg

SEQ ID NO: 702317 - DNA, 930 bp, Homo sapiens
gcaccatggcactccagcctgggcaacgaggagtgaacctcgcgttctcagaaaagcacaaactaacatacagaataagtaagattctaattcaggaggttcgggagtgtgtgcatttctaatgcgctccaaggctgcttgttgctgcctgtttagaaccatcactattcaggtcagtaagggtctcagaaacaatcacgacatccacacacgtaccatcatacaccagcagcgccagtgtggatacatcacatatccagaacatcgtctctagtggaaatgcatttctgtcgtaatgctgagtcgccgctagcttctaaccattatatcgtagggggcaacggagtgtcaatggcatcagcacagtcttgcatggggcacttagcgcggatccccaaacagactagcatcatagggtctgtgaggtggtatgcatgcatcaatgcatactatcaggcagtcctgggacatgctgacgtgctctaggcagggcaaggtcaggcaaaaacataggttgcgattaatacttatttgtccatatcccttggtcactggtgcatacacacatgcacaatgggtaagcctagaatatagactaagctgggccagcagggattgcgcatgtttttacacgcatgtctacatagagcgcgggaacatgcggacgtaagggatactacaagtatagggaccacatgccaaggccatgggtttctcgggggccactcggttccacgagggagggcaccttttggggggtcatatggaattgacctcgcaaacttatggcctcggcaatcacctggggagcttgttaagacggggacatacgggggttcaccaccttggccgtgtataacatcttggaaggcagaatacgtggtgagaaactccccaaaaatttgtatagctccttcggacgagcacgaa

SEQ ID NO: 702318 - DNA, 1210 bp, Homo sapiens
accaaggcctgagccagaagttcctccacagtgatgggctgtgccatgccctggctgcccgctggttgttatggacacctgcacgggcatgtgctgggctgtgccatgctggcttccagccctgagatctcccatgccgcatgaagggcctggaatgcccctggtgacctatgatgcattccactacatgccctgagctctgctagtgtgtggcctgtggaacccggaactggacccccaggatctgggaacgtggctcctgtgcctcccagggctccgggagccatggcagcctagacccacaatcccatagctttccgtacggcaagtaccgtatggacccccagtgatgctagcgtcgacgacccgatgcatactgcttgcgcttccttaggcatttacactatcgttgggcatgcgacccattgcaggtacccaacttgccggaccccacggctaaggacccagggacccacagaactcctacacatatccccagatacatacccaatcacccaggctgggacaaggcagcacccaagtgctgccacccacttcacccccatcttcctaactacaacgaccgacttgcacactggcgccaacatcaatccgcaccaccccaacagactagggctctgacctccctacccaccacgagggcaccacccccgaaggaaaaaggcgccaattgaaccttaccattagccccacaccaaaacccaacaccaaatccacaacacccccaccgtttccaataggaagaaagcttccaacacttccccatatactcactcgcccttacctccctttcccacgtgcccacaggtcccaattccctccacgcagcaccaaccacccacttactcatacacaaccgtccacaaacgcaaccttccaagcatgccgccccccttggaccttcggcatgcagctgtgacgcgaattgctgatgatgacactcccacccctgtgaatcacaacactaccaataacctaacacctaaccccacacagtcacccatcaaacccctaccttccaacatcaaacttccttccccttcaccacacccctcatcacacaaccctaccacctcacgcccatatcccccaaacacaacacatacttacccatcaccatacatcctcatccctatgcttcacactcaccaccacccacacccaccatatatccaccactgaacccact

SEQ ID NO: 702319 - DNA, 896 bp, Homo sapiens
ggcaccgtcccgttctccagccaaggctccgggctgaggcatttgcttggctgcagcctccttccgaactgcccggcgggagccagtgggacctaagctcgatgccgagccgcggggtccgctccagcccggccatgagcgcaggcctgcatgatgctgtccctgcctcggccgctgagtcgccggcgccgccgccgcaggccgggaggagccgtaggcgcctgggcgactccgcccggtgcctcggagtccgatcgcataggacacgtatgcagccttaggatccatgaaggaaacggcaacataaatgttcaagtgactgtttagaaactaacctgtgtgcagggtgcgtcatgggaacactcatgcagatcatcatggacatcagggctccgggcacgtcggaagtcatcatcctcttcctggtctgcatagacatgacatcctcatgacgtcttcatcgtccatcctcctccgatgtctgacgttgcgctgagctggagtactggttcatccgagacggcttgcgagcatgatctcgctgctgtgcatgaccgttggcttactggtcggactatgcaagaacttacgtagagttgacttccggacaatgctactgccctttccaataagactgctggatacgtctgtggttcaacggggtcatctattaactgcttgaggacgtgcatgccctgtgatacccaacgtgagaaaccaatagttcaccgagcctgaaaaattcatgtgacttgcgagccatctggcatggcacagtgaaaagtgcggctggaaccaagacctgggagggcagatagtggtgaagggaaaccgaaggactgagcaaaggcctacctgtatgggaaagacccagaaggaaaagttaagaaagaata

SEQ ID NO: 702320 - DNA, 386 bp, Homo sapiens
agagaaaaaatcaacataatacagactaacgttgtgctcctaatgtcagagtggtcagagttctggatcacatggtgggagtgtatggaagtgtaaagaagttctttcattttctttgttactctcagtatgcctcatgtgtgaagcagtgtcaatctcaaagttgtcttggaacagggtaaatgaaattataaatgtaatagcacggggcctgtactcataggagtgctccgtaaatattagctcctaatcattattattactcagtacttggcaaaaatcaagttacagtttcatctaatctgagttgatcacatgcatatttttctttatttaaaaaaaatttctttacaaacatgaaatacatgggatggaaagggggatct

SEQ ID NO: 702321 - DNA, 843 bp, Homo sapiens
agcgggcgctcggagcggccgccggcaccaccggctctgggcagtgaggggcttagcacctgggccggcagctgctgtgctcaatttctcgccaggccttagctgccttcccgcggggcagagcttgggacctgcagccaccatgcctgagcctccgccccctccgtgggctcctgtgcctcccgagcctccccgactagtgtcgccccctgctccacggcgcccagtcccatcgacggcccaagggctgaggagtgcgggcgctcggcgcgggactgtcaggcagctccacctgcagccccggtgcgggatacactgggtgaagccagctgggctcctgagtctggtggggacttggaggacctttatgtctagctaagggatcgtaaatacaccaatcagcaccgtgtgtctagctcagggttcgtgaatgcacctaattggacactctgtaatctaagctagtctggtggggacgtggagaaccttggtatctagctcaggtatggtaaacgcaccaatcagcgccctgtcaaaacagaccactcagctgtggtgaccctgtcaaaacagacccatcagcaggatgcaggtggggccagatacagacacataaaacgcaggctggctcgagccagcagtggcaaccagcttggtccccttgcacactgcggaagccttgtctattgctctttgggtccacgctgccttttatgagctgtaacaactcacccaggaagggtctgcagcttccactccctgtagccaggcgagaccaaggaagccaccagaatgtaccaaaactcccggcaaatccggccttaacgaacagttaccattcac

SEQ ID NO: 702322 - DNA, 706 bp, Homo sapiens
  misc_feature (222)..(222): n is a, c, g, or t
cccgttttttagccccaatttagaacccccatctctcctaagtatatatagggagaacctttttggttttccaagttaggtcacagagaagggccttctttccactcataggtaaagccctccaggcttttttaataatggaaaatttttaaggctttttttttttttttttcacaaattattgataagtgtaatattgtcttcaaaaatataccaccgccnctccccataggtccaagttatccacattagtattatgttcttggaaggccccctcccgaaaagttacaattcactgggaaggctgcattaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttcgttaatcctattttgctatgctttctagtaaagtaaattcactgtagctaatgatgttacagacttacgtatacccttgtatacctgggacagggctgttttataccaataaacagcaaaatattgtccttactaattcaagaattaaaa

SEQ ID NO: 702323 - DNA, 656 bp, Homo sapiens
  misc_feature (35)..(35): n is a, c, g, or t
  misc_feature (63)..(63): n is a, c, g, or t
  misc_feature (77)..(77): n is a, c, g, or t
  misc_feature (96)..(96): n is a, c, g, or t
  misc_feature (109)..(109): n is a, c, g, or t
  misc_feature (151)..(151): n is a, c, g, or t
  misc_feature (168)..(168): n is a, c, g, or t
  misc_feature (178)..(178): n is a, c, g, or t
  misc_feature (182)..(182): n is a, c, g, or t
  misc_feature (190)..(190): n is a, c, g, or t
  misc_feature (192)..(192): n is a, c, g, or t
  misc_feature (211)..(211): n is a, c, g, or t
  misc_feature (247)..(247): n is a, c, g, or t
  misc_feature (258)..(258): n is a, c, g, or t
  misc_feature (279)..(279): n is a, c, g, or t
  misc_feature (282)..(282): n is a, c, g, or t
  misc_feature (312)..(312): n is a, c, g, or t
  misc_feature (438)..(438): n is a, c, g, or t
  misc_feature (455)..(455): n is a, c, g, or t
  misc_feature (484)..(484): n is a, c, g, or t
  misc_feature (533)..(533): n is a, c, g, or t
  misc_feature (583)..(583): n is a, c, g, or t
  misc_feature (596)..(596): n is a, c, g, or t
  misc_feature (605)..(605): n is a, c, g, or t
caatacaggccgctcccctcaaaggaatggacaangtcacacacaccacaaaacaatgtcaanactcatgtataatntactctaatctcatttgtngtcatcaatcccnttagtatctcagtgcctcggggaatatcctcaaccaaacccntcaagcctctcgcaganagtataggcntaanaccctccncngtcattaggtctaattccntcccaccagtctaacacaagtccagaattcccgggnttctccatacntcacagtcgcctagaactccngcnggaaggtcgtgtaccatattcggttgtccnagcaatggacaacacgccgagtctctgaaattctgtgtctttagggctctcaggaaaggagaaggaaggctgccggtggattctgaggttttataatcggtaacatgtcgacatgtgaaaatagtnatctgcatgtccttccntggacaagagccaaaaaccttttccagcnactcacactgtcgacctcctgcaacacagcacactgcactaacagaganaaaccgagggattggattttagatgataaaacacacaaaaagcctctttngaggacagaagtntagtgtctnttgttctacaccatttattccagagtttagcacaaccaactccctcccaga

SEQ ID NO: 702324 - DNA, 317 bp, Homo sapiens
atacggaactatctgtagagagacggtttcacctgtgtaggcgggcttgtctcaaactcttgacctcaggtgatctgcctgccttggccttccaaagtgctgggattatgggcgtgagccaccatgcctggcctcattcttccttatagctgcatagtactccactgtgtagctgttatcataacttattcaaccacactcttatatttggacatttaggtagttcgacattttgcaattacaaatcatgctgtaatcaataaccttgtgcatatttattttcatattgttggaagtgaatcttcagagtatattcc

SEQ ID NO: 702325 - DNA, 299 bp, Homo sapiens
  misc_feature (144)..(144): n is a, c, g, or t
  misc_feature (164)..(164): n is a, c, g, or t
agcatcgcggaccgcagattgcaggtgcacgggccagtactgcgtggatcacgccgagctatcgatgtcggctgtataactgtgtaccgactgtctgtagtaaaattggcgagtaggatcaaacgatgtgacttgtgctttgancctttgacagcttaatcaancccggtattctgctgcagcaccgacacgcggttgagcgaaacggcgtaaagcacccttagacgggactctggcgggatatcatgtggttgttcgtgggctggcatctcggcgttcggccaaccaagttgactctc

SEQ ID NO: 702326 - DNA, 600 bp, Homo sapiens
aagatagtaggaaggaatatgaattttgtcaaggctttctgcatctattgagataatcctgtggttttgtctttagttctatttatgtgatgaattatgtttattgatttgcataggttgaacaagccttgcatgctggggatgaagctgacttaatcatggtgggtaagctttctgacgtgctgctggatttgatttgccagtatttaattgaggatttttgcattgatgttcatcagggatattggcctgaagtttgctttttttttggtggttatctctgacaggtttgggtatcaggatgatgctgtcttcataaaatgaattagtgaggaatccctccttttcaatggttgggaatagtttcagaagaagggttatcatctcctcttaatatttcgggtagaatccagcggtaaatccatcgggtccggggcttttgggggtgggtaggctatttataacggcctcaatttcagaactggtggatcggtccagggatccaacttcttccgggtccagtctgggtattaacccatttcttctagatctcctagttaattggcatagaggggctaatagtagtctcggatggtggca

SEQ ID NO: 702327 - DNA, 216 bp, Homo sapiens
gcaacctcctctgcctcctgggttcaagcaattctcttgcctcagcctcccgagaagctgggattacaggcgtgagccaccgcgcccggccggtgcctagactgtttcatcaggacagcataaagtgtaccggggggtaagaacaggttttatcctgctgaccaaccttaagcacaagaattaatccctaactccatttagtgataaggaagttgg

SEQ ID NO: 702328 - DNA, 748 bp, Homo sapiens
  misc_feature (577)..(577): n is a, c, g, or t
tgggcgccccacttttttgttttttaaaaagggacattaaaaaaacacacacaaccgggtcaaaaaaattactcccaaactctcttttgatttggaatactcttgtgggaaaatattttctcgcgcttaggaaccccctctcttctcctctctgtgccgagggcaagcgttccttctttccttctttccttcttctcccttgcgtgccttcttctcgcgtggcaacggtcttctcccttttctttatagaatttctcaccttatgggttctcaacatctccacacaggttggtgtgtttctccgggaggtgataagagcgtgtgtgctgtggtgtaaaaatataaaatatacgcgaagatgtgtttatttctctctctcgaaatatactctcgagcgtgtgttcccacgcgctgtgtgtccgaggtgtctctctgtgtgtgttcttctagaggggtctctatttctctaccacagcgctttatagagagagtgtgtgcgtttctcgtgtgtgtgtgcactatctctcacacacactctctcacagagagaggatatctaatctctctcgtagagcgnggcgcgcccggggtccaccccctctcgtgtgggtgggtccagaaacacggcacacacacagagatatcactctgtctcaagagcggaaaaaacagtggcggcggggagtgtggcgaagatgtgtgagagtgtggcgcgggcaaaaaagtattgagagagcaaaaaagaaaa

SEQ ID NO: 702329 - DNA, 909 bp, Homo sapiens
tagaacgggcgtaagacaaggtgcgtccccgagaagggcctctctgggcacccgtagccctctgcgagcggtccacaaattgttgtataggcggccaaaaaaaggtccgcgtttgcggtgtttcccacggagccctcttgtatgagtgtcgttctcctggcagaccccttagtcgctgcccctgccgaagcgggctgtatgtccgccccctctctcgacaagtgggggttctgcggtggacctccttctaatgtagcccgctcacgatgcacgtcaccccggcgggtgccgccacaatagttaattattgtaaggggcttttccattgccaaaagtttcacgtggtcgtaatccactcccccaggaaggttttggttccattaataaaaacaggcggctagatgaatataaattgaaaaattgtgagatgcggcgtggtccccccaagagtacaacctcccaccacccttggtggacattcaagggaaactcctgtcgcagtgactccctacagtaaagaaactcttgttgggacacaacacgcattagggggtccccgcaaaacagagatgagacaaacgcaggtcttgaagaaaacacactgagagacgggtcacacactatgcgggacacggtttcctttgggcccaccgaagagggccacagtccgcccatggtgagatcgcgcgtacccccaccgttggaacagctggcaccaaacgcctcgccacacagagatctttgtatgtagcccccctgccacagtaaccctgagttgtcaacaatcacggtcctctcagacaatttcccgccgaatgaataccaccggggcttcctccccacagtggcaacaacacttgagacacagttgggggaaacaccccaaacaaaccccaagcccaacatacc

SEQ ID NO: 702330 - DNA, 307 bp, Homo sapiens
tggggctcctaagagccgcggggggcagatgggctggctctcgatcctcgcctcgccgggtggcctcccaccctgcgatggggctcctaagagccacggggggtagaggggctggctctcagtccccgcctcgcggtgggtgcctccccgccctgtgatgtgtgtggtcccgaaagagcagcgggggatgcatgaggggcttggctctcaggtccccgaactcgcgctgcgggtgcctccaccccgctgcgatgggcggtccctcagagccagcgggggcgaagagggagctggcatctcaagtctt

SEQ ID NO: 702331 - DNA, 185 bp, Homo sapiens
aaatcgacggcggtccgacaaaggaggtcaggtgtgctggatcactggtgaaatcccagcatttgggaagctaaggcaggaggatcacttggccaggagctagagaccagactgtgcaacatagcaagacctcatcttctcacacacacagacacagacacacacacacacacacacacacacac

SEQ ID NO: 702332 - DNA, 126 bp, Homo sapiens
ggagaacttcctcaacttgtatttaaaattaccctgcaaattcccttacagttaattgccattatttcattgttgagaaattttaagtttttcccatttggggttcaaggaccaagggcacggttt

SEQ ID NO: 702333 - DNA, 444 bp, Homo sapiens
  misc_feature (198)..(198): n is a, c, g, or t
  misc_feature (293)..(293): n is a, c, g, or t
ctagcaggatctacggtgctgatgtgatgtgcgtctctgtgtgccgttgtgtctgattgtgtgtatgtggtgtggtgtatatccgtgtatgtgtgtgtggcagcatgttggaatataacgtggtgggttgtgtggaggtattgtatgtcatgtttgggtgtggctcatggctcagaggtgatggtgtatgttgcgttngtttttttgtttttgcttgttttagagataggatcttgctatgtttgccaggctggtctcaaacccctgggctccagcaatcctcccacctcaanctcccaaactgctgggattacaggcatgagccactgcacccagccgtatgttgcatttgggcactggggtctatgaaggtccaaccccatccccttcccccagggcatcatcctggatgttgtcctgtgtggccagaatataccagaatca

SEQ ID NO: 702334 - DNA, 186 bp, Homo sapiens
  misc_feature (39)..(39): n is a, c, g, or t
  misc_feature (72)..(72): n is a, c, g, or t
  misc_feature (82)..(82): n is a, c, g, or t
  misc_feature (149)..(149): n is a, c, g, or t
ctcggaaatgtccggtcgtggtaagcagggtggcaaggngcgcgcaaggctaagtcgcgctcgtcgcgcggnggctgcagtnccccgtggccgcgtgcaccggttgctccgcaagggcaactattcggagcgcgtgggccgtgcgcctngtctatctggccgcggtgctcgagtacttgactgccg

SEQ ID NO: 702335 - DNA, 1397 bp, Homo sapiens
agctggagtgtgctgtgcgtgcggcatggctagtggctgcgtgctggcgcggtggagggttctgcctgctggtttgcctgccggtggtcgggctccgtgggcctggggcagtgatgggaccagcacctgaagtgcctggtgccctgcatgtccctgcgaccttcagcatgcgcacgtgctggcgtgcgcatgattgcttgctgctgtggtgctctggcgcgcataccctggttgtgtacatgcggttgcgtgcttggctgccgtgggtgcctggtggacgcggccaacgatggatggattttggacagttgcttcttatagacacgcaaatggcccacaattggtcctggagaagcaagacgcattgtccaggggctagctggccgacgtgttcagcttgggaccaacgcgtggcttctggcttgcccatgctgagcatatccacgcgcttttatcctggccagcgcgctcaggcgtggaggaccgccgtcgccgaggggacggcaaggcggcaattagattgagacctggaagtaatgcgactgaagtggtgccgcggaaagggagggaaggcggagcggcgccgcgggggtgcgacgacatgggggatggccggaagggaggcaaccgggaagtcactggcatgaggagcgcagaggtgagtagcagccacgcccactaagggagctggacgtaggcgggggccagcgccgagctgtcgatggcgaggccaacagccgccggccgatggcgaagcgaggaaggaccaaccggaacccgcagggagagagacacaagggagacagagggaggagcccacgagagagagagagcgcaagggggaaccggcggaaggagtacgcccagcagcgacacagggagagcggaccgcgcaagcaggcgaagcgagcgcggaccggccagagtacgaggccgatcaccggcggagtaagcacgacgacgagcgagacacagccaggaagggagacgcgtagagaggcaagcgagcggacacgagaccacagaggcagagcacaacggcgcggcgggcgacccgcgagaacgaacaacacagcaggcggagcgtagacacagagcgaggcggaggaagcgggagaggcgggaaccagcgggcacaggggaggaggcgacgcagtactggccgagaggggagcaaaagcgcaggaaggaacgagagcgcccgcagagcacgccagcgagcacaccggcgctagcaactcaacctagcacggcgacatagccgcagacaagcgcgagaagcggcgcggaaccagaggagcacgcgcgaagcgagcacggacgagcggcgacgcacaaggcgcagccggcgggagagcagcgcggtcgcggacgcgaaaggcggcgagagacgcagg

SEQ ID NO: 702336 - DNA, 210 bp, Homo sapiens
tgctggcggtgacgtcatttcaaaaaaagttatcgccgagaccaactatcaacaaggttcttccatatgttttcttcactgagttttaacgactttcatgctcttaatattcagctcttcgcttttgacagtctgaaacttagaacagcatgatgcactcggccctccacaaagctgctggcgacttacacggccatgagcccaccaaca

SEQ ID NO: 702337 - DNA, 356 bp, Homo sapiens
acagcacgttgcctgtgggccatgggttttcaagggttatgcggctggagctttcgcctcctgcagcagttgctgaatcatcttttcctgcgtctcgtagcgaccttctccgaagtgggtgaaacgcacttgccctttggcgtcgatcaggtagtgcgcgggccagtactggttatcgaagttgcgccagatcgcgtagttgttatcgatggctaccgggtaagtgatgccgagctttttcacctcatccctgacattgctgatgatgcgttcaaaaccgtattccggggtgtggacgccgattaccaccaagtcatccttctcgtacttctgcgcccagtccctcacgtacggca

SEQ ID NO: 702338 - DNA, 188 bp, Homo sapiens
  misc_feature (154)..(155): n is a, c, g, or t
tgtggtcgatctagaggatctggttgtgctgggatacaggcatgagcactacgccggctagacacaagtttaaccctgtaaattctgtgcctctaactgcaaccaaagccccaattcatcgcattctgcagagtgctgcccacattcacttggnnaatcagcagcatgtacacctcattacttcacct

SEQ ID NO: 702339 - DNA, 1022 bp, Homo sapiens
  misc_feature (32)..(32): n is a, c, g, or t
  misc_feature (111)..(111): n is a, c, g, or t
atttggtcaccataaataggggaggagggggnggcctccagtacactcgcgtctcgtttcggggccgcaacaatagcagcccaacctttggtttgacctgagaacaaaacntctaaggtcggggggagagaccggaatggtgctccgttcaatcaccagtggcttgccatgagacaggcttcaggagggtccaagcagctgcccgagagatttttcttggggaccctcccgagggctgacccctgtgcataactgcacgtccctttcactactggggaggaacacagatcacaatcagacacgctcaaagggtgctgtcttcaatgccccgaaacagattgctactgagaacaaatcaacctcttccactccactgatggtgtcggagccccataacgacgaccccctctcagtaggaagtatccataatgattacaactacccatctccctgcgattctcatgataaataaatatccacacgtgactaaaatccttgtaaattgacagcgggggactggtgacaagcattgtctaacgtaatgcagaacctaccttaacaactggtgtcagtgtctgactgaagtggttaagttaaatagtaaaaaaccagtgctccttatacaagaggctgtgaatgtaacaaaaaggccaccaaggaggttttggcctaagcctctccctgagacctcaagagccttgattaaagcaagtgtttgcttgggagggcggcaagagacctcccccaaatccttccgtttgtgttaccaccgcagatgacaaacgaagtggcaataaccgccaccacgcttgcgacccatgttggagatacactaagacttgacttgatggctcacacaagaagggtgttccacaacctaagacccttagtgtgtaggatcaaaagcaagctaatcgcttgatggctttagaacgaatcgaaccctgtcacctatagttagagggcttacacagttattggctccgggaaatggacttccattgtgccctgcgataatccag

SEQ ID NO: 702340 - DNA, 676 bp, Homo sapiens
gagcctgtcagtatacagttagttttctagtgactcataaaataagatttcctgtttcatgtagaatagtgtttgtcaactgtcttttctctgtcccagcacatgccgtactctttatatgtacgcattggttagataattgataagtgattcatattggacttgacagaaagatgtgtcctccaggcacatgtattctgaatcacttgggggatttatgattctaccctcttgtggagatacatgctcgtcttgttcaaccccccatcctccttgagtagccacctaatgttgatgataacagcagacatcatctgaggggacacatagagcacactattctcacctaaagataaaccgtttggtaaaccttaagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaa

SEQ ID NO: 702341 - DNA, 439 bp, Homo sapiens
  misc_feature (6)..(6): n is a, c, g, or t
  misc_feature (18)..(18): n is a, c, g, or t
  misc_feature (31)..(31): n is a, c, g, or t
  misc_feature (61)..(61): n is a, c, g, or t
  misc_feature (365)..(365): n is a, c, g, or t
  misc_feature (432)..(432): n is a, c, g, or t
  misc_feature (434)..(434): n is a, c, g, or t
cggggncgagacacaccncagagaaccctgnggattgtgggattgggagggaaactttgcnattccttgcccccatccccacaaatttcctgaccttaaaaacactgctgtgccccccagttcagtatttgccctttgacaaacactgtagggcccagtgagaaagttgaagagatttttcaactgactagcagtcggtagacccgttaactgaggccaccccggccagagcacattgcattcctgccaacagatggtggcctgtatgatgacagggcctctcttgcatatggccttttataattaaaagaaagaagtaataggtagaaagagagagagagagggagaaggcaggagaaaaaaanttgcagcatgcttttaaaatgtcatcgcaccactgcactccagcctgggtgacagagtgaaactttntnttaaa

SEQ ID NO: 702342 - DNA, 300 bp, Homo sapiens
gcgctggccaacatcagcggccggctgtcgggtatggccaatgccttccggacggtgtaccagctcaacggcctggccgctacttaaaagcatccagcgcgtgtcatctaccagatgcctccaccgccatttcttgtctgctatgagtcttcaagtacttctcacaagcgcatggaaaatcgagctccatactaaaggagggatcatagatctgtcttaagtcatctctgctgcatcagcccttgcctctctacacgtgatcattttgtttcagggtctgctatggccttgtccaagcta

SEQ ID NO: 702343 - DNA, 288 bp, Homo sapiens
cacgaggagcgatgttgccctggccggtggcgtgggagaaccgggtgaatgcctccgtcatcatctgattgaaaggcacctcgatcacgcggaagtggtgtcgcgcctggggatcccccgtggctgcgcgggcggctttctccgccaatcccagcagagacggtagcgactggaacaggggatgatcggtctccactcggaaggcgttgaaggtggaaactccgtaacagcggatcttgccggcgaccgtcgcccgctccaaggcgacgaaggcccgctccagcttgc

SEQ ID NO: 702344 - DNA, 499 bp, Homo sapiens
  misc_feature (178)..(178): n is a, c, g, or t
ttttcaaaaggcaggctctggcaaggttggtcaaagacaatggccccggtggcagttaagcagagattcactgatgacttacagggtgccctattctgaggtacaggaacccccggctttttgatgggggaaaatccgcccttaggctggagccaacatgactgtcctttaaactcangtggctggccaggcacggaagctcacgcttgtaatcccaacacttgggaggccgaggcaggtggatccctgaggtcaaaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacacccctgcactccagcctgggcgacagagtctccatttggggaaaaaaattaaataaataaactccccgggcctgcca

SEQ ID NO: 702345 - DNA, 273 bp, Homo sapiens
ccacgtagactactacgggagcgcgagcgagtggggcgacgaggctgacggcggccagcaggaggatgattctggagaaggagaggatgatgcggaggttcagcaacgcatgcctgcataacattttccaacccggagcttatatcatgtgaaccctcctatcttcaaccactctgcaagagtgtattttcatggcaggcagggtctccatgagaatgttatccagactcttatcatgaaaactacaccgcgtgtggcccagcacttgtgaac

SEQ ID NO: 702346 - DNA, 259 bp, Homo sapiens
  misc_feature (45)..(45): n is a, c, g, or t
  misc_feature (233)..(233): n is a, c, g, or t
ggggcccacaggtgtgcaccacaactctcagctaaattttaaaantttttatagaggtggggttttactatgctgtccagactggtcttaaactcctgggctcaagtgatccccctgccttggcctcccaaactggtgagattacaggcgggcacctgtgatcctagctacttgggaagctgagacaggagaattgcttgaacccgggaggtggaggttgcagtgagccaagntcatgccattgcactccagcctgggc

SEQ ID NO: 702347 - DNA, 523 bp, Homo sapiens
  misc_feature (445)..(445): n is a, c, g, or t
tgtggagacgggggtctcagagatgtggagacaatatgagcggtgccaacaggcaggtaagggcagtcccaggagagaaaagggggcagaaaaagtatttggaagacaaaaagggccagacatttcccaaattggataaaaacaacattcatctacaaatggaagaagctcagtcaacccaaagtaggataaatacaaagagatctaaaactaaactccatctcaaaaaaaaggtaataaaaaaaaagagagagagagaacatacaatgtgatcaaagttcaggaataaaagagcgtatgtcagggacccggcagaaactaaagggtttctaagagaatattaggaaggctttataccaacaaagtaaaatacttagatgaaagggatgatttcctataagggcacaaactttaaaaggtgacttaagaagaaaccaaaattggnaaaagatctgtaacaacgaaagacatggaactagtcatttaaaatcttctggggggggggcgggggctcaggccggta

SEQ ID NO: 702348 - DNA, 152 bp, Homo sapiens
tcttgcgagtgtgtgacgtttagatacatttgaatttagaaagttagactgcttctcgagcgatacacaccttcgggcctcatttggcccagcgattttgggcgtcaggttttccaaaacagaggcagcgtttgacgttagatttagcatca

SEQ ID NO: 702349 - DNA, 103 bp, Homo sapiens
ttgaacggacgactcggaatcttagagagcttggaggcgcaccgcctgtcactttggcgacgcgcagttgggacagctccaccttcaggtcgtctgttccaag

SEQ ID NO: 702350 - DNA, 533 bp, Homo sapiens
  misc_feature (29)..(29): n is a, c, g, or t
tcgaggtgccttagacagcagtggcatcnacttgtcaggctttgggagtgcgcagctagacaccaatgacgagagtgatgttaccatgtacactaagttacatcttaccttatttctcagccgttaacctagatgtgcaatcactgttactacctgttcattacaactagccacagcaccaggggaaaaaaccatgtcctggcaacagattcaaactgtaggcaaaaaccggcagagactgaatagaggtccctcattggggccccaaaggcagcatccagaaaaggcacttcaaagcaggtaggaaagggcaagagcattcagggaggggaaccagggttgccaggcatctgtggagaacactggccgaaagaaacaaaggctcggaaagtccagccccaagggaggctgaaaccaggcctcattacacagcaggggcctgagaagttagcgggagacgccgtctacaccaagtccttcgttcaccccaatgagccattaaggcagcagatctcctgtgctgaaaacccttc

SEQ ID NO: 702351 - DNA, 996 bp, Homo sapiens
tggcgtctgccggtcgttggccaagaggcgctgcctaccaaatccattgtcatccccagtccataactttcgttgtgctcaccttacgacccccaactaattgacaaggatgctcttacaacggcaagaattctggcaagtgttcgtttgtcaatccccaggcccgggcttgggatcatgtagatggcacgagtcaaagccaattgtgattgaatgaactgaggcctggctgtcaattggcggtccctgagtcgcctctattgcgggatgaactccgcgggagcctatggtctcccacaatggccccatctcctctgtctctgcagtcctggacaaccgcgggccaaggaagagttcggggccatgagacgagcagtacatgcgtcgctggaccacggcttgcctgctcggtgttcgccattaatgaccggcagagtattcaacgatggttgggcaagctcttcacgcagattctgcgggtacaaggaccgcgacgacttccccgttagtgttggtcgggaacaaggcagatctggagtcacagcgcacaggtcccccgaatcagaagccatcatgcccttcaggcgccgtcccacgacgctggcccataccgttgtgaggcctcggcacaaactgcgtcatcaacgtggacgaggctatttgagcagctggtgcgggcagtccggaaataccaggaacaagagctcccaccgagccctcccagtgcccccaggaagaagggacgggggctgccccatgggtcctcactgtaagcccaggcaagagagaagcaaccaccacaagctctacgggagctatgcgtgccttcgacaccttgcatagtgtgacactgaggccctcactgagcctcaagtttcctcatctgggtctcccaggacacatacataccaaccctaacggtcctggcctcttctgggctactagccactgtgtgccttcagccaacgcctccgtgtccccacctaagcctggtgg

SEQ ID NO: 702352 - DNA, 1273 bp, Homo sapiens
  misc_feature (226)..(226): n is a, c, g, or t
tggaaaaacccagttgatattaatggcccggggggcagggggcccaggaggctctggggggggggggtccgtttcctcttcaccatcacagggcttactgggctggcccaggatgggcggctgtgccctggaggggatgggttggccattgcagcaggtcggggcggacttggtcctggcggagatcatggtgtgtactaagatcgctgctgagagctgtggccgngacgcatcctagtgtagatgggtgggtccgcacatagagagttgggcagggctctccggttgggccggaaatctcccgtctaaaatggacccaccagagacaaccttaggccggaacaggcatggccgggttaccacggcccaaaaggtctgagcggggagaatcaagccctgttgagaagcgggaagggaatttggggggctcttcaaggtctatgggcgctcaagaggctggaagggttctgggtataatccccttattgggatcaggagaaactctgggagcaagattcacgagaaagagacccataccaatatgggaaaagattagcgagcagaaaatatggggcggagggggggactccccatacgcagaaagtggccaaagccccatggaaagttgtacagagaacactatgggcgccccacaaccccaaaaaggggtgggagaacgctccagggggtggaaagccccaccccttgtgcgtgagggagcacttcccacccaaaaaaacatatttgtggcaacacaccaatatatgagccataagttgataataacaaggcgccagaaaagctcacaaacacggtggacagagaccccatcagtgaggaatcacacagagaggacactgggagcgccaagtaggcgccaaaaaagataacaaccatgtgggaacaatagactattcaaacacacgcaaaaaaattggcggacaagaacaaaacaacagacgtgaaagaggggaccaaagcgaacccaaatagtataagacaacccacgatcaacaccaagtagacacaacaccacgtgtacactactgatagaccaattgtccagtgaaatggtggatagagtaaacacctaataacgaaagatacgacctattaaacaagaaccgcccatgacgaccccagctgaaccaaactgagtaagcagaacactatggcacacagaggaataaaagaggagcaacgacgagaaccacacaaagtaggcgtaatcactagtatgtaacagccaccaaaaaatggagcaataagataa

SEQ ID NO: 702353 - DNA, 775 bp, Homo sapiens
gggcccgtccactggtttggtccccccccgctcccctttgtgctggaatacttgtcgggcgtcgtcttagagggtctctctcgctccgtcggcctctggctgatactgcacatcacccttctcatgtcgcaggggggtccttctgggcgtggcgaccgcccccaccagcccttgttggtggtttagtctgcttttgtcgtggaaagattgccgcaggccctacgactctgcggcacgcttatctgtcgcgtagggacaatccccccacgggggccattccccccccgctgcacttgccttttttgtctatctcgtactcgagtataggctagagagtggcgcgctgcgctgccttgttccccccacactgagctgccctcccatctgactccagtgagtgtgccacgcctcccattgtctttaggcaccggcgccttatttgtgtctctctccaatgggagtccctttgggcgagacttgtgttgtatgctgacgcccccgctcatgtcttgggcagcgggcttgtttcttgtcttccccgccctctgaaactagcgtcgcctcttgttctcctaagctcctgctctgacgtttctcctcggttgctgtgcgcaagcctcctccccttccctccacgtgtgtctgctggtggcaccccagctgtttctacgacgactggcccgagtcgcccacgcccccggttttatgtcccccgcctggtccccgcgctcccggagaatcccccccgcttgatcccgcccccccaaacataaca

SEQ ID NO: 702354 - DNA, 313 bp, Homo sapiens
cgtctgctgttactgagggaaaatagtactaggtatatatcagaacaactactccagctgacacaggatgccatcaaacattaaaatataagatcatacttagattttctgaaggctgatcaacagatacgacagagatgggaaccctttcgggaaaacataaaatcccttctaccccagtttcgagcactgttaagaagttataaaggaatgtgaaattatttaagatatttcaaaagagaattaagaatggaagagtatattctgctggaaaagatagggcagctttacagtcgtgcaagtaaatagtcta

SEQ ID NO: 702355 - DNA, 675 bp, Homo sapiens
  misc_feature (19)..(19): n is a, c, g, or t
  misc_feature (64)..(64): n is a, c, g, or t
  misc_feature (66)..(67): n is a, c, g, or t
  misc_feature (70)..(71): n is a, c, g, or t
  misc_feature (75)..(75): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (90)..(91): n is a, c, g, or t
  misc_feature (100)..(100): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (115)..(115): n is a, c, g, or t
  misc_feature (120)..(121): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (151)..(151): n is a, c, g, or t
  misc_feature (166)..(166): n is a, c, g, or t
  misc_feature (168)..(168): n is a, c, g, or t
  misc_feature (177)..(177): n is a, c, g, or t
  misc_feature (237)..(237): n is a, c, g, or t
  misc_feature (242)..(244): n is a, c, g, or t
  misc_feature (258)..(258): n is a, c, g, or t
  misc_feature (263)..(263): n is a, c, g, or t
  misc_feature (274)..(276): n is a, c, g, or t
  misc_feature (278)..(278): n is a, c, g, or t
  misc_feature (280)..(280): n is a, c, g, or t
  misc_feature (286)..(286): n is a, c, g, or t
  misc_feature (290)..(290): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (310)..(310): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (337)..(339): n is a, c, g, or t
  misc_feature (358)..(358): n is a, c, g, or t
  misc_feature (404)..(404): n is a, c, g, or t
  misc_feature (556)..(556): n is a, c, g, or t
  misc_feature (591)..(591): n is a, c, g, or t
  misc_feature (601)..(601): n is a, c, g, or t
  misc_feature (662)..(662): n is a, c, g, or t
agtggtgaaggtgaatttntagctgaaggaggaggcgtgcgtggcccaagggttgtggaaaaanannaanntgcntgcaaanantnanannggcccttcngcnctnangaaaaanggaannaaaaaancncttntggctgcaggaagaaanggttgaatgaagaantnaaaaaaaantttaaaaaaaaaaaaaaaaaaaaaaaaaaaaaaaaaaatgaaaaaaaaaaaaaaaaaaangaatnnnaatcgttgaacaanaaaanaaaggaaaaannnanantgtgantttncctcagcnaanaaangtganaanacntanaaccgagtgtcagaagannngagaagaagaattgaagtnatgaagaacaaagtcatagaaaaagtacagcatatccagcttctgnagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacangtcattgccaaagacttacttccctctagagatangcaacacttntcactgataaaaatgaaaccagttccagacttggttcccggaaattttaagagccagcttnagaaggtacccca

SEQ ID NO: 702356 - DNA, 150 bp, Homo sapiens
ttagacgagcgacgggacacggtgggaatgcttaccgcaggtcaccaacagccactatggagtcagaagcaggtatgagaggtggcggtgtgcatgctggtcccagtgttacaccatcccgatcacgtgtgctgtactgcatgccggaag

SEQ ID NO: 702357 - DNA, 670 bp, Homo sapiens
  misc_feature (9)..(9): n is a, c, g, or t
  misc_feature (126)..(126): n is a, c, g, or t
cattttagnggggggctctctttctctttcccggtgtgaagaccgcgcccccccaggccaaaaaccggtggtttcttttccctttttttgcccccacagcgccccccccccgggggggggcgggtnttttagggtgtttttaaaaggcccgcggaaattttaaagtggggataccaaaggggtctccccccgcggttttcctatttggggttcccgcccgggggggggggggccaccccaaggccccgggcccaagaataaaataaggggggggggattattacccccttttggccggccccttaagggtttggaattggggtaggccccttttttaatttttttccttcccgggccctggggcccttttaagggggaggggttggggggttttccccctttttgggggaccccccccctggggtgggaaaaatgggggccccaatttggggggttgggtaaccccaccccccccgaaggttttttacccttttcccgcgggtgggggggggctaaaaaaacccaaggcccattttttccccccccccccaagggggggggggggggccctggtgggggaatattttccccccggggggaaggggggggcccataaattttcccccccccccccggccgggggggggccttcctttttaaggacccgggg

SEQ ID NO: 702358 - DNA, 384 bp, Homo sapiens
gaccattttgtgggggttgggttctgaaaagtagctcagggcacgtgttaaggatgtctctaggtgactctaacttccctggctattgtttgaaaccgttatgaccttcttgcttatcagcttgctggtttccttctcggggcgagctgggtgcctggagttttcggtgaaggaaactcaagattctcctttatttctgtgcttgtgggaatccccctgggacaccccaaagaggggtccctgctccggtctcacagggatcttttaggatattcggcttaacatcatacatttggcacgttgtttcatcatctggctaatttactggttttgaatatttcatttgtttctaattgttactacagataatggtggggtgagcaa

SEQ ID NO: 702359 - DNA, 135 bp, Homo sapiens
catgatggctttctaaactaccagtgttcaaatacataaatgaaccaggatcccgtagtgaaaaacttgcagcacataataggcagccagtgacgtcgttataaaagattggagcatgggcatatagtggaaagt

SEQ ID NO: 702360 - DNA, 305 bp, Homo sapiens
tactgggtcatccgcagtcacagaccggtgtgggagagctgcatggggaaaccagattctggcatggaacggactactgcacatttcgtcttacaaagactgggttcaactctgacaaaccttttgctagataatcattgacaggtactccacgccccggatgccctggcatgacaattgcctctgcagtctacgggagggcggctcgtgatgttttacgtcacttcatccagcgctggaacttcacaaacattctgaaatcaaactatcggtccctttcttatccttttctgcttccggacgaa

SEQ ID NO: 702361 - DNA, 316 bp, Homo sapiens
  misc_feature (239)..(239): n is a, c, g, or t
  misc_feature (257)..(257): n is a, c, g, or t
  misc_feature (259)..(259): n is a, c, g, or t
  misc_feature (270)..(270): n is a, c, g, or t
aggggccgggggtttttgcccagggctcccctggaccaggacgccaggtagggcagggaacctcagtagtcctccccccagccattttcagagatgaatgggtcaataacctcaatgcaggcctgttggggccggaggtggctgtggtcctcatcaccctcgtggtttcggtggcacttttccagctccctgggggttgaccaggagccggtcaaagatggacctggccagatgtttgncccccccccaatttcagngntaacatccacncttccccccatttcctgcttgccagtaaagccttcgataaacgcta

SEQ ID NO: 702362 - DNA, 243 bp, Homo sapiens
aagtcggtacctgccaaagcgtagtacccaaagtgctgggattacaggcgtgagccactgtgcccagccaaagttataaagtcttctaaggcctaaaacaaggcagaaattactaagagtctcactctattgcccaagctagagtgcagtggcacaatcatggctctctgcagccttgacctcccaggctcaatcgatcctcctgcctcagccttctgagtagttgggtactacgctttggca

SEQ ID NO: 702363 - DNA, 82 bp, Homo sapiens
ggatctcccccttaagaaaggaaaactgaaccatcctttagaagaggaaatatgatttacctgaggaagagacctgatctcc

SEQ ID NO: 702364 - DNA, 318 bp, Homo sapiens
  misc_feature (58)..(58): n is a, c, g, or t
  misc_feature (90)..(90): n is a, c, g, or t
  misc_feature (254)..(254): n is a, c, g, or t
  misc_feature (290)..(290): n is a, c, g, or t
gcgccatctgggctcactgcaagctccgcctcccgggttcgcaccattctcctgcctnagcctcccgagtagctgggactacaggcaccnaccaccacgcccggctaactttttgtatttttttagtagagacggggtttcaccgtgttagccagggtggctcgatctcctgatctcgtgatccaccccgcctcggcctccaaagtgctgggattacaggcgtgagccaccgggcccggccttgacttaacctnttctaccgctgcaaggccttttccttagtgggtttncagaatgggtttcgattggtgatatttt

SEQ ID NO: 702365 - DNA, 651 bp, Homo sapiens
gggttttcttaatggtggtcttccgctccctggctgggtgatgatattttctccgtgttggggggcgccgcttttttggtgggacgtgtggcgctcgcttggttgtccgtgtggtccttccgttatttgttgtctgctggtgggctctctttcctcctgtcttcaggggcgggttggttgtcgtatagacgtctcgcattcgggtcctgccccagtgccggcggtgttctttcgtctcgtcccacacgtgtctctctctcattgcggcttttctccttcgcccgcctctctgtttgttgtgccggtcctccaatccctcccccattgtgctttttctggcccgccagaggtcggtgtggccggcggcttctccgcggggtgtgcacacccctcttgtagtaacgcgtcgtcgctggttaccccgctggtgtgggtctcccctccgctgttggcagtgtgctcaccccgcgaggcatattcccctcggtacggctgttcaatttttgacccaaatgtatcatctcccgctaggcaattcctccacaatttctgatgccccttatctccccacaccccccttttctccccgcttttctattaactaatcgcctctttcaacctttgtgttacaacccccccatcattatcaca

SEQ ID NO: 702366 - DNA, 275 bp, Homo sapiens
gattagaggacccggaaaattagcgacgcatgagctccaggaattccctttggcctggtggtgaaggacttggtgtgtcactgctttggctcaggttactgctatatcttgggtttgatccttggcccggaaactgtggcatggccaaacagaaaaagaaaaagacctaggctccagaccatgactacctggactcttttagacgatgctaatgcctatttcttaacagaaaaggagtgtaatctggtgtatttacgagagactttctattgggg

SEQ ID NO: 702367 - DNA, 380 bp, Homo sapiens
tggaaacagagtcgtcggtcacccaggcgggagttcagtggcacaatctcggctcatggcaacctccgcctccggggttcgatgccattcttctggcctcagcctcctgagtagctggtactacagatgcctgccaccatgccgggctaatttttttggtattttaagtaaagaggggtttcacggtgttagccaggagggtctccatcttctgacctcatgatctggccacctgggcctcccaaagtgcggggattacgggcgtgagccatggtgcccagcctcatggtgttttggatatgctttttactaatgattagtaagcggtggagtatttttccaggtgcttctgggccatgtgtatatcttctttggaagtg

SEQ ID NO: 702368 - DNA, 417 bp, Homo sapiens
  misc_feature (205)..(205): n is a, c, g, or t
ggtttttaaaaatttttttttccaggggcgggccatgcaaaaacccccggggggggggccctttttttccaggaaaagtttttaaaacttgggcccctgatttttaattgccggggccttgggaaacagtgggaagtaacttggggcccccccgggggatttttggctttttgtgttggaaactttgtaatgtaaaaggaaaaantggaaatcccccccccctgtttcccttttttgttttggggggggggggggtcaatttgtttaacccaaatttttggtcccggccggggttaaactgggtccaaaaaatggggggtttggcccccagttttttttaattggggggggatagggttcggggtttccccccttgttttaatgtcaaaaaatgccccccctgttttgttagggcca

SEQ ID NO: 702369 - DNA, 712 bp, Homo sapiens
gggggcatattctctgcagaatttctgaaagttttccttccatctctgctgctctctcattgctggccatcggatggggatctatatggaaggcgtctgacaacctccaccagcacctttgatgaagaaccggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaattggtagtaaattttcatttgatattagatataaatatctgaatataaataattttaatatactagtcatgatgtgtgtgtattttaaaaattatctgcaaccttaattcagctgaagtactttatatttcaaaaagaatgaataacattgataataaaatcgtactttaaggggttgtccaaaataaatatgtggcttatatatcacactatgtagaaagtattattaatttaatggtgcaggtgtctactaaagaagattatttttactatgcaattgtcctaatcaaagaaacaagatagaggtacaaatcggtgtcgttcgacactaactttgctggtttaaggataggtca

SEQ ID NO: 702370 - DNA, 347 bp, Homo sapiens
ccaacgccatcatagctgaaggcatccctgaggcccgcacgagaaacctgatccagaaggcggaccagaagggagtgaccctcatcacacctgccactgttggaggcatcaagcctgggtgctttccgcttggcaacacaggtgggatgctggacaacatcctggcctccaaactgcaccgcccatgcagcgtgtcctatgtctcacgttccggaggcatgtccaacgagctcaacaatatcatctctcggaccacggatggcgtctatcaaggcgtggccattgctggggaccggtacccgggctccacattcatggatcatgtgttacgctatcaggacactcca

SEQ ID NO: 702371 - DNA, 121 bp, Homo sapiens
ttgatgctaatttcgggtggcgcgcgctaactgagtggtcaggtgtgctacgctagcgggggcgggttaccggtgaccccttcgtggtgtggctcggggttgcgattttccccatgaacga

SEQ ID NO: 702372 - DNA, 606 bp, Homo sapiens
tgcaatatctctgtgctctccagttgaacttggtggcaataaaattaagaatctgccagtgccccccaagcatttctactctgtccataatgtttagtgacaattaactattaccaggtgtagccacccttacttaatcttagtgttatggtgcaagtaatccttagtgaaattattgttctgtagagaatgctgtgatctaagtgaagtgactttcatcctgagatgacaatggagttgtttttgtcactgtaaaggctgcatttactcgcagttttaaagcattattgctacttatatatggtctcaacactgatttttatatttgactttgtagctttaagtgtaaaaatttctgttaaggttttatatgtgttagttaatttttcccatttcaataaccatgttttattattgatggagtctcctaaaaatatacccttaaaatctgcttgccctgtgcctgcacacatattttaaatgttgggtatggagtctttttttttttttttttttagacagagtttcactctgcagcccaggctggagtgcagtgagccaagattgtggcactgtactccagcctgggtgataactccttctcaa

SEQ ID NO: 702373 - DNA, 589 bp, Homo sapiens
  misc_feature (44)..(44): n is a, c, g, or t
actagtaggtttaattagggataggggggggggccttatttctntactctatcccttcctacatcttatcatttttctccatctcccaaactacatcttaacccattatacagtacatttccttcttttacaaggactagtaagctgtatatctatatattatggctgcattctctacctagggggggggcaatactttcttccatcctgataagtgctaaacgctaggggactcttttgagctcggcctggaacctttattttatgtgatgatgaaactttatcccatgttccttgaactgacgacacgagtgcgtcttaggactctatgcccagcttatgctaacggtcagagctgaggtgctgcaaagacagtccgttaatgagggactgttctttggccctgttgagacttatgcttcaccaggactcgcatcagctccgctttcacatagcttagggtacatcacctccctgaagggctatgctcttttggttcctaagcaaggacataaggccgcattgtggtaacattccacatgaggtgacggcgctgccctccgagtcttctttttccttatggcggcag

SEQ ID NO: 702374 - DNA, 1024 bp, Homo sapiens
aaatggcggatgacgccgtgtgcagcgggggtggcccgtggggccctgtgtggccctggtgctggggaaccgcggtgtgcttccgcggaggtttcggcacgtggcagtccggtggccggggtcgcggccgtggaccggggccggggccgagtgccgcggagctcgctggagtgcaaggccgacggataacggagttggaatgcccagtcacacaaagttgggccgctttgggctcaagggactttgacggatcaagttcccgtggagggagatctagtcgtcttctcccgtgcccatttaagggaactcaggaagaatcactctgatttccttccgtgggggccatcttctcagggcatgaggtcttcgaagatttatgccagtgcagaagcagacccgtgccggccagccgcaccaggttcaagggcataggtggctatcgagggactacaattggccacgtcggtctggggtgctaaggtgctccaaggagggtggccaccgccatccgtgagggccaatcatccttggccaagcttcttccatcgtccccgtgcgcaagaggctactggagggaacaagatcggcaagccccaactgtccctttgcaaacggtgacaggccgttgcgggcgctgtgctggtacgccctcaattccctgtagccagggggcactggcatcgtctccgacacctgtgcctaaaaaagctgctcatgatcggctggtaattcgatgactgctacaccttcagcccggggcctgcacttgccacccttgggcaacttcggcaaggcacctttgaatgccaattctaagacctaaagctatcgtgtatcccgcggaactctgggaacggagcactggtatttcacgaaggtttcccaatatcgggagctccactggaccacactctgggtaaagaataccacaccgaggaagatctgctggcgcggggaaccaagggccccccagtggggcctcacaacaacgggtgttatattcagcaacaacactgtgccgtac

SEQ ID NO: 702375 - DNA, 428 bp, Homo sapiens
  misc_feature (152)..(152): n is a, c, g, or t
  misc_feature (167)..(167): n is a, c, g, or t
  misc_feature (402)..(402): n is a, c, g, or t
  misc_feature (420)..(420): n is a, c, g, or t
  misc_feature (426)..(426): n is a, c, g, or t
gtaccctggtggctggcataattctaagggcaaaataatatgaccatctaatcatgtatacccatggctatcaggaggatatagcaattatataagataatacatggtcaagaatctacgcatcggatgtattcttttcttcttctttactngatgcattcaaaagncaccactggatttttttcaatgtaaaaaagaaaaatagatacccatgccaaaattcatgggtgtaaacagccaacagagccaaacttacaaagaaaatgaaagacttgtttctggacagtggtttattggtaaagatataggacatattggctactattaaaaactcaggtaataaagcactaagcttgatttattgtatcgctacagtctctttcttctaaggggaagaaaatntccccaagaataggatgntacctnag

SEQ ID NO: 702376 - DNA, 638 bp, Homo sapiens
  misc_feature (521)..(521): n is a, c, g, or t
aaaaaggtttgtatttgggccaaaatgtctgggaaacaggcccaaattaattattggggtgattggggaaccgttcaaagttgttcctcaggttgggttgtgcagaaaaagacaaaaagaaccccgcacaatttttttggtatagtaatggatttggcggtttgcttttgttcggaaaaccacctgtggattttctttgggtattcccccctctttaataaaaaattaacacaaccagggggcactctccttttgtttagctcaaaagtccgttccccgggcgtaatgggttttaaaatactctcatgttcaaaacagtcatggtgaccatgggttcggcttgtaaccagctaaggggggttcgcttccttccttttgtgtctagattttatgtaagggggtacttcgaatgtgtgaaagcgtggggagttcacatattgtcactccgcgtttagggtgggttcttccacaatcaggacttttcgttgggaacagaaggcttctcttttcttgtctctaanaaatattcttcctgttatagaaatgcaatcagcattctttgatgcgtatgtctcggtgggtgtatgaaaaaagcttgctctggttttgtcgggacgtgctctatctccctatatagc

SEQ ID NO: 702377 - DNA, 857 bp, Homo sapiens
ctgtaattcaagcacttttggaggccgaggcaggcggatcacgaggtcaggagttcgagaccagcctgcccaacatggtgaaactgcatctccaccaaaaatacaacaaatagccgggtgtggtggtccacgcctgtaatcccagccactcaggagaccgaggcaggagaactgcctgaacccaggagacggaggttgcagtgagccgagatcgcgccactccactccagcctgggcaacagagtgcagagtgagactccgtttcaaaaaaaaaagcttatgacaacaaaacgttataacgtgatttgggattagatgaggaaaacacactaccggaggaccatttctgggacaagtgtcattaccgaagtggtatgatccacgccatcattgcctgtcaatgggataaacagtgtgatcactgatgttgcctgattctgatcactgtctgtggttatagaagaaaacatccttgtctgaggaaaccccaccctaaaatagtaagggcatcatgcctgaaactgttccaagggctcacaaatagaggcgcatgactaagcaattgtgtcaagatgttgcagcaccggaggttaagtttcgagagtttcacaacaacagctgggctgtgtggctcacatttcgtcattcccacactttagggaggccccgtggggtggactgtgggaaccaggaggcacaaaccgcctggttacatgcaaacctattttagaataccacgttaacgctgggcgtaccgtatccggctgtgggatgcaaggccctgcatgtcaccgggtcagtaatgatcaagcacagctcccggaatacttacaaaaaaagggcgcccaatactgggc

SEQ ID NO: 702378 - DNA, 944 bp, Homo sapiens
gagaccgtgcttcgccgagagtcgtcggggtccctgcttcaacagtgcttggaacggaacccggcgctcgttccccaccccgggcgggcgcccatagcaagccctccgtcacctcttaccggagcctccggattgtgccccaagggcccctcgtctgcggcttccaaggcgccgaggagggccagcggcaggccatgccctgcacggtctacatccgttgaagtacggccagccaatagatggaagcggtgattcaaaccttttggcagggatcgccgccaaaaaaattaacaaagcccaaggggatccacaaagaggccccggctattgcaaccctgggtaggaatacaccctggggagagtttgctatgacctgacctcaacgcgttcacaccctttgtacccggatgtccatttagctcaacctttttggacccggacagtagtgctggtcaggagttctcggaagggcaattttctgctgccgaagaatgacctatttgtcttaatcaaccaaacttcctccaatgagaggggacaggacagggggcacaacattcgcgtgggaagaacatcgtgggtgagccaagtctgcggcatgagaacccatacggaacgggggggggcagaaatatccgtcttccgttgtcaggcggaattgacttcgcaggaagccccaggaactgtgagtggacactcgaacctgtggggaaagaactgcggcggacttagaacatcggcccaggtggtactgtcggtggggcattacaccctgttttctggcgccacacaagcacgtggttggaatcacacaggaccaatctaccgtgggcacatcttggcaaaccaaaaccgttggcgtccgacttgggcaacgcataaaaatgtggtcgcccccaccagtggggttggaagcctcaccacattgctgggacgaccacttt

SEQ ID NO: 702379 - DNA, 293 bp, Homo sapiens
ctccatcggcacagtcagtattgccttgatacacggtagtgtctgtgcgccctcccgcagggtcgctgttagctggttggttttctgatgtaacacatagcacatatagtgttagcaggcccgtttctctgagccttgagatcccttctgtcatcgtctgtcatagctgttccgggatttcaaagttcatttaatgtgggccatcattttttccaaacttcctagagccatcccagtagtatatttgagcctccactgagcccacgcctcagtgttaatcctatgttaggtca

SEQ ID NO: 702380 - DNA, 127 bp, Homo sapiens
  misc_feature (1)..(1): n is a, c, g, or t
  misc_feature (30)..(30): n is a, c, g, or t
  misc_feature (52)..(52): n is a, c, g, or t
  misc_feature (70)..(70): n is a, c, g, or t
  misc_feature (107)..(107): n is a, c, g, or t
  misc_feature (112)..(112): n is a, c, g, or t
naatcaataagtaatctaggactagcattntgtttgctaaacctggcttttnctcggttcatagggttcnatgtttcctttcctttttttatttattttatattttncaatnttttttttccataat

SEQ ID NO: 702381 - DNA, 199 bp, Homo sapiens
atgacagacaaacaaaattatttctgaccagtgttccgggatgaaaatgtgtgtcgtacgcaaaaatgcaagtgcctgtgcctactctcacatcgagacgactatggattttattgcccatctgagtgccttaaccttgaagccttgactcactgtagcacgtgcatatagcacgctactccagtctccatgatacttg

SEQ ID NO: 702382 - DNA, 812 bp, Homo sapiens
tagctgccacagttattttaattataaattaataaaagcctacattaaattcatcttattaactacttatgagagtgtctaaaaactgatgaagccaacattattgggacttctgatacttccattcgcttcaacttttctttctaaagtagaaaattaaaagatggcaagccatttacaaaaagacatgtaatttggttaatcaggttgacatttggaacatcttcctctaacagtgacagctgtcttctcatctatcttagcataggagtcctctgctgcctttacaataccgtcgggtatgtctccaaagcagtttgcaagtttagaaatattcccggggacttcagtttctccctttcagcagcatctttaagttcgtagaatgccaagtttaatttttgggatttctggataaatgggggttactcgttcatagacagcacctcttttgtcttgaactttatggcaatcctcaatacgggcgttgtatggcttaacatcttcatgcttcttattcatttcgaatggtgctggggcaagtttttccttccttcacgaatcatcaagtcttttggaaccggaattttcttcaggcttcacaaatccttcaagtcctgactcactcactctccaagtgtgggcgctccaagtgagaggcccccctttaaaaaaaggaaaatatcccataatttgaaaaggcggaatacgttgaaaaagaagggttcacaaggataaagggggcgcacaaagggtcccagaattaattttccccctttgttgggggaggcagagagagaaaattttaaaaa

SEQ ID NO: 702383 - DNA, 91 bp, Homo sapiens
ccccccccccccccccctttttgggggggggggggggggtttttttttatttaagcccgggcccccccattaaatttttggggggttccca

SEQ ID NO: 702384 - DNA, 229 bp, Homo sapiens
tgggcttgaaaaaaaactgaaagggaataaaatttctttgggggcggaatatgagaaaatcaaagacccccagtttgatgactggaagaatattcggggacccaggccttgggaagatcctgcccccccccaaggaagaaatccagaaagccttaagactaagacaacttgaccctgcggattcttttttccttttttttttttttaaataaaaatactattaactgga

SEQ ID NO: 702385 - DNA, 175 bp, Homo sapiens
aaactgcacaatgctgaagcagtctaaaaaagaatcaaacacaccactgcatagttacttcaaggagttactttttttaatataaaaccagtttggaccggcaaaatgtccccagatcaaagtctcaaccataaagtcacttgtccagtgtgcgggacgccacaggggccctggc

SEQ ID NO: 702386 - DNA, 1076 bp, Homo sapiens
  misc_feature (140)..(141): n is a, c, g, or t
  misc_feature (152)..(152): n is a, c, g, or t
  misc_feature (154)..(154): n is a, c, g, or t
  misc_feature (196)..(196): n is a, c, g, or t
gccggcagcggcagctcaagtggccaaggcaagatgggtcaaagtcagagtggtggtcatggtcctggaggtggcaagaaggatgacaaggacaagaaaaagcaaatatgaacctcctgtaccaactagagtggggaaannagaagaagaanancaaagggaccagatgctgccagcaaactgccactggtgacanctcacactcagtgccggttcaaaattcactgcaagttcagagcagcaattcaaagcactatcttctcatggaggacagcaattccattcagaaatcaggaacaaatgaaaccgattagacagagaaagccaagcaggcaggacacagatcaaaagtggatgatctgagggggaccccgatgtccgtaggaaccttggaagagattattgatgacaatcatgccatcgtgtctacatctgtgggctcagaacactacgtcagcattctttcatttgtagacaaggatctgctggaacctggctgcatcgggtccatgatcaagcacaaggtgcatgccgtgataggggtgctgatgggatgacaccggatcccctggtcacacagtgatgacaggtcagaaaagggcccccaggagaactatgacagaatataggggggtggacaaccaacttcaggacatcaaggaatctcgtggaggcttaccgtctcacccattcccttgaatattattgaagaggatgggaataaaggcctcctaaagggagatcaatacacataaggaccacctggacacaggtaaagaccatgtatagccaacagacagaagaaaaccaaaaactctaacaaatcctcgacgaggagggaagagatctggacactaattcagaaagtacctacggtagaatgggaccaagaaacgcacacgaggaattaggtccccgagagggaggaacgacaatgcacagggcaacaaggaagaacagaagaaaggatgcaccattgggaagcacaaggcatagacacaaagaggggagacagcagaaaaggagaaatgaagcacagggaagccagagggaacaggaaggaggagagcgacagt

SEQ ID NO: 702387 - DNA, 236 bp, Homo sapiens
  misc_feature (46)..(47): n is a, c, g, or t
cagaggacccgacgagttgtccgagtatgttattattagatacagnnttcactctgttgcctggctggagttcagtggtgattatggctccctaaagcctttatcttctgggctcaggcattcctcccacctcagcctcccaagtaggtaggactgcagctgtgtacaaccacatctgactgtttttaaatttttttctttcttcttcttcttctttttttttttttttttttttg

SEQ ID NO: 702388 - DNA, 258 bp, Homo sapiens
  misc_feature (70)..(70): n is a, c, g, or t
gagggttgggttagtggtaacgataatataatcagaaaagctcagccgggcgcagtggctcacacctgtnatcccagcactttgggaggctgaggcaggcagatcacgaggtcaggagatcaagagcagcctggctaacatggtgaaatcccatctctactaaaaatacaaaaaaattagccgggcatggtggcatgagcctgtagtcccagctactcgggaggctgaggcaggagaatcacttgagctcaggagttt

SEQ ID NO: 702389 - DNA, 163 bp, Homo sapiens
atcgctgggtcaatagtacttgccgcagtactcttaaaacttgggggctctgtgatgagacacgactgggtatttttggtgactgccccatggcacaagaggtacggaatatcattattcacccgacctccctgaatggctacttaaaactcgtctcttattg

SEQ ID NO: 702390 - DNA, 899 bp, Homo sapiens
tggtaagtgaacaacgtctcttaattgggggaggagcccggggggacagtaaaagtaaaccctggccggttaattgaacgggccgaggtcctgcggggagtgtggggtgggacgtgaaggggcagcctccttagtgacaaggccactattgtgctaatacgcattgcgcggtttcttcagcgccagctccgcccccgccgcagcgaggcgggataggtccgcccgcgcgcactatacgcccgtgacgtcagcgtcgcgcgcagcgcagtgacgaaactcggcgggtatatatgggcgcggcccagacggcagaggtctcgtgcggcgcggcctcggaggacaccgcgggggttgtcctggtggtgggccatgggccgaatacctggattagggggggcactgtcctacgtgccagacgagggactcacagcacagcagctcttcaactggcgggagacgggctcacctacaagtggcggggcctagggggctcacctggggcagaagagagggggggccccggggggaaaagggcagaggggggcttccgagagccgcctggggcggggcgcgcgggggacagtgtttcggggaatgggcacccacctcgcggggctcactttgagacatctggacggggctgctgggggtaccggaagaaacgcatctcaggaagtgctgaaacctcagggcggagatccatggtcccagaacattggaatttggccggtggccggaagccttgatgacactcggtggaaaaaaggccctggccatttccccttggttgtgtcggacccaacttggctggctcccgcacatgcgtcggtgaggacggagaggagatagggcaagagataccaaaagcatctcgagagtatcccggcagacggcacagg

SEQ ID NO: 702391 - DNA, 104 bp, Homo sapiens
aggtgaaaggcggtggggaagatggtcctcttcccaccaccgtagtatcagtagtcttgaacttgaagccacggtcacccacaagccacggtcagcacacaagc

SEQ ID NO: 702392 - DNA, 653 bp, Homo sapiens
tagacgaatgtactcacgggtttgtggatcgtgctttaactggtcatctgtttatacagatagtttagaatgtgtcgcaagcccgctgtaggtgctggcgcaacacagaggccgcctcttcgggggctctggcttcagcaagcgacactaatgcctcgtggtcgtcctgtgccatttctcccagccccatagccgagaggtgaagtcgcaagaagcgctcctcttcctgcaattcaatgtcgatcagacgcagcagcttcttgttgggcgtgcgtcgatatagagacatgtgaaatagcctgttgaggcgtccaaggctctccaaatctgtttcactttccatagcaacaatatgtaccctagctagtttgaaatcctccttgcacagatagggaattgattggcgtaacgcctccggctcaagcaacaggcgtatggcatatgtttcgacggcatcgtcaacattcatctgaagtacgatggcgcctttgttgggtacatttcgtaccagtccttgagcctcaagtttcaacagcgcctcgcggacaggcatacggctaacgccgaacatgcgggctagctcctcctgccgtcaggctgaacagccgccaggcgactgttcaaatcccatcccttacgtttctccacaagat

SEQ ID NO: 702393 - DNA, 184 bp, Homo sapiens
gcaacattcaccatctttcgtttgagtctcacggccatgagatccactccagcgacagacccctgacaagagcaggtctcttgaggcttagttgcattgggcctagtaacaccaagccagtaagcctcttatgctacttcgccctgtggggctcccagggccttggcaacttagggtcgtcaac

SEQ ID NO: 702394 - DNA, 740 bp, Homo sapiens
agcggggctggtgtccccgtgcctcgcgtgcggcggtccgggccctggctgggctgaggggcgcgcgctgtcggccgcaggaggtcgggggatgacgcggtggagaggggccggtgctcggccacgtccggatctgccgggtccttggttgggcggtggtgtccgggcgttccctgtcgagactactgcagtccccgctggaagctcgccggcgggtagcggttggggctgtgaggatacaggacgcccgcttctcggcctcccttcccgggcctgggcttgagggcaggcgttggtgggtatcagggcctgactggtgcagaatgtcactgatggacgagtggcggcgcagcccctgatcaccgatatgcctggtctatccaggagtctgtcctgatgcacctggcgacccgtgttcgagagctgactgtgtcgacacggtgctgagtgtggccgtacaaatggacaggtgccgtgtacgacgggaacgagttacctgtggagggaagcagattctagccgaatactagcctggtggtccgggacgtgccccgacaaccaggggccatgtgctggtacgaggaagtgacagcggctgtatgacacggtgccctgcgtggaggtgcagacgctgtcgggaacacgacatgagcaggtctctgcgacctcaatttctcgcattccgggtaccagttcgcgttctgctccaaggactgcactgtgaagatctggagcaacga

SEQ ID NO: 702395 - DNA, 195 bp, Homo sapiens
aattcgcggccgcgtcgacaggcttccacgcttgcgcaccgacactgaacacagcggtgtaaccgataccccgggacataatttgtgaatttctcgcttcaatgcctcgattttatcgccagctacgtcggcattggtcaggacgacctgaaggggaatcctggcatcgctaccgagccgctggatgaggttgac

SEQ ID NO: 702396 - DNA, 347 bp, Homo sapiens
  misc_feature (2)..(2): n is a, c, g, or t
  misc_feature (36)..(36): n is a, c, g, or t
  misc_feature (210)..(210): n is a, c, g, or t
  misc_feature (290)..(290): n is a, c, g, or t
  misc_feature (330)..(330): n is a, c, g, or t
  misc_feature (344)..(344): n is a, c, g, or t
gncgttcttcatgttctgcccagactgtttccaagnactggggccgtaggaatttccatgttttcagggagcctaaggaccctcccaggaggcccaggggctttcaccgcaggaccccaaggccattgaggcacatcacccaaaggcagtgggccaacatcgcggacccctgtgccttgtcacagatgggtgctggtcctcagggcgttngggacactgctgggtcgatggggtcggattctgccagtttctgctctgcagccaaagatggtcagaagcattgtcacttnagtaacatcaagtgcttaaagacatggcaaccgttcagtnggacttaagtattnaaa

SEQ ID NO: 702397 - DNA, 533 bp, Homo sapiens
gaagtaaagccccaccccgctcccccgggagtaggaaggaatgggtgctttggcccccagggctccggtcctggcatggcctgggccgcctccccgactccatcatcgctgtcattcccggcctcaagcctccaccgcccccacacgtgccgccacagggagcggcccgatcaaggcgtgacgctccgaagggtggggcctcacttattcccctatttaaaggggaaagaggccgcggcgccggccccaggacccgacccggccccaggagagtgtgctcgttctgttcacggagctggccgcgttagcgacgtcctcgagtccgcggcgggcacgatgcagctcttggtgagggtaccctctcttccggagcggggcgagctggactgcaacatctgctaccgtcctttcaacctcgggtgccgcgcgccccgccgcctgcccggaacggcgcgcgcccgctgcggccacacgatctgcaccgcctgcctccgcgagctggcggcgcgcggggacggcggcggggcggccgc

SEQ ID NO: 702398 - DNA, 701 bp, Homo sapiens
  misc_feature (127)..(127): n is a, c, g, or t
  misc_feature (155)..(155): n is a, c, g, or t
  misc_feature (164)..(164): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (211)..(211): n is a, c, g, or t
  misc_feature (224)..(224): n is a, c, g, or t
  misc_feature (237)..(237): n is a, c, g, or t
  misc_feature (253)..(253): n is a, c, g, or t
  misc_feature (315)..(315): n is a, c, g, or t
  misc_feature (330)..(330): n is a, c, g, or t
  misc_feature (332)..(332): n is a, c, g, or t
  misc_feature (335)..(337): n is a, c, g, or t
  misc_feature (340)..(340): n is a, c, g, or t
  misc_feature (342)..(343): n is a, c, g, or t
  misc_feature (347)..(347): n is a, c, g, or t
  misc_feature (355)..(356): n is a, c, g, or t
  misc_feature (359)..(360): n is a, c, g, or t
  misc_feature (365)..(366): n is a, c, g, or t
  misc_feature (382)..(382): n is a, c, g, or t
  misc_feature (402)..(402): n is a, c, g, or t
  misc_feature (424)..(424): n is a, c, g, or t
  misc_feature (433)..(433): n is a, c, g, or t
  misc_feature (442)..(442): n is a, c, g, or t
  misc_feature (449)..(450): n is a, c, g, or t
  misc_feature (458)..(458): n is a, c, g, or t
  misc_feature (485)..(485): n is a, c, g, or t
  misc_feature (493)..(493): n is a, c, g, or t
  misc_feature (506)..(506): n is a, c, g, or t
  misc_feature (528)..(528): n is a, c, g, or t
  misc_feature (549)..(549): n is a, c, g, or t
  misc_feature (553)..(553): n is a, c, g, or t
gctaggggttattcgtcccaggaaccctgacttccctttctccccagttatgatgggaagcataattattaaaaagcatccagaacatcctaactggggagaaagggaagtcagggttctaggggtnattcgtcccaggaaatagaagtgaaatngtctttatnaagtgaaaactttccncntntgccctgcaatgtagctgggcattcanacggagggcaaancgatgatctaaancaaccacttggaaaancccaatggggacattgtaaccagagggtcctggaggtggggttgatgggtttccttatcccnaaagtcactcctgtntngtnnngtntnncttngggggttnngtnnatttnnggggctggcaatccanaatagaaaatctgatccttngaggctctaaaggaaaatcagntgcctctancaaccaccntctatcnngcagtggnccaggaaggaggtcaagcatcttcggncgatattnaaacatgggcagnttccttcaggatgatcaccgangctcccgtgactttgaactcnctantctccagaatccaggggctatagcgatggggactgaggaattacgagggctggctgtaataaaccggtcacatttctatgggcagtgactgcatcatgggaaagggctttgaacggaactacttcagtgccacaacacaaggtacgac

SEQ ID NO: 702399 - DNA, 128 bp, Homo sapiens
aagaggcagcgctcataaattgcttctacaaacgactacaaaatcttttgaaacaggccgggcatggtggctcacgcctgtaatcccagcactttggaggcaggcggatcacgaggtcagagagatca

SEQ ID NO: 702400 - DNA, 196 bp, Homo sapiens
gtggatagtggaaacaggatgatccgtggatcctccttccaaaaaattggaggatggaaagcccgtttggggccaacaccctacagatgggatttcagatgggcaatattgttggatatttggcccccgcagctttaacaatttgaaccccttggaatcagaaagggcaagacattttttgggctctcataaacca

SEQ ID NO: 702401 - DNA, 821 bp, Homo sapiens
gatggaatcatggatgcttgccaattatagatcagttttttgccatgataggatctaaagtgaactggaaaagctgggaaccttggatggagtgggtggtagaccatcgaaaggagcaagagcaagatcaccgtgacatccgaggtgccttactccaaaaggtattgagaatatctcaccaaaaaatattgatgaagaataactctactggtgactggttgcgcgtagttgctaatcagtaaagagagttcacagaacttacgttacttccagattaaccaggacgaagaagaggaggaagacgagggattaaatttcatttatctggaaaagttttgtatgagttcttgaataaaaatcttgtggaaccaataatggtgggtttatccttgtatctctgcagtgtggattgaacatgaagcatttggcacaccctcatatggtcaaatgggcttcccttgagttcgccactcatatatttgtaatcttgacttcttatccctcactgctataaaaatttcaattgctcgtggtactaccaagacgtcaaacggagagggtgacttacctgaattgacatgccacttgcgggaggctgatccgggtgttggaggtgtgcggctgacaggtacgtgacctgtatttgatcttctactcactgtcgttgactcgtcaggttgtcaccctagctggtttactcaactgctctcatgggtgtccccatgggggttctgctcgttcatttggagataatcgccaattctttctccggattacgctgcggggaccctgactgtcgaaaatgggggttcttggggcct

SEQ ID NO: 702402 - DNA, 107 bp, Homo sapiens
  misc_feature (51)..(51): n is a, c, g, or t
cggtcttcagtcaatcgagcactgcacttgttgagatgtcttgtgactttncagtgagtgatctcatcttctagctcacagctaagtggtctgagtggcagtcctca

SEQ ID NO: 702403 - DNA, 140 bp, Homo sapiens
gggcatttcagttagaggagggtgaagaaactgaaccagattgcaaatattcaaagaggattggaggagtcgagagaacaataacaataatgagaaggtcttgatttggaccaaaagttgtaaagataagactgtaagaa

SEQ ID NO: 702404 - DNA, 122 bp, Homo sapiens
tcatcacgctctctccccttttccgggtgactctgtgctgacttttctgtccagtacaggttcagctcatctctcaggcacccggcactcatctctagagaaattcttggctcagcgctccc

SEQ ID NO: 702405 - DNA, 742 bp, Homo sapiens
  misc_feature (431)..(431): n is a, c, g, or t
cgcatttaaaatcatgtcacctacaagtttaattttcaacatctcatgtttttatttgtcccattacagcctcaaatgttggtcataaaaaaatttaggctaccaaagtttaaagaataaaatgaaaattttataagaacttacattaaaaactcagtagtttgcatgagtaataactccttgagatacacagatccccccacatttgtatttaaaataattggtgaggcattgaaatccagaattataataaagcattactgaatatgtgtgttataaaatcaatattattataaacaaaataggaagctagaaatatttgggatcacagtaatagcttttctcaaatatacttttagaattgaatgtacattatcctataatgtaaaaaagcaaattattaatttaatggagctctcgattgacctttntagcatacttttatagcatgtatattaaaatagaatatattttagcaaaagattgccataaaaccctgacttggcttattttgaaaattgcactgtgaataagggcttacatttcaatgtacaatgtggtggcagacaatatactatgtaggtcttttaccgtaatgcctaattgttccaaatttgctataattggaggtgctttaactggactttccggttggcttttttgacttgtgggagcacaatcttccttaacgctttatccttgaggggttacctacattcactattttgatggacccccacct

SEQ ID NO: 702406 - DNA, 780 bp, Homo sapiens
ggctgctgcaatgactggtcaacgtcccccgcgtcctccaacagcctgcgcactgctcgatgccctcatacaaggtcagcagctgctgcaggatcttcacatcgagtggctcgcacattcctgaagtcatgggctggccaggacattggtgacccgccaatccggtatggacgactggaagcccaggccccctcatcaatgccctttggggctcggaagaagcggagctggttaccgttacctggaagctatagcatctgacaaaccagacgggccctgcggcagattctgtcagacagggcgccgctgctctttcctgcctggtgactgtcattgtcaagtactcaagtctgatcctggacactcggcgacccatcacttgaagccaagtgaatgacccagagccacgagcaagactatgatgaggccctaggccgccgtggagccccccacggacgcagaggccagtggctccccggccgcggtactggacgctagaggctgctattcaagctccgcatccaagctactatgtggcacagcgatggcaccacggcgccttggactggactcagcgccccgcgcaacccacgcgccgcggggcattccgcatggctcaattaggtcccttcaaacaccaaacgccctacgggtggcccaccggtagcaatggcacatcaacggctggtgatatgaaccacgtttccctcatcactttcactgaaccggatgcacggccctgtgcgagcctaattctcgtcaccgatgggaagtggcccg

SEQ ID NO: 702407 - DNA, 254 bp, Homo sapiens
  misc_feature (27)..(27): n is a, c, g, or t
  misc_feature (49)..(49): n is a, c, g, or t
  misc_feature (51)..(51): n is a, c, g, or t
  misc_feature (69)..(69): n is a, c, g, or t
  misc_feature (109)..(109): n is a, c, g, or t
  misc_feature (144)..(144): n is a, c, g, or t
tggagtaaaggtaagcatgttttagtntctggagtattatattgtacgntngagctaggtatttaagantattttggaggtcgagagggaagactccaatttactggtngtgcttggccagtaatcaaggtgacagtttaagtnttgggtcttgcactgtaaactcctgcttatctagacttcagactaccacagagcccacacagccagggaagtctgtctccccatttagtctttattgagcaagattggat

SEQ ID NO: 702408 - DNA, 110 bp, Homo sapiens
cggacacttgacactggacttagaaaggacttggaatgaacactgcaatgccctggacctcaacatgtacatggaactggaacctgaactcaaacaggacgttcacactg

SEQ ID NO: 702409 - DNA, 209 bp, Homo sapiens
catatttgaaatccttttcaaatcagatcagtggggccatctatcaggagatatcaaccttcaggagcctgagcaagaagactgaaacttactggctgacttaggatagctgcagagagctggaatctgacacaaaactagttggagcagccctgtctgtcttcaagcaaggcggggtggaattccataatgctggcagcagggggcat

SEQ ID NO: 702410 - DNA, 894 bp, Homo sapiens
atcgcgaaggaaccaatgcctgtcgtgagagcacacgacactcatttctcaagtgtagtcactgcttgttccccactagtgcgttaaaaggctggcgaggaatttgcaccaacaccccggttaatatgcgtgcgtcgccttaaaatatgttggccgtatttccgatatgtaccccgccaaacccggttaaatttacgttagcacagatgtgtgtaaccccgtggcacagtttctacccacagagggtagttactctggtcaaaggaactgccccaaaaagatacaatcaactgggccattccccaatatttctcccacctcgtattgccccccttgaccctatgtcttaaaattctcccccccccccttttttttatttagaccgccaatgttaccagcgatacatcaagacagagtgtttgcatgtagccttcccgcaaggcacaactttccccccaccaccccctcgcggagtgcataaattttaaggctcccccccgctctttaaatgagttccggcgtttcactagcagcaaaaatatatagcttctaacaccccaggttgagcgaccatattctttacatattggatcctcatacccccatcccaagacccctgggtttaataaatacattctatgatttttttctaccacccccaatagccacttcttatcaaaaataatgggccaccgaaaccccgaaggacgatatcccttattcgcccctacttatacacctcgtgttcttcacagccaaccattctcccttctgcaattgccaatgttcctgcgacacgccgcaccagctatgctatgcccccttcaccaactaacacgtaacaaaaaacccgcgccttctccccgaaagagttctttcgtaacaaacaaaaca

SEQ ID NO: 702411 - DNA, 346 bp, Homo sapiens
tataggcaggctgaggcatgagaatcatttgaacccgggaggcggaggtagcagataagccgagatcacaccactgcactccagccgtggcgacaaagcgagactctccatctccacaaaaaaaaaaagagttataacccttttctccactaaaaaatattaatttttggctaatttggcacattacaaatatttttttcccctaactacagaaacctcgtggtcctgaaaattccaaggatcaattggaattaccagattaataccagcatgaaacaactagacaactaaaatctatcccaaaacataaacccgagtcgtgtatcataatcccaggcaagccagc

SEQ ID NO: 702412 - DNA, 198 bp, Homo sapiens
gcggttgacgtctgaggactctggcccctgaccactctcccgacgacaatgctccacgcagagcaaaatcttgcaagtcattcgcaagaaacatgttaagaagtgccttgagctcttcgtctgagctggccgcagccagcggagccttacagagaaattctatgaggcattctctacaactctcaagcttggaatcca

SEQ ID NO: 702413 - DNA, 301 bp, Homo sapiens
  misc_feature (58)..(58): n is a, c, g, or t
  misc_feature (71)..(71): n is a, c, g, or t
  misc_feature (112)..(112): n is a, c, g, or t
  misc_feature (132)..(132): n is a, c, g, or t
  misc_feature (157)..(157): n is a, c, g, or t
  misc_feature (203)..(203): n is a, c, g, or t
  misc_feature (257)..(257): n is a, c, g, or t
cccccggccctcccctaatgtaggaagaaataaacaatcccagtttgggagtccctgntcctatgaactgntccttaagcctatatgtttcctcatagcagaatatttcaantcaaagactatttaaatttntttatttaaatttaaatttaaaaantcaaagaatatttacattcaaagattatgctcattagacagtgctnagcgatttgcttttgtgcaattatacttcttgttgagcacatgatctggggatncaacataaaattcaaaactttaataaaactatattctctgtctc

SEQ ID NO: 702414 - DNA, 419 bp, Homo sapiens
gatgccatctaacctgtgatcacagacaggccacctctcaaacgtggagagcctgtacataattacacatattgggtatgaggaaggccaggtagactgggtatgggaatcacagcaaacccatatcagttttcccacagacagttcccaggcaggatggcctggagcccagggaacataggtcccggtactgaattggcctagaaaagccttctgatctagccttatttctgagtcatgattgtcacactcccatgctccaggaagtaacagtactttttttcattttccttgtcccctccctctcttttaatctttgaggactacatctctgcttatggtgtttactaaatatttttgggtttgaattttgaattctaagatgcttataacactgggctcaccgtatcagccttaag

SEQ ID NO: 702415 - DNA, 171 bp, Homo sapiens
ccaatcaacatccaaccccaatcaacatccaccacccacggaatcgagaaagagctatcaatctccaatcaacatccaaccccaatcaacatccaccacccacggaatcgagaaagagctatcaatctgtcaatcctgggttggatgttgtttgggttggatgttgattgg

SEQ ID NO: 702416 - DNA, 597 bp, Homo sapiens
tcaggcttccttctccttcttttcctagccacccaaattttattgtgttattttcaacctaataaaagcaatggggggggctcatgcctgtaatcccagcatttggggaggctgaggcagacagatcactggagctcaggagttcgagaccagccggggcaacagggtgaaaccctgtctctaccaaaaacacaaagaaacttagccgggcaggggggcatgaatccgggtcccagcaactggggaggctggagggctagagcccaggggcccaggtggcagagatccggagatacatgccacttgcactccagcctgtcgcaaccaggagcaagagactcccatcctgcattacaaatcactacaaaaaaaaaatccacaaagagaatcttcaggaggcgggttggggggagagaaagggggaacaaaagaatggggacaaaatgggcgccaccggtggccacggaacacacgttctgtccggcctaccgcggggcaccatcgggggcgagccccccaaagacaacacccaataatcgaatccaaaaaaccccggtgaaccggttaacgtcctccaagctcgcacaacaacaaaac

SEQ ID NO: 702417 - DNA, 307 bp, Homo sapiens
  misc_feature (249)..(249): n is a, c, g, or t
gagccgcgcacattcagcttgtttctcatcgagacagaggacagcattctgttaagtttctgctgctgccatgataacagattttgttgtcacattctggctcccgcaggctgtgccccggacacaaagcaactctgtctttaccctcgtgagcgcagcttgggccataataggacttttctttcatttgtatctatttcttattggaagccttagatcatttattcccttccttacacttctagaggngaaagaaaacccaagtctgcctttgtaaaaccaagctgtggcctcaggagtcagggct

SEQ ID NO: 702418 - DNA, 529 bp, Homo sapiens
accttttaccagtatggccttaacttagtcaagtgtatcgatagctgaatattaattttggcagtcattgtttgatgctgagtgaattctgtatattactcttttgctcccgtgtcataatagctggtcgtgctttgtggatgtgataccttcttgaatgcaatattcacttgaatgcttctgaggctactcattagaatttttaaaagtctctcttttgttcctgaatcacctcttctttcttcaggtcagttgttagtccaaaagatgtcaatgatccctagttatcagtttacatttattaataaagaactaggttgcctaatacaagtagctggtgtgagttatagcactatgttttcttaaccactttatccccaggataacagggcatgatcactggcagacttcacccaaggcctcgggtgggagacaggcagcagggtgagcaggcagtacacttgcctattcctcaactccacaccaaaatgaggagggctaacttggggggtcatcactacagatccat

SEQ ID NO: 702419 - DNA, 156 bp, Homo sapiens
acagcctggtcaatttggacctgcaggcctcctacacctacctctttttggggttttatttcggccgcgatgatgtggctttggaaggggttaacccctttttccgcgaattggccgaggagaagcgcgagggctacgagcgtttcctgaagatgc

SEQ ID NO: 702420 - DNA, 569 bp, Homo sapiens
catcccccgtattatagtgaggagttgagcctaaccttttcatatctagggaaggcatactcaagggggtggggttgtcaatgaataaataatactagcatttaagttgagttcacctgttataatcaaccctagcataagattatgtttgttgcagaatcaatgctaacaggaatctgtacatgtgctgttattatacaatatccaagaagggagaaacctctggcaatctttctaagattttctaaggaaaagagccatttgcaactttagtgaccaatgtatccacagaattcattttcatttagtgacgggacaagcttagacctcttcctccactccccaaatacctgattttaatagcaaaaggcaatcactatatggtttctctagttatgtatataagaaataaggaaaattatttattttggcttctgtgaaactgaggaaacattacattttcttcatggtaatgcacatgtgaagcgattttcctcacaccagattctacttttctgtaattcagcagcacagctcccagaagtttcctgactacaaatgctatgggg

SEQ ID NO: 702421 - DNA, 174 bp, Homo sapiens
gcagcctggcccccaaatgtattcattcttaatttatgtaaggttttttttgtacgcaattctcgattctttgaagagatgccaacaaatttcggtgttctactgttatgtaagaacattaggccccaaaaacacgtcattgtgttttgcggcataaaagtgctgccgtaaaca

SEQ ID NO: 702422 - DNA, 224 bp, Homo sapiens
tgggaggtttagtattttaatataatacagttccaatcaatgtgtctgggtcatttcagttccttcactggcaaaccggggggcaaggactgcttcaatttctctggcttctctttgtcagtgatgaccagggtgtaaagggatctgctgcatcgaactttaaacttcacgttggccttatttttcttgatcttgacagatttggcatcccttctggcggcttc

SEQ ID NO: 702423 - DNA, 1331 bp, Homo sapiens
  misc_feature (435)..(435): n is a, c, g, or t
tatacgcaatgagggcatagctaatgccactgaccgtgtcgcgcgtatcaagagacttctgttgcagtccggtgcatgatctcgcagtgccgggagacgacgaagttgtgaccattacacagcggtgcccatctgctagtgagtcaactttgctgcgctcctcgtgacgcgagactgagtctcataacttggtttgccgtatgcgacaacgcttacgtcatccaggtagcaatcatgcatgctggcatatatgatgcggaataaaagttcgagagaagttccgctcaggaagatgatgctatgacaaactgttgggacttgatgtaacatttcaaagtgattgagaggggagcagtgcgcgtacttggagtcgtgcttttcaagtttggccatatgaggtagtcgcttggttgagtaagatgtgatgaaggacgntcgtgtgtacatcggggaaaataaggaagggtcgccaagtatcctgaataagaaatttaggcatcattagtaatttgtgagtcctttggaacggaaaaggtaaaatacccgtgggggtaattagacgcctttcgcaagcaatatatggtggagcgtactaggaaatttgccatacggcttgtgctaggagattgcaagaatgtggatagcaatgatcgtctaatggactcttggttcgttgagaacgctctcatttgcagcgggtacgaatagcaggggttagtgtgtcagggtacccgaagtgggtcatttgggaatatttcggagctgcggttattagctgaaagtacttaacacggcaaggtaaagaagctatgcgtaacttggtgaagaatgggatagccatgtacaagtcgtggatgaaagatattgagcttagcgtatcaggatcttgggatagtattagtgcagagacgagagcaattagggcagagatggggtttcaagtcaattgggggcagccaggcgtacaaggagggttattaataagggtggcgagtttaaggtactgatcaacgaagtgaagacataagtgctacagccacactgggacatagtacgacgaaggtgaaggacagacaacaagtcgcggagtgctggaactccacgcccgcgtaagagtgttagtgtggcttactgcggacctcacagcagttgattactgacgagtgaaataacgttgaacccaacagtggacggcgcaataactcgtgatcggtccaaacaatgtcactcggtgctcactcgacaccgtacagcatcgagaacgcactaacaaacgaaggctggggaaggtcgaggcgcagacaacagcgccagccggaccatgtcacgtt

SEQ ID NO: 702424 - DNA, 163 bp, Homo sapiens
cacctattgtgcagaagatcacctcatcgggcagaagatcacctatcgggcagaagatcaccttatcgggcagaagatcacctcatcgggcagaagatcacctattgtgcagaagatcacctcatcgggcagaagatcacctatcgggccagaagatcacctt

SEQ ID NO: 702425 - DNA, 821 bp, Homo sapiens
  misc_feature (1)..(2): n is a, c, g, or t
  misc_feature (4)..(4): n is a, c, g, or t
  misc_feature (16)..(16): n is a, c, g, or t
  misc_feature (21)..(21): n is a, c, g, or t
  misc_feature (46)..(47): n is a, c, g, or t
  misc_feature (50)..(51): n is a, c, g, or t
  misc_feature (59)..(59): n is a, c, g, or t
  misc_feature (247)..(247): n is a, c, g, or t
  misc_feature (331)..(331): n is a, c, g, or t
  misc_feature (375)..(375): n is a, c, g, or t
  misc_feature (544)..(544): n is a, c, g, or t
  misc_feature (591)..(591): n is a, c, g, or t
  misc_feature (600)..(600): n is a, c, g, or t
  misc_feature (657)..(657): n is a, c, g, or t
  misc_feature (685)..(685): n is a, c, g, or t
nntnaaaccaaacganccggncccgccccctgccaacacatttaannacnnaaacaaanacgccctccccctcacccaccgccagacaacctatcccccctgtactttttcctacaaaccgaaaggtagcacaccacactactaccacagattatttatcaccacaaccacaaacgaaaggcccgcaccgccacctcgccatttcaccccccccccacctcgggccctgatccagtcggcgtctatnacaccccccgtcgcagcagttgctatgtccgggtctttgccagcgttcgtgcttcttcgtcctaggttgacgtttctataatanataaaaggagatacaagtctagaggggtacgttacgaagttacnttgcgatcacgtccactaccgtctatttcacccttcacatttcgacacacattctctgtccgattttgttcgtgtagagtaaaaggagttataagtgacgtataggatcagtgcataggcgtgacggaacgacatcgacaataacaattactataaatgaatgagaatntctaattatataattacggtaacgatcagtaatcttatatctcttcntctgtagtnttacttctttgaatactgtgtctagaacaataatagtataatatctgtagtcactanccctatcctacgtctccacctccatgtnacttctcgaacatacccactccgtcacccacacacctcctacaactttcactctcctccacatctgtagtctcgcccgcgtacccctcaagcggtccacactccactcaacatagccccgccgcctcagcccctat

SEQ ID NO: 702426 - DNA, 1140 bp, Homo sapiens
  misc_feature (52)..(54): n is a, c, g, or t
  misc_feature (61)..(61): n is a, c, g, or t
  misc_feature (92)..(93): n is a, c, g, or t
  misc_feature (98)..(99): n is a, c, g, or t
  misc_feature (260)..(260): n is a, c, g, or t
  misc_feature (364)..(364): n is a, c, g, or t
  misc_feature (489)..(489): n is a, c, g, or t
  misc_feature (736)..(736): n is a, c, g, or t
  misc_feature (739)..(739): n is a, c, g, or t
  misc_feature (821)..(821): n is a, c, g, or t
  misc_feature (838)..(838): n is a, c, g, or t
ggtgtggcaagaaggtatgggtcatgaacagaaccaaggagctgcgctgctnnnagatgtnaccacttctgtggctgctaccccactcctgnngccgnnccctgaagctcctacatccaagtgtggagcgatgatgactcgtgctagaaagcgagcgaacattcctcgcactaacaggtgtagctgcccaggatggtgagatcctcaagtgtggtgaactactcctgagtgcgcttactgcacgggagagacacagcgtntaatacttactgtgctgacattctgcaccagtaagcacgtacggtgtagccatactgcacgtgaccgctgatatattgcttgcactgggggctccccaggatanagagggaagcaatgcctccctgaccgaaatttatgatatggcacaacaggagtcttcctgcagacgtcgtgaatgacttccgagcgcatagaatacgggcctagaaacatctggatggcgcgaanaaatgcccccgcgtgttcccacgtaggtcgaaacttcgtgcaggcgaatccatggtcacgttccactgttgcgacacgagacttttgggcgccatacctttttctgcttcttcatgcgtagtaccgatcggacccttcacgtcgtatccaagcggctcgttgtttgctataaccttaatacaatcattgctagcacacacacgaaatccgtcgcatagatccattgtctccgttcccatggactatntgntagaacatccatccgcaacatgtgtatgccgcattaacatcacaggcaattctgacccgtaatatgagcgatcaccctcccntgtgagaagcagcgacntggacctcgtcaaggactcgtttgcatgcgcgaagaactggtggctcgatgatgagcgtcgcgcccatattcgaggcatggaaggtggtcggctcggaggacgaatcaattctcggccgggggcaatgttggtgtcgctctactctagtgctaacttctcccgtgggaacgaccatatgtcatcggagtgttgcaacgtgacttcctctgaccaagaaacccaggagggtttgggatcgcccaaggaggctatcggggcgattccaaaacggagaaggaatcgccaacgatctcctcagcat

SEQ ID NO: 702427 - DNA, 113 bp, Homo sapiens
agcgagactagagaggatcccctcacagagtgcgactccatcttaatatatttaataataataataataatacaaccggctgggcacggtggctcacacctgtaatcccagca

SEQ ID NO: 702428 - DNA, 797 bp, Homo sapiens
  misc_feature (52)..(54): n is a, c, g, or t
  misc_feature (61)..(61): n is a, c, g, or t
  misc_feature (92)..(93): n is a, c, g, or t
  misc_feature (98)..(99): n is a, c, g, or t
  misc_feature (292)..(292): n is a, c, g, or t
ggtgtggcaagaaggtatgggtcatgaacagaaccaaggagctgcgctgctnnnagatgtnaccacttctgtggctgctaccccactcctgnngccgnnccctgagagtgtcctactcacatatgtggccatgatgacctgctaaagatcacacattcctgtcactagcgagtgtactgccatggatgggatgtcccagatgtgggactctctgatggcctacgacgagagactcaggctatctctcgttctttcgacttttgcccatgaatcactctgggtgtcctcgccntggcctgagatttgctgactgggactcaggatacagggagatgctcctgtccatttgatctgaccaaaagagttctgcgagtgggatgatccacgcaagataggtgccataatacttgactgggaaaatcccggtgtccagagggtttacctatcgcatgaagtgttcacagctgaagcgccctggagttgggctaggcccaatactttggtacatgtaagtccagtaatcgtcttcaccatcgcgatgcgtgacgagtgaacttggcgagcatcaatgccagtccactgttggaagggatacggggccgtacgttattagtctcagccttgtcggatggagtcaagcttccaggcctatatcttatcttgaaaggttcacaccagagaccttcgtgacattttctcctgctattgtgactcaccgaaatttgatcgctactacagcaacttgcctaatggggtaccccggaacgcactgggcctcagaatctgctgcagactgt

SEQ ID NO: 702429 - DNA, 258 bp, Homo sapiens
  misc_feature (43)..(43): n is a, c, g, or t
agcagcaatacgattttgccaatggaataaaagatttgggggnattcttgcacccccccccttccccaacccttcctcaaaagttgaagggatcccagcccctaggtgggcaaaggcagaccctccccaaagctctttagaaaaaaaacaaattggttccttgaaaccccccttatttatttttggtaagaatgcaagcgtggggccttttggtttttaaagtggggggctcacccaataaatcccttgaatctccca

SEQ ID NO: 702430 - DNA, 887 bp, Homo sapiens
  misc_feature (444)..(444): n is a, c, g, or t
tgggggggggtttcccccttttgggccgggtggttttggattcccggattggggggccggccggctgtgtggccccccaaggtggtggggggaatacacgggcttgtgaaccccacccacacgttggtctgcttggtcacatgtggctttgtggggagcacgaggagttctctcccttctgtgttcgcccgagggtgtggtagtttgccgtggcccaggtactcattgacacctcgctgtggtacatctctcctacttttcgtggggtctgcccaggtgtgatatctctgcgtgtgcccttcgacgccctccgtggaagtacaccggggcggaataaatcagtgtgtgggcgagcacaaatgtagtgcccacaccaaaaccactgtgtgacatctaaatattctttctctctctgaatatcttttgacaagtacagacaagacnaggagagatattttcccccacccagagtgttgtggcgcccagagcggtgtgggtctctctcaaaaacactctcgtgtgggccccctcaaaagtgtgacaacttcgtgccgtgccccctcgtgtgtgtgagaagtgggtcaacaactttgtgagcgagtgtcgcctaccatctcgagagggggcgtctacaaacaaagatgtgcgcttaaagacactctcgtggtgtaaaaacaccgctattaaactatcgcggcgagggtgggtcctgagaaagaggcagttttgagcccccacgagggtgtgcggaaaccttctctggaagttccttggtggaaacacgacagtgtcgcgggaaaaaatatctctccgccctccacaggtgggtgtccaacccaactccaatttcttcgaatggggggcgccccccagaagaaacattaaca

SEQ ID NO: 702431 - DNA, 1540 bp, Homo sapiens
atggcgctctaaggtatatcaatgcaaactgtatgtaaacgaaaggccttcaggatcgcatacaatctattccgacagatctgctattcggacatacttctcagtggctatgcggtgacgtagcgtgccagggagacgagaagccgcgcgatagacgaccagcagacagcttcattgtctcaatgagttttaggccacgtcaacatgcgagacttatgtatcatcgtacgagatcgagtgccaccttacatcattgatcccatagagtggagacctactggttaagcccgctgaagcgcgaatttacactatggcgtctaactgctatatttgctagatgtaccaattatgacaaggaaaagttagggtgtctagcggaccccatgcgcacttgctctagatagtgccacgaggagcaattgcggcccgtagttgaggtcgagcgacgaactgtcctcattggaagagagggtctaccggtttgtggatctcccatagcaggagtatgaaccacgggtgctcgttgcccagtgtggcacttctgggatgatcttcgagcgaaccctgtgaagtttgaaattgccaaagaggtacccgcgggtatatgcattagtaccttatctggtcattacattttcgcttacacgcctggtttatccggaaacagcgcatctaccaagtacgcaaaaagtaaaaggggtcacttcatcgtgtacaaccaatatacggctgaacgcagttatttcctgggaccagtaaaacaacataacaccaaagaaatagtacacagagagatggccataagagaaaaacgggggaccatatggtatttgaagacgcgtggacccaaattgggaacgcgcgcttggttaaggatggggcacatggggtacaaaccagaagaaaacttttggcacgaggggggaaaacgagaccaagggggacaaaggtttaccccaaggagtgacgaaatcacccaaaaacagtgggccaggtaagttacttccggaggggagcccagtataatgccagaaagggcgagagattaaggaaacaggagtggattaggttcacaatatggacacatggatttgaagagagggaattaaaagacaacaaaaaaagagagttggcaacaatgggttgcacagagatgtttggaaacacgcggagtatatagaagttgttagcaaggcacaaatggatagagggggcacttataggttcagacagtaaggtgtggggggtagggaaagacaattgtagagcgagaggttattaactattcacgttttatagaagagttatagctcgaacgtagtggaacggataaaagagttggcagattatattaggcaaggaacataggatacgcccagcgcggactatcggtggtggtgtagttgccgatacataggagatacaagttgatatagattagagtatcagttgttatgcgattgctaatttatttaaagcagtacagattgctaatagttagacagatagacagttaggagagcgccgaaagggaatggat

SEQ ID NO: 702432 - DNA, 502 bp, Homo sapiens
  misc_feature (4)..(4): n is a, c, g, or t
  misc_feature (76)..(76): n is a, c, g, or t
  misc_feature (121)..(121): n is a, c, g, or t
  misc_feature (449)..(449): n is a, c, g, or t
  misc_feature (488)..(488): n is a, c, g, or t
attncgggtttataattcctgcttgagtatggtggttaactcccttgtatttaggaaagatttcagattcatcccntctcccttagttttcctttttaagggtgacccccatctgtgatanaaatatagccttagtgctaaaatccagtgtaacttatacatggccctaaaatgtttcctacaaattagagtttgtcacttattcccatttgtaccctaagagaaaaataggctcagttagaaaaggactcccctggcccaggcgcagtgacttacgcctgtaatctcagcactttgggaggccaaggcgggcagatcacgaggtcaggagttcgagaccatcctggccaacatggtgaaaccccgtctctactaaaaatataaaaattggctgggtgtggtgcaggagcctgtaatcccagctacacaggaggctgaggcacgagaantgcttgagctcaggagatggaggtttcagtgagccgagntcacaccactgcac

SEQ ID NO: 702433 - DNA, 122 bp, Homo sapiens
ggaaccaatcccaacacaactggattctactgaaattaccacatatttgaggtccacaagcacaagtatagatctaatgcaaactgggctcagattagcagatccatgccaaaaaaaaaaaa

SEQ ID NO: 702434 - DNA, 143 bp, Homo sapiens
  misc_feature (66)..(66): n is a, c, g, or t
  misc_feature (139)..(139): n is a, c, g, or t
aacaacctgggcctgtgctgcttctatgcccagcagtacgatatgaccctgacctcggtttgaacngtgccctttccctggctgaaaatgaagaagaggcagtgatgtctggtacaacctgggggcacatagctgtggnaatc

SEQ ID NO: 702435 - DNA, 166 bp, Homo sapiens
aaaaaaaaggggggggggggtttttttaaaaaagccccccccttggggggttttttgggtggggggaaaaagggccccccttgggctccccaaaagggggggggggggggtttcccttggttaaaaaaaaattttttttttttttttttggttgccccccccccca

SEQ ID NO: 702436 - DNA, 171 bp, Homo sapiens
ccacaatgttcttgtgccatcatgacattggggagcattaactgttagatttgtgcttccaaatcactttttggcctctaagaatttcttgaaactcttataacctgccttcaattttgatcctttattccttctatttgtgaggggcacaagaataccttcctgcattag

SEQ ID NO: 702437 - DNA, 195 bp, Homo sapiens
ttttttttggtttcccttttaaggggaaccccctggaggcccacgctccccttgggggggtccgccccccacccccttggccccgttttttttaatttggccccccggggggggggcccaaagcctgggggggggggttaaggccccccccccgcctcccggcaggatccagggccggaaaaaaagggtttttta

SEQ ID NO: 702438 - DNA, 395 bp, Homo sapiens
ctctgtgaaatcatggtacagtcactgcccagaggtactgaggaaaatgtactatgggattggcaaacggtggcggtaaataatcagcagttgttggcaatgcgagctcggcttctgtggcgccactgtgtgaagtgcagctgcagaagaagcaggagcgccaggaacgtttgtttaatgtcactctctgcttccagatgataatatatactagatggcaagaaatgagtcctggagaagtaatgtatgggagagtttaaaaaacacactaaggaaaggatgacaatgtgaaacttgtttcagtgtgtaaggctggagccccttaagagcctactgccccgtggccacatttctctcagaagcagaaacccgaggacgtgccatagagtggtggc

SEQ ID NO: 702439 - DNA, 311 bp, Homo sapiens
gatacgcttgtgccaggtcagcgttagtgcaggcatctcagctctcataccagaatattctctccaacaaaaatgtagggattgcaaacaggatatccatcagctcattgatgcaggccaggcacttcccccaaatcactggctacatgtaggttgccaggaaggggtagtagtcatagagagaggcgactaatattgaacttgatcttgacactgacgccctctcccaggttgttttccgctgcaatctgacccagcagttgcagcagctcaatctgggcagcacgatcagtacccttcttgcctcgtgc

SEQ ID NO: 702440 - DNA, 228 bp, Homo sapiens
tgactctagaggaccctcgcttttgataggaccaacctgcctcttccccctctcttctcgattttagtaaatgccacgccacatatatttgcctaagtcagacacccatcttcaactttcctttttctcatatattcaatcaatcactaagacgtctcagttgtacctattacatgtgtctcaagttcacccaactctctccatcctgaatagcctatcaaaagacga

SEQ ID NO: 702441 - DNA, 240 bp, Homo sapiens
ataacatcgtatatgagtgtatcctggcgtgagctggagctactttgatcctaaagccagtttcaaatgagcaaatcggatgtcatttgccttttatgtaacctttaaatgaaataattttcatggtcaattttcttatttagattattattccaccttaaaaatattttggtttaaaatccaccaagaatatgtattctttaaataaagataatttatgatcatggtataaaaaaaaaa

SEQ ID NO: 702442 - DNA, 542 bp, Homo sapiens
  misc_feature (262)..(262): n is a, c, g, or t
  misc_feature (264)..(264): n is a, c, g, or t
  misc_feature (279)..(279): n is a, c, g, or t
  misc_feature (390)..(390): n is a, c, g, or t
  misc_feature (430)..(430): n is a, c, g, or t
  misc_feature (511)..(511): n is a, c, g, or t
gccactgtttggttatttttgatagtttaagagaattataaatcaagttgttctgtctactagagtcagaaattctgtgctagaatgggacttgaaaattaggtggtcctgtcactttctagagaaagacccaaattcataggtttaagtggcttgtctgacatacacatacagccagttagtaacagaattcagaatagaatagagttcttttttttctgtcagtccgttgttctacttctcccctttgtccccttttttntntcttttccaatgggntctggagcagcttttggcaaaatgtgttccatatagcagtagttccaagagatgttaatagatgtaagaaaaaaagtcgtgagtgatgttggaggagtgcggaggaattcngcatggtcaattaaaatgaaggaatgctgagtttgtttcncttacttggctaaaggggaacttctaagagttttgaacatgctattacacattgtgaatttataaaaggggacaaacactngtttggacccttagactgcactccccttctt

SEQ ID NO: 702443 - DNA, 442 bp, Homo sapiens
  misc_feature (171)..(171): n is a, c, g, or t
  misc_feature (175)..(175): n is a, c, g, or t
  misc_feature (209)..(209): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (433)..(433): n is a, c, g, or t
ctgatggtgcaaaaacagcaggaggcactttaggagcaggcggctttggagcctaagctggacctgctactggagaagaccaaggagctgcaaaagctgattgaagctgacatttccaaaaggtacagcgggggccctgtgaacctgatgggaacctttttgtgacacccnccgngtttttgccggcccattttttccgcttttgggangaaaatnananccagggctgttgttttggggcccttcaaggcaaaagaccaggctgtctggaaaatggaaagccccaggaaggaagcggcccctgatggtgattttggccctctccatgttttttacaaaaagctgtggggattggccctgtggtctatcaggcgaaaaccccaaattttccttttagttagtaaagcgggcttaataaaaaaggaaaaaactnttgcttcca

SEQ ID NO: 702444 - DNA, 899 bp, Homo sapiens
atagaaaccggtctgaacgtatcctgcccgcgcatcatcctagttcctcatcggcctcccatccctacgacatcctttacataacagacgaggatcaacgatcccgtcccttaccatcatacattcaatgggccaccacatggtactgaagcctatcgagtacaccagacatagcggtcggactaatcttcaacgtcctacagtacgttccccccaggcctgtgtggggggacatgacctgccttgagaaggggcaccacataccccgtcactgccacggtggccccggtaagggaagctcgtaggcctgggactttccccgcgtggccccagaggatgaggtcatttgtgaactcagatacgtgattcggtctggcccctcggcctcggcgggttcttcggcggcggtaggtcgagcccctggagtgccccacctgtgggcgctcctactagtgtgcacccagcggatggccccgggtgctgtcctgcctgcactgctgtgtgtgagtcgtgcctgcggatgtctctacgagtcctgctcctaggtagcaagttcatctcctggccctacctgccggcgtgagattgtgctcttcagcgagtactggcctggtcgcgtctgggctgtccaacacgtggcatcctgagccgcctgcccggctgaggcgctgaacggcaccatccggggtcagtggggggctgagcccgaagggaggtggtaccaagacccccggcggacgtggttgggccggtttacctgcccgttgtggaccacttgtcgggctggcctctgggttcgcctgcgttgccgcgatgccggtgactcgcccgtttttgggaccggcgcctgggggggactctttccaggttgccccccggtttttctcctttcctaactg

SEQ ID NO: 702445 - DNA, 1036 bp, Homo sapiens
ggagagaggtcagttcggttcagagcgactcagcccctcgactcgggtcttaaaacctccgagccgccagttctgcctcagtgccgctgccccctataaagctgccacgcagactgctgcggcccctgttaaatgctgcctaccagactgcctgctgcccctgtccctgtgcctccccctgctgctgcgtggctgctggtgtgctttcttggtgccagggctgggtgcctgtgctgaacttgctgtgccctgtgaactggcttgagtgaagtggccctgtccctgcacttcccctggctgctgccactggatgcccctgggctgtgttgcatgaatgcctgtgtgagacgtggtgcaggacggatcgtgacttattggacacgctctgacgtgtcattacagaccagtgatgcactctccatgagctttcaccgttctgattgattgccgcagacagtgagtgacccgtgaatgagaactcgagcgagagcatgcattgtgtcttcctgtaccatgagacacaaggagcttagcacagaccattccctaccagttgatcatcatgtgcttgcaagagttgtcacgatatcacttgtcgccgtggaaccgcagactggacttgtgaccctgttcacctaggcccgcctagacagcctgcgaggccacgtatgagctcatcacagcgccaattgcgggcatgaagtcccccgagggttccatctttactgtcccatgcaaggtatgaccattgtgcgaagactaatggcagcagcacgctctccatcgagacgcctgaactcgggaaccctgtactgactgatggcagcttctttctgactcccacattcaggaactggttgctggcttccaaggaggactatcctttgggggtggaaaccgtgggggaaagccacagtccactgggaatccacgaacacggcccccactttctccatcctacgaaaacccgttctcattgaagtcgcagtactgtccatgaatttgccttctggatccagattacttcatcatcctg

SEQ ID NO: 702446 - DNA, 335 bp, Homo sapiens
  misc_feature (138)..(139): n is a, c, g, or t
  misc_feature (294)..(294): n is a, c, g, or t
gtgtctagagatccacgtaatgtacatcatgtactttagaaccaatgaatacactataaaatagtatattccagcaaataatgatagagacatctggagtatttatacatattataaattatgaatgctatcatttgnngggggaagatttggcaggaaatgagactgaagctgtcatatagttttggctagattgtagttataggatatcgttagactttatttatccatgtactctcttatctgttattagggtaacttaagatttgaccaggatttgtttttggatttttngggagcgatgggaaacgttctgcatcttgattgtggtgatg

SEQ ID NO: 702447 - DNA, 150 bp, Homo sapiens
agaaaacgcaatcatcaggcaaaagcgaggcttgagtgaccactatgaggcagaagatgggcgtaagagacaatcctgagacagggctggtgtagagagggcccaaaagaggccagtattgggcagtggccgcgcccctcagggcctacg

SEQ ID NO: 702448 - DNA, 105 bp, Homo sapiens
ttttttacaccaaggattttttaaattaagaagatgggcaaagcaggctttcttttcagaatcaaaatgcagaacaaatcggaaaaattatggtattaacctccc

SEQ ID NO: 702449 - DNA, 130 bp, Homo sapiens
tttcttgtcgaggcactccatcgtatccgtaacagaatcggccatgtcgcccatcgcgatgaggagcgcacccttgtttttgagaatgccgccgaagtgtttgcaggcgccgttcttcgggtcggctttc

SEQ ID NO: 702450 - DNA, 182 bp, Homo sapiens
aggatacctgtaactatatatatatataatgtgtgtagtatgtgtgcacgtgtatgtgtgtataacgtgtagatagctcccttccccaaagatcagctgtttcctatactcatctgtattagtgtcaacaaacggctacagatacatatttctatatgggtagtccagtgggtagtcacaga

SEQ ID NO: 702451 - DNA, 163 bp, Homo sapiens
  misc_feature (10)..(10): n is a, c, g, or t
  misc_feature (44)..(44): n is a, c, g, or t
actctgtttnaaaaaaaacaaacaggaagtgaattattggccangtgaggtggcacgcttacagtcctagcactctgggaggccaagacaggtagattgcttaagcccaggagtttgagaccagcctgcccaacatagcaaaaccctgtctctactaacatta

SEQ ID NO: 702452 - DNA, 560 bp, Homo sapiens
cagtcttgggaggcagagatggaaggattgcttgatcccaggagtttgagaccagcctgaggcaacataaggagacgccccgtctctacaaaaatatacaacaaatcaaaaaggcatgggattgatggtacacatttttgtcccagctacatcaggaggcatgacgcttgggaggatcacgttgagtccaggagggcgacggctgcagtgaaccgtgatcaccatcactgtactccagcctgggtgacagagtgagaccctatctctaaaaataaaggccgggcacagtggctcatgtctgttatcaccagtcacttgggatggtctgatggagaggtggatcatgaggatcgttagacgcggctacgacttacacgtagacacactgtatatacagatacgactttaggtacactagtagaactctgagatccatagtttgtacaatagacaggcgttgtagacgacggacagacctataccggtcacagtaggggctagtcgcaaactcgcacgaacatgtgctctgagcttagtatcataactggcagtaaaatctc

SEQ ID NO: 702453 - DNA, 622 bp, Homo sapiens
  misc_feature (522)..(522): n is a, c, g, or t
  misc_feature (547)..(547): n is a, c, g, or t
atttgagcgactcttctaagatgaacattcgcaacatcaaactaggtacaaggtctcggaaggggccctgcttattaagctgtcttagcgtcacaatacgtccggatctgctggcgcttgctgacgctccagtgagggaatcttaggctaatacgattggaagagcgagctgttagggcagagcatgaccttcaccatagcctctcttatctcacatatggatgaacatgaggctccgagtcagcgcatgatcattgcatacctcacaagcgtgaatgtctgggtatcggccaacctatgactctggagggtggagacatgctagtatatcattgaggcaggaggctgtaccctaggcattctgagagggcttactctacagctgtgtgtcagagagcctaatgcttttcagcatcggtaggacactagacggctagtggtctctgcctgagctggcgccatagtgcaagcaggatgcctgctggacgtgtgccgtgctgaatgtgtcgtgattggcgtgtntttgcatgagatgcacgtaggcttncgtgcgtacaagtgggtgtaagactttgcgacttgcctacgtatgccaccatttcatgcgaccctgtctgccggc

SEQ ID NO: 702454 - DNA, 478 bp, Homo sapiens
cccgtagcacttccttacattcaaagagaataaaatacctaggaatccaatttacaagagaggtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagatactaaggactttcttcacagaattggaaaaaactactttaaagttcatatggaaccaaaacagagcccgtattgccaagtcaatcctaagccaaaagaacaaagctggaggcatcacactacctgacttcaaacaatactacaaggctacagtaaccaaaacagcatggtactggtaccaaaacagagatatagaccaatggaacagaacagagccctcagagtacaggaaggttggtacaggaagagg

SEQ ID NO: 702455 - DNA, 492 bp, Homo sapiens
tagaggatcccactggatgttataggcaaaggtgttgtaattacatgatgtcaaataggacgtaatagcataaggtcctggaagacaaaggtgttgtagattacctgatgtccaaataggaggtaatagaatacggtcctgaaagagagggctgtaaattacctgatgtcaaaataggaggtactagaataaggtcctggaggacagggctgtagattacctgatgtccaaataggaggtaatatcatacggttgctggaagagagagggcttaagataacctgatgtccaaataggaggtactatcgtacctgtgctgtaagagagagggctgtagattacctgatgtccaaataggatggacatagcataaggtcctggaagacaaaggtgttgtagattacgtgatgtccaaataggatgtaatagcatccggtcttggaagagaaaggtgtagcacatcacctgatatcccaataggcaggtactaga

SEQ ID NO: 702456 - DNA, 194 bp, Homo sapiens
atccagggactcgtccgtgccgcgcagagactccaggtcgcacgtcaaggactgcaactggcgccggtagtcgtcggcttcgtgcttggcctggcggagcagctccgcgcttgcgggccgcagcgtctgtcaggtctgcaccccttggagcggcacccctcttcggcttcatgcatgttgctggacgccattgc

SEQ ID NO: 702457 - DNA, 107 bp, Homo sapiens
ctgcaggtgactcatacaggatcccggcgtgcgctggcacttacgcctggatcacttcgctttggtctctcctcgcaaagtaatttctatttcattcattatgcaaa

SEQ ID NO: 702458 - DNA, 431 bp, Homo sapiens
cacgagtcggagtttgataccagcctgggcaacatggtgaaaccccgtctttgcaaaaaatacaaaaaattagccaggcacagtggcacctgcctgtagtcccagccactcgggaggctgaggtgggagaattgcttacacctggaaggcggaggttgcagtgagcgagatcatgacactgcactccagcctaggtaacagagacagaccttgtctcaaaacaaaaaagcaataaaagatctagctaagataattaaagaaaatggctataataaacagatttttcagtgtagatgaaacagccttctattggaagaagatgtcatctagaactttgatagctagagagaagtcagtgcctggctgactcttgttaggggccaatgcagctgacaactttacgttgaagccagtgcccatttaccattctg

SEQ ID NO: 702459 - DNA, 360 bp, Homo sapiens
tttttttttttgagacacaggtttactgtttcccaggctggagttcagtggcacaatctcagctcactccaacctctgcctcccaggttcaggcgattctcacgcctcagcctcctgagtagctgggattacaggcgtgtgccaccatgcctggttaattttttgtgtgttattagtaaagatggggttttgatatgttgttcaggccggtcttgaactcctgacctcagttgatctgcctgcctcggcctcctgaagtgctgggattacaggtgtgagccactgcgcccagcctccaattgcaaagatgtattaagaggtggaaccttttggaacttattaggtcatgaggcgtcgacg

SEQ ID NO: 702460 - DNA, 341 bp, Homo sapiens
agcgaaaggttctctctccaggctggacttaataactttgaagctgtccaccggtgtcacgtcctgaacatgagcctcctcctctccttctacctgctggggttgcttgtcagtagcgggcaaggtaggagtgtggcgctttattgcatttactttccctcccccttccacccggccaagagaggcaaagagggaggcgcaggaagaatgaaatgaaagaactaaagttacagttattgctgttgttgttattattattttcgttctttctcctagctgtccctaaaattgtatctgttgtgtggagacccttaaataagagaagggaaaatacagaattg

SEQ ID NO: 702461 - DNA, 871 bp, Homo sapiens
ggcggcgccggctggacgctgtagtggcttcgtctcggtttctcttccttcgtaacgcctcccggtctcgtaagcctcccgccggccgtctccttaacgccgaacaccatgccttcaataagtgcagagtctgatggagagatattgagttgatgtggaattgccaaacactctgtgactattaagaccatgtgggaagattcgggactggctgatgacggagatgatgacccagttcctctaccaaatgtgattgccgcattattaaaaaaatggtctttcagtggtgcacccaccaaaggatgaccctcctcctcctgaggatgatgagaacaaagaaaagcgaacagatgaatatcccctgttgtgggaccaagatttcctgaaagtttgaccaaggaaccactttttgtgaactcattcctggctgcaaactacttagacatcaagaggtttggttgatggtactgcaagacttgttgcaatatgatcaagggggaacactcctgaggagattcgcaagaccttcaatatcaaaaatgatttacctgaagaggaggaagccatgtacgcaaaggaaaccagtgttgttgcagagcagttgcaatgtgtgcctgaacactgtacactgttcgctgttcaatactaagtgcctgctctgtttatgtattttgaccaccgtcgacaatgcgcgcagtcatgtttagcgaatatgtctctgctttgtgtttgggcgatccacttgcgagttttaatggaaggtttttgtgcacaaggaggggtctttaaaaaaaaaaaatgtggcggccgaaaatgggcggagatatgtcattttttctaccgaatgactacaataaccaaaaaaaaatgg

SEQ ID NO: 702462 - DNA, 703 bp, Homo sapiens
  misc_feature (603)..(603): n is a, c, g, or t
  misc_feature (647)..(647): n is a, c, g, or t
  misc_feature (685)..(685): n is a, c, g, or t
acaggtggatcacttgagcccaggagtacaagaccagcttggggaacagacgaagctctgtctctacaaaaaataaaaaaattagccagacatggtggtgtgtgcctgtagtcctagctgtttggggggttgaggtgagaggattgcttgagcctgggaggttgaggctgcaataagccatgatcacgcccctgtacttcagcctgggtgacagagtgaccccttgtctcaaaagaaaaaaaaaaagataaaagaaaaacttaaaagagagcaagtaagaaacaagaatacagttaaatacttagaaaggcatctttgaaaaaaaggaaaattaaatattgttttgaaaacctggtttaagtttagatggatagaaaaaaataaaggaaaaaaagataaaatagctcttatatgtaaaatctcataaaagctcttatacatgacaaattgtcaaaataaaatgagagactacagtctggtatgataatatttatgggcaacataatagactgagatatgtatccaatatataaacagtttacttttatttcttgtttggaatatatttcattcttgttttttttttttttttttttttttggngaacagtcttgctctgttgcccagggcagaggttgcagtgagcngagattgtgccattgcctccagcctgggtgacagagcnagattctgtctaaaaaaa

SEQ ID NO: 702463 - DNA, 233 bp, Homo sapiens
cggcacgagaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggta

SEQ ID NO: 702464 - DNA, 261 bp, Homo sapiens
cgtagtaatcaccgataatactgatggagggcagctacacaaagtgtactggccagggtacatccccgccgagatgctacaccttcttcattgacatcctgctcgacactatcaggcatgagatcgctgggtgcatcgagaaggcctacgagaaaatccttttcactgaggccacccggatcctcttcttcaacacacccaaaaagatgacagactacgccaagaagcgagggtgggtcctgggccccaacaactactaca

SEQ ID NO: 702465 - DNA, 1151 bp, Homo sapiens
  misc_feature (472)..(472): n is a, c, g, or t
gactccatttcgtggacgccgtgtgagtgtgagagttggttggtgttggcgccggagtgagagcgtggaagactgtatcgtgtagcctgtgtgtgattctcgaatgcctgtcgcatttgtgttcacaccgctagtatcgtctggataatgtccgatcgtgtattccatgtcccattgggacatgttaaggtttattgttaggctaatctttggtaaacgaatggtcaacatagacgtgaagttggaatctgggcctttttggtataacgtactagagacacagctacgcgaaaaggtggtggatgtgagatatggcataagaaagagtctcaggctcgaggatttatggcctttatctcgttttgatactttgtggagaagtatcctctcgatgaattgcaagttgcatttgtcatgttgccgatggaggctatgatttgggacacgaatccaactaatgttggcgtcctgncccgttggtaagggacgtttgcgtataccctggtgttctggatattggcgcttgagataaagactgatacgtaggacatactctggtggggcgcccactcgtcacacatactatgtggggggtacggtccggcgcccctccgactgactgactttattcggtgatgagaggcggaggggtcccctgcgcattgcgttcgtgtcggccaaggaattcgtgcacgggtaaacgtggatgaaagtccatttgcgtcttcgtgcacggtgcccggtaggcacgtgttacccctgtttgtacttgagaatgatttagggacgaaaccgacgaggaagactcgccctgttcttcgggagaagcaacgcaaatcaccaaagggcgcaggatcaccctgaaaatcacttttcttccgataagggttccttcgataaggatcctgatatcgtgagggtgctaaaacttggattaaggggaaacattgaagtaaggagaacaggtttgggtggcacgtaaggaaaagtttgggttggtaccaggggagacagatttaccttttcttgtttgggaaccaccggaaggtaattgttaccaagaataaggatttcagaaggttttgtggttttggaacacaccctttctcagttaatgccttttgggatgccatttttttcaaggaatggtg

SEQ ID NO: 702466 - DNA, 162 bp, Homo sapiens
ccccatctctattaaaaaaaaaaaaaaaaaaagcccaggcaaggtggcaggtggctgtaatcccacctacttaagaatcgtttgaacccaggagatggagattgcagtgagccaagatcacgccattgcattccagcctgggtgacagagtgagactgtctc

SEQ ID NO: 702467 - DNA, 813 bp, Homo sapiens
  misc_feature (11)..(11): n is a, c, g, or t
  misc_feature (64)..(64): n is a, c, g, or t
  misc_feature (100)..(100): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (115)..(115): n is a, c, g, or t
  misc_feature (122)..(122): n is a, c, g, or t
  misc_feature (131)..(131): n is a, c, g, or t
  misc_feature (152)..(152): n is a, c, g, or t
  misc_feature (216)..(216): n is a, c, g, or t
  misc_feature (230)..(230): n is a, c, g, or t
  misc_feature (238)..(238): n is a, c, g, or t
  misc_feature (271)..(271): n is a, c, g, or t
  misc_feature (298)..(298): n is a, c, g, or t
  misc_feature (345)..(347): n is a, c, g, or t
  misc_feature (368)..(368): n is a, c, g, or t
  misc_feature (402)..(402): n is a, c, g, or t
  misc_feature (411)..(411): n is a, c, g, or t
  misc_feature (431)..(431): n is a, c, g, or t
  misc_feature (458)..(458): n is a, c, g, or t
  misc_feature (484)..(484): n is a, c, g, or t
  misc_feature (496)..(496): n is a, c, g, or t
  misc_feature (514)..(514): n is a, c, g, or t
  misc_feature (527)..(528): n is a, c, g, or t
  misc_feature (532)..(532): n is a, c, g, or t
  misc_feature (559)..(559): n is a, c, g, or t
  misc_feature (562)..(562): n is a, c, g, or t
  misc_feature (571)..(571): n is a, c, g, or t
  misc_feature (574)..(574): n is a, c, g, or t
  misc_feature (587)..(587): n is a, c, g, or t
  misc_feature (589)..(590): n is a, c, g, or t
  misc_feature (594)..(594): n is a, c, g, or t
  misc_feature (599)..(599): n is a, c, g, or t
  misc_feature (622)..(622): n is a, c, g, or t
  misc_feature (625)..(625): n is a, c, g, or t
  misc_feature (634)..(634): n is a, c, g, or t
  misc_feature (637)..(637): n is a, c, g, or t
  misc_feature (668)..(668): n is a, c, g, or t
  misc_feature (725)..(725): n is a, c, g, or t
taatgcctcancatcccaagtagctggaattataggtagtgcacatctcacctgattaattttnatatttttagccgagatggggtttcaccatgttggnccgnccngcntcggnctcctgncctcaagtnatccgcccgccttggcctccnaaagtgttggggttacaggggtgaaccaccgtgcccggctaacattttataactttgacttgcnaaagtatgcgatgnggtcagtngccttcaccccagattttaacactttggggaanggggctttgtggtcttccatgaaaaanacaaaactaaagataaggttggggagatgacaatgtagtgggaaaannnggggaaaatgaaacacctggntctagaacctggaagtgtctcttagggtattttnatttatgcncacttggggcttccaatgcntccggagggcttgagaaatactttttnttgctggtgtgagctgactgggtatnattattggggtnacggatacgaatgatgtntacatataaatgnngagnggactggaaagattcctatcaagctgngtnaaaagaggngtntactgggtggggngnngggnagggnctttgttttcttctaatacaggngtnccaattgcntgnggtgaatgtgggcggtgtgggtcgaggagcnacactcttggctatgggacctcttcatctgtctgcatccctgctgccctcgtgccancgggattggccagcataataggcaaaccataaagccatgtgatctttgtagttcctccattaactaaatttctatgattatcttacag

SEQ ID NO: 702468 - DNA, 742 bp, Homo sapiens
  misc_feature (9)..(9): n is a, c, g, or t
  misc_feature (100)..(100): n is a, c, g, or t
  misc_feature (124)..(124): n is a, c, g, or t
  misc_feature (169)..(169): n is a, c, g, or t
  misc_feature (178)..(178): n is a, c, g, or t
  misc_feature (235)..(235): n is a, c, g, or t
  misc_feature (271)..(271): n is a, c, g, or t
  misc_feature (282)..(282): n is a, c, g, or t
  misc_feature (322)..(323): n is a, c, g, or t
  misc_feature (333)..(333): n is a, c, g, or t
  misc_feature (380)..(380): n is a, c, g, or t
  misc_feature (402)..(403): n is a, c, g, or t
  misc_feature (410)..(410): n is a, c, g, or t
  misc_feature (436)..(436): n is a, c, g, or t
  misc_feature (467)..(467): n is a, c, g, or t
  misc_feature (554)..(554): n is a, c, g, or t
  misc_feature (578)..(578): n is a, c, g, or t
  misc_feature (581)..(581): n is a, c, g, or t
  misc_feature (590)..(590): n is a, c, g, or t
  misc_feature (622)..(622): n is a, c, g, or t
  misc_feature (655)..(655): n is a, c, g, or t
  misc_feature (658)..(659): n is a, c, g, or t
  misc_feature (670)..(670): n is a, c, g, or t
  misc_feature (732)..(732): n is a, c, g, or t
caagatcgngtcaatgtactccaggctgggcgaaaaggggagattttgtgttaaaacaaaataaaaggaaaagaagagaaaagaaaaagaaatggaggtnccttgaaattgaaatttgttaggnccaacaagctaacgacagatgaatttgcggggtcctgcgagaganacaccagcnccgccgccacagcacagggttctggaggtggaggtgttttgggggttttgggggggngctgggaagagagggggcccgggtagttttgttgtnagggggttggnggaggggggggcttttttagttcagtgctgccgccgtcgnncgggaacgcnaggtttactccagctggggaaggttggaattttttagattggggatntgtttgttgttgcttcgagatnntggtggntttggggtaggtgttgtgttgtgatngtgagtttttagttttgggatatgttggtgnttggtgtttgtgattggttgtggttggtgggttgttaaggtttttttttttttggtgttattatagtgttgttatttgtttctggantgtgagatttttgagggttttggnttntgtgatttncgtgccacatgtgccgtgacagcaaaaacgcncgctccgcgccgctggtgaaagagctaaagaangcnnggtgctgcganagtgaacacgggaatagaagggctcggatggagaatggggaggccagagcaagcaggaaaangttttgtttg

SEQ ID NO: 702469 - DNA, 527 bp, Homo sapiens
  misc_feature (2)..(3): n is a, c, g, or t
  misc_feature (487)..(487): n is a, c, g, or t
tnnaaggggcgagggggggcgcggatattccgaagatgcgcgagggatgtgatctcctccatacgggactttctcatctacgggggcctcctgcgaggcagggaggggctcccgggcgtggggcgtggagaccaggggggaggtcaccggcgggcaccccttaactctaagggggcatgggggccttcgaactggggtgagcgctccatttatcttaaagaaattggacagcgtatgaaggcaggacatcacatatgaatgcgcgatatgaagaggctgggtacaggttcgactcctctctggaagggaataggcccagaaggggggaagggactctttggagggacataaaattctggttggtaagaacaaggttggctctgggaactggccttcaaaggtaaaatatctgggacggttggcctctggacatactgggataagtggaaataatggcaaactccggtttctagcagggttaaggggnctgggtctgaaagggcactggcttggcaggcatttctggt

SEQ ID NO: 702470 - DNA, 180 bp, Homo sapiens
tggggtctcaccatgaggcaggatggtctgggatctcttgaccttgtgatccacccacctctgcctcccaagagtgctaggataacagggcgtagagccaccggtgcttggccagtcggcctggctaattttggtatttttttggtaagagacagggtttcccgatgttaccacaggctg

SEQ ID NO: 702471 - DNA, 596 bp, Homo sapiens
tcatttgagacggagtttcactcttgccgcccaggctggagtgcaatggtgcggtctaggttcactgcaacctccgcctcccaggttcaagctattttcctgcctcaacctcccaagtagctgggattaccggcatgtgtcaccaagcccagctaattttggtatttttagtagagacagggtttctccatgttggtctggctggtctcgaactcctgacctcaggtgatccgcctgcctcagcctcccaaagcgctgggatgagccaccatgcccagcctaaactttattttctcaggccttcttctaaatattacatgttactctataaaagtctcacctttttaaaagacctatttcaacgtatctaacagcttttatgcaagaatgaagaaaggtttctttggtcttctcagatgtgctgccatgcaggtggctgatgctgatcaactcccttattagctccaggggataatctccaggctcttttggattatccatgtagttatgtcatctgccgataatgacaatggacacttccacacttttattgccttggaaatccttgggcgtgacctggactgatgagtagaggg

SEQ ID NO: 702472 - DNA, 93 bp, Homo sapiens
gaactgaggcgcactacggccattgccttggacaagactcttgccacaaggcagggcgggtctgtgtcccatgtgtcctctcagtcccctcag

SEQ ID NO: 702473 - DNA, 241 bp, Homo sapiens
ctgcactgacatgtcatgcacccaagtttgaagctatttaagtttaaatgacacaatgcattacttcaggtaaatggaaaacaaagaaaactctgatctcaaaaaaaaaaaaaaaaaaaagatttctgttccctaaattcatccacttggtttcctcgcatggtaaatttcctctctatttggttctgacaaacccaggttcaggggcctgtgggaagacttttgaccagcgggcggggaa

SEQ ID NO: 702474 - DNA, 595 bp, Homo sapiens
tcgagctggtaccggactgagatgtctgagtggagatggaatctgctctctgagagagttggaatcattggtttgaaatgtgatgaaatcactcaatgcaatgaaggtgggtgtgtatggtggggagtactttgccataatattttaaaacattacctggttagagtacataagtggtacttattgttgtaaggtaaggggaaagcctgaataaaaacagaaatggacacataatatgcatattccatagtactcagggaggctggaatgtgcctggaattcgggtctaagtgtatagcgtattcttaccctacactaaagaatgtggcttgtccgtgctccttttggtgagtgactaacaacgtctgggcttccctgtgtgcgtgctgacagcaaaggcacgcagagggctgtgcaaacggtgtgagcagggatcacggtgcaatctggaggatacatcttggcttgcaaactgcctctgtctcctgggtgggactgttctgtccttgcactgctgttctgtgttacctcttggggtgtaacggttttgcttacaggagacaaactttgggcgtagaatggaagccactgcagc

SEQ ID NO: 702475 - DNA, 419 bp, Homo sapiens
  misc_feature (24)..(24): n is a, c, g, or t
  misc_feature (41)..(41): n is a, c, g, or t
  misc_feature (59)..(59): n is a, c, g, or t
  misc_feature (144)..(144): n is a, c, g, or t
  misc_feature (169)..(169): n is a, c, g, or t
  misc_feature (195)..(195): n is a, c, g, or t
  misc_feature (220)..(220): n is a, c, g, or t
  misc_feature (345)..(345): n is a, c, g, or t
  misc_feature (409)..(409): n is a, c, g, or t
  misc_feature (419)..(419): n is a, c, g, or t
tccttcgggagagacgcagggtgnggcggcctgacatcagnatggcttcctgtcaggcngagcatggcccatcaacagccccgggcccatgtccccttcggcaatgaaggggactcccagtactacccctcctactccggcagntccggcggagagcggcagacggcancatagacacgcagcccaagaaggtcnggaaggtcccgccgggtcttcatcntcggtgtaccacccagctcaggtgaggactacggcagggatgcaccgcctacccgtccgccaagacccccagcagacctatcccgccccttctacgtggcagatggagctgacccctcagctgantctggagttccccgggcaggagggttcgggccatgctgggtgggggctcatcccgctgccctcngcccgtaggn

SEQ ID NO: 702476 - DNA, 113 bp, Homo sapiens
gctggtaccatctgggggcagagggagcagagctaatggggggaagtgaaagcagccatcttctctgcagctaagccaggcaaggcactagagacccacatcttcccatgcca

SEQ ID NO: 702477 - DNA, 838 bp, Homo sapiens
  misc_feature (465)..(465): n is a, c, g, or t
ggtggttcgcaatacatctcactcgccgactgaaatgaggtccgtgatgtgatctacggttcagttcccagactccatgagccaaacgcgattgaggtcgtcggacactgacttggtacaacgactgatcccctgcctcatgtgttgagggcgtctcatcgacatcctgaaggatgctggcttccttgtattgatctggttgaccctggcaggatgtccacatcgtggcctgccctgttgcttgtggtccttgtgcagtggtctcaccctccacgcggtcacctattggcatgcctgcatggttcagtatggagagcgtctagcgatgggtgacctcagtggtcgaatactgaggagctcccagagagcagtagcccgtgtacacgtggtgcctagcagggccccctggctgagtacgcgatcatgagtactcgtgtatgcgcgagcgagacgagcagcttcgcncagctgcggcacataacgcgtcatgcagagccagcgtcaggcccgttagtggctacatctcacctggtgtggatgactatgtatctcaattaaatagccaagtgacttatttctgcaaaccttcagcccccttgtctgggactgagagtgccttccttttctcactcaggaaatcacagcactgagagcctatgagttgcaggttcggggtgagggcactggcgtgctgggctcattatccctgcccctctcagagctcctcgtggctgaccagctctgcttggaccgctggtttaccgctcagcagtggtcaggggccggtgctactgagagcacagctatgggatcctggtgtcccagcactcgggagtgg

SEQ ID NO: 702478 - DNA, 364 bp, Homo sapiens
atagaccagacaatagccatgatactgtatcctaaccaaccctctgtgggactgcttcctacactacgacagtgacgacggcttggagacggccgggtacttagcagacatactgactctcgaggaatgctaaggacgggcaagagacaaccgattcctatacggcctgggctctcacggcccactagctagactgactgtagtgcaaggagttctagaacatcaagagggcagggagcgcagagagattgctacttgtagcaagaggcagtcaactctagcggctgaatcatgagcctgaatcaagccttgaataaccttagcttgcccgtgacactgccacattcctatagagtcagttgct

SEQ ID NO: 702479 - DNA, 643 bp, Homo sapiens
gggagatccaggagtctggacaaggaggacgtagatgcctgcgataagtatcaaggatggccctgctgggaccggtggcctgtttccgcagagccccgaacgatctgccaatggtcgtggttgactggactgtagccctgggtgtgctagactcaggactccggagaccctcatggaagctggacctgacgggcgacctggagagcttcaagaagcaagtcgttctgtgctgataggagggtgtggagtaccggatatagatctctttccgggttagccgagagatagtgtccggcgatgaattacatccagtcatacgtacaggaaaggcgtcaagattgacaagatctgactacatggtaggcgagctacagcatctaagtcccgcttcacagactgacgagaagaccgaccacctgtcctgggagtggaatctcaccatcaatgatacggactggaaggtactgtagtcccagccagagtgcgggacatggtcagactgacggacggacgagcggacaggcggattgttgtccccgctgagaagattcggtatccaaagtggaaaaatgacaattgatgacctggtagataatgaaatgaccaaagagaagacctcttgtaaaaggatgcttggacagac

SEQ ID NO: 702480 - DNA, 323 bp, Homo sapiens
ttctaccgccagctgctgttgacagctgacgaccgtgtgaacccctgcatggggggtgtgatcctgttccatgagacactctaccaaaaggcggatgatgggcgtcccttcccccaagttatcaaattcaagggcggtgtggggggcatcaaggtcgacaagggcgcggtccccatgtcaggacaaatggcgagactaccacccaagggtaggatgggctgtctgagcgctgcgcccagtacaagaaggacggtgctgacttgcccaagtggcgttgtgtgctgaacattggggaacacacgccctcagccgtcgacatcatg

SEQ ID NO: 702481 - DNA, 789 bp, Homo sapiens
  misc_feature (15)..(15): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (90)..(90): n is a, c, g, or t
  misc_feature (137)..(137): n is a, c, g, or t
  misc_feature (143)..(143): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (189)..(189): n is a, c, g, or t
  misc_feature (191)..(191): n is a, c, g, or t
  misc_feature (199)..(199): n is a, c, g, or t
  misc_feature (214)..(214): n is a, c, g, or t
  misc_feature (221)..(221): n is a, c, g, or t
  misc_feature (246)..(246): n is a, c, g, or t
  misc_feature (262)..(262): n is a, c, g, or t
  misc_feature (271)..(271): n is a, c, g, or t
  misc_feature (286)..(286): n is a, c, g, or t
  misc_feature (288)..(290): n is a, c, g, or t
  misc_feature (317)..(317): n is a, c, g, or t
  misc_feature (330)..(330): n is a, c, g, or t
  misc_feature (367)..(367): n is a, c, g, or t
  misc_feature (376)..(376): n is a, c, g, or t
  misc_feature (384)..(384): n is a, c, g, or t
  misc_feature (389)..(389): n is a, c, g, or t
  misc_feature (393)..(393): n is a, c, g, or t
  misc_feature (395)..(396): n is a, c, g, or t
  misc_feature (412)..(412): n is a, c, g, or t
  misc_feature (425)..(425): n is a, c, g, or t
  misc_feature (429)..(429): n is a, c, g, or t
  misc_feature (434)..(434): n is a, c, g, or t
  misc_feature (530)..(530): n is a, c, g, or t
  misc_feature (612)..(612): n is a, c, g, or t
  misc_feature (748)..(748): n is a, c, g, or t
gcaccagccctactntgggggtccagggcagtatggcagcttccccggcccctcctccagccgccaggncacacngcngtgccaggggangcggccccaggccattcacatagcttgcgaaggtggcccaccagcgngcctgngccatgcccagacccagctccgttgaggnttnttttnggatagacntnaagggggngttttttgttggttngtgggtngagttggggttctgctgtggggggntgtgttcacaaacagngtggccatnggggcttggtgatgngnnnggggggtgcgagtgtgagggtaaaagnatgtagtggtttnaaaaattttaaaggagatgtaaaaaaaagaaaatgcnttgtaaagnacgtagtnaatgngganannaaagggaaatggcttnagctcctgctggntgangtagnagttcttgggtaccattgtgttgccttcctcagagcccttgaagtcccgagtttcaagataggcatcatgaagccctgtccactccttcagcaggnagcagcccaggtcttctgggtgcatgttgaggtctccacacaacagaaccacgtctgccttcttggatgtgtggtggatganctgggccaattcccaagcttgggccacacgatgtgctaggtagatgtccttctgtcgattgtattcggcatggagatgggtcacataggcgttgagcaccatgccacttagatggagcaccagcagccccaaagcnttcccactgaaccagtcaccatgatggatcatgtaggggta

SEQ ID NO: 702482 - DNA, 1111 bp, Homo sapiens
  misc_feature (18)..(18): n is a, c, g, or t
  misc_feature (71)..(71): n is a, c, g, or t
  misc_feature (81)..(81): n is a, c, g, or t
  misc_feature (123)..(123): n is a, c, g, or t
  misc_feature (135)..(135): n is a, c, g, or t
  misc_feature (147)..(147): n is a, c, g, or t
  misc_feature (157)..(157): n is a, c, g, or t
  misc_feature (163)..(165): n is a, c, g, or t
  misc_feature (184)..(186): n is a, c, g, or t
  misc_feature (198)..(198): n is a, c, g, or t
  misc_feature (200)..(200): n is a, c, g, or t
  misc_feature (306)..(306): n is a, c, g, or t
  misc_feature (371)..(371): n is a, c, g, or t
  misc_feature (485)..(485): n is a, c, g, or t
  misc_feature (499)..(499): n is a, c, g, or t
  misc_feature (509)..(509): n is a, c, g, or t
gcccggttagcattcggncgggagatgcggcagtggaatctggaagggcggtgaaaaacctacgtcctgcnctcgcccggnctctccattcgtcccccgggtagagaggtgcccggctcccancccttcccagtncccagccctggnagacagcagnccctannntactgagggacagcgacannnatgaaggctccngngtcggctcgtgctcatcatcctgtgctccgtggtcttctctgccgtctacatcctcctgtgctgctgggccggctgcccctctgcctggccacctgcctggaccancacttccccacaggctccaggcccactgtgccgggacccctgtcacttcagatggatatagcagntgtgccagatgggaagccgctggtccgcgagccctgccgcagctgtgccgtggtgtccacgctccggcaagatgctgggctcaggcctgggtgctgagatcgatcagtgccganagtgcgtgttccgntatgaaccanggcgcccaccgtgggctttgaggcggatgtgggccagcgcagcaccctgcgtgtcgtctcacaacacaatgcgtgccgcatgctgcatgcgcaaactattcacactacttccaggaaggcccgagacacgctctacatggtgtggggccagggcgaggcacatggaccgggatgctcggaggggcgaccgtaccggtacgcatgtctggggcatcaccaggatgtaccccgggccgtgcaggtgtacagccttcgacgtgagcgcatgatggcctactgcgagcagatcttccaggacgagacgggcaagaacccgactggtcatgaggctcagagaggttcacgaagcaaatgtgatgcccatagcagagccaggttcaagtggaagatccttggactctagatgaacccgaactgaattggaatacactggtgccgtgttgctcatgctgttccccagggctggtcccttagatgaggagaggtctttggcccgaggcccgaactcatcatcagggggttgtcgaccctggaagcgtgattggcgagcccgtggtgcgggattggctcggctggtgggtgcgtttctccaatttggcttg

SEQ ID NO: 702483 - DNA, 435 bp, Homo sapiens
ttatatgagaagagattgctgtgtaaaagagggcgtgctagtagaaaggtggtgtcgaccagcagctgccagtattatatagctgtgtgatctccagaggcctagggcccttgaatgtcacagatgctgtgttaaatgtcatctcaaatgtgactctcacgccgccgttaatctctggctatgggcagtgctctggctggcttcatggggggctcatcctggaaggctggtgaccccgaaatggtgggcagaatccccttggggggtgttttggtcacaggtgagttccgacactccatcaggaatttccggtcatagatgatcctggtacctcccgcggtggtgctgaagagcgtgccgccgggggtcgtgctgtagtccccgggcgggagcttgcacgccgtcgccgagcaccacccggcgagtggcgggaac

SEQ ID NO: 702484 - DNA, 947 bp, Homo sapiens
  misc_feature (500)..(500): n is a, c, g, or t
  misc_feature (515)..(515): n is a, c, g, or t
attctattctcactaaatccaactggttgactcttcctcattatctttgatgctaaacaattttctgtgaactattttgacaagtgcatgatttcactttaaacaatttgatatagctattaaatatatttaagggtttttttttttggacaaattcaacattcaacgagtagacaaaaggctaattatttccctgattaggaaagtttctttaaaaaacacgtaatttggcctagtggctttttctctaccgtgccctggggctcactaaatatcaccagtatttattaccaagaaaatattggagtttacctgattaaactttaaaagttaatggtagatttaaattggtggtgaaccctaatgattttggcagtggaaacctttactaattccaaagttggctatgttctatgacatctggtgactggcgttggcagagtggtacttgaaactggttataatggagtcattcagtaaaggagaacagtatctgggtnaatggctactggaanggttgagaacagggaatgggttggatatttaccacagcgctgtgcctttctacagtagaactggggtaaagggaaatgggttttatggcccatagtcatttaggctggaaaaaagttgaaaacttaacggaaatatgggcaagagatgtgttatgtgtgggttccagctaaaaatgatttgtagtgtgaaatcatagctacttacttagcttttccatatatcttcttagtggtgggcactcttaggtctaagtatggattcagggtgtcagggtgtgtgtagttaatcctctgctctcatctttatctaagagattggctggattacctcattcggttggtaaaaccagacaggtaaatttctggtgcaccctttattatgttgcatattttaagatcctgaagaaatgtgtgtgcttgggatccggataa

SEQ ID NO: 702485 - DNA, 670 bp, Homo sapiens
agcggaaaaggcagatcaaagtggtgggactcgctgtcgctggccgctggagacgtgaagctctcgaggctcctcccgcgtgcgggtcggcgctcgccctcgctctcctacgaccctccgacccggccccggccctggccaccggcgcccgaccataggcacaagactgagctgtatccacggaaggccaagctgtgccgagcacgtgcgtagcgctacgtagcgacatggccaccgtgtcactgacaggctagtgaccgaatgcagcgggcgaccggagcatgtccaccagagggaggcgcgcacctgcgtcgtcgcgggagtcccgtaagaaagaaacggttgcgtctagtggggtgccgggcagtgtccctgcccatagcgaaccgcgtcaatcatcttacggtcaattcacgaacgcacgaaacgatacccggaggaggcattccggagctcagagaaactgttagtggccgggcgttgcattgacgtggaccttacttccgcgacgcgaattggctgggaggtacccagtaaacgtgaggtactcccaattgttagcagtccaacgctatggcttgtgacatgtatggagggggacttacaggtagattgtagaacgtaccacaacagttgcaaactataagttcctatgtatgagtataaaggg

SEQ ID NO: 702486 - DNA, 402 bp, Homo sapiens
  misc_feature (44)..(45): n is a, c, g, or t
ttggggggcccggggttgtttaaaaaaggggggaaattttctannaaaaacccccaccagaacccctttaaggggtttttccggggggggtcttccccccaaataaaaacccaaaaaggtgggttttggaggggttttcccataaaaaaacaagttttttccaggggcccttttttcccgggggggtttcccccaaaatacctatttgggccaagggaaagccccccagttcctttaaggagttcggggaatacccgcccctggggatgccctttatcccctttttgttttgagggttcacccctgttgaggttaagcccctcaacccgggggctttttgggggaggagtggggccccaagtttttcagcacccggaataaagcccgcctgccccatttgga

SEQ ID NO: 702487 - DNA, 711 bp, Homo sapiens
gcctgctcctgccgcgcgcacccccggggcttcggctccgtgcacgggtcgcgcccagctttcctgcacctgaggccgccggccaccgccgccatgggtcctacctctccaccacacggtgaagtgccggggacggggtcggggccccgctgctgcctgtgccctacggcttctccgccatgcaatggctggctgcgtctccatggaggatgctcacaactgtattccttgagctggacagtgagacaagccatgttttcttgtctacgatggacatggaggggaggaagttgccttgtactgtgccaaatatcttcctgatatcattcaaggattcagaaggcctacaaggaatggcaagctacagaagggctttagcaagattgccttctatggctatttgacgccaaattgaccacttgaagaacgtcattaaagagcttggcacaggatatgcagcggcgacccacttgaggatgaaggattaaacagaaaaagtagctgatgaagatattgtggaccatgaggaaggctgcactgctgcatgaggatgctaccatgactatttgaaggaggctgctgacacgctacgggcagaactgtccaagtgccctcccacagcaatctggggttggcagcgagggacccggtcccgggctcaatggggggccggccttgggcccctgtgggtccttccagaaatgtcccggc

SEQ ID NO: 702488 - DNA, 696 bp, Homo sapiens
gtcgtcggggtatgacatgcgttcaacaggggctgggactggaagcccgtggcgctcgtatccccaccccaggccggcctgaccatagccagcccgtccgtccacctcttcacgcgcgaccctacggactggcgcccaaggacccgcgagcgacggagtcgagacagccgaagcgagacaacctgcacagacccgaccagcactgcaacatacattccttttaagattcaggcacgggccaggtgaggcgagcacggccgatacgcacacattcggacacgtggtagccagcgcgagaaacataacgcagcacgggggaaactcgaagaagggcgacggacacaagttcaaaccgccggcgcaagaagtaccagaggcgcggtggggaagctgtcttagaaacagggcgcgttccacgtttaaatgggagttagtgaacggcgatggatacgcgagctgtgtgttcggtttgtaaagcggttaaacgcgttagtatatgtacgagctatgaactgacaatagtgaagttgggattggggaacatagtattgtgtaagagggaagaagcgtgaaacgaaggacgcgcaacaagaaagtaaacgattgtgatgcgatagtatagagagaggaagaggataccgatacacattggaaggtgaaggaatggagaggaaagaatcttggaggttggagaaa

SEQ ID NO: 702489 - DNA, 436 bp, Homo sapiens
  misc_feature (252)..(252): n is a, c, g, or t
  misc_feature (288)..(288): n is a, c, g, or t
accattcccagagtgagcagggtcagttgagaggggaagtgggagcgggagtcaggggtagcacatgggaaaatgagagatgagaaatatcaatatttggtatcattagggaaagtttcgtgggtgcattagagttcaagtttgttggctcattgtaggactgtcatttattaacctaaggctctagtcctgtttgtgtaatatggtagccactagccgtatgtggctatggaatgcttgaaaagtgacaancctgaattgaaatgtgctgtaagtgtaaaacacacnccaaatttcaaagacattatataaaaaaagaatgtcaaatatcttgctagtaattttttatattgagtacttgcgaaataatattttaatgtggtgaattatataaaatatattattaaaattaatttcacctctttttgtcttttta

SEQ ID NO: 702490 - DNA, 1052 bp, Homo sapiens
gagttcagcacgcggccgtggaaccaaagtacgactgccaggagcatagtctcagcaacccgaggtagagcatcggacatctgaaagcaacgtcccctggcacaaacctaagattggccacgccagcaaccccagatctatctggtaaacaactcaccgatcagggtcagggggtcccacaggacacgtggagcctcagcacagtctgtcgccacaaggacgtatccaatcgctaaaagctcatgctctgcacagcaccacccacagtgtctacacacgtgcagcccatggagcaacaggcatctggtcaactgacatactatccgaagagcacctgtgaacgagctgtgcacagccacctcacagctatgcgaagcctgggaagccacaatgctggagagtacgcacggatggtggctatcacaagctgccactttcccctgtccgtggccctctcagcaaatcggtcctggcacaacagtctgaacggaatggctccacgtgtcttcatctacggtcagttctgctacacgaaaacattctgggcagcaagcaagtgtgatgtgagaccaggccaccagtgggaacctggcaaggctgccacccccgagccgtcgtcagcgcgcactgtccctcgtgcatacaccaaacgcccatctcatgggaaagcgcacagtatccgattgagtaccagccagcatacggctggcacatggtgctaccggaaaaactgaatatgcaccgagatacacacacacagctcacgcatgcagacaacaccccttacgtgcctttggataagaggctgtggatgttagttgttgtcacttactatgtacttacttcattcatatgtagctccacaccaggtcccttgtgtcttgtttggatagagaacaaaaaattaaggctgattatatttttctcgttgatttctacctcgctgttaaaattgaccaacttctagtatagggagtacttgttctctactaactgttttattgaggccctgtgttgatactatacaagccagtgtagaaataaagatatat

SEQ ID NO: 702491 - DNA, 192 bp, Homo sapiens
atcatcatctcgtatagcatgtttccgtattgcatcatccaacatttagctcttattgttacctttcacacttccattttacccctgtagtcatgttaaaagaagtctcagacactcctatcatgtcacttatacttcttctagtattatctcatgacagtttaagaacattattttataatataatctcca

SEQ ID NO: 702492 - DNA, 359 bp, Homo sapiens
ctccttatccgatcgggtggcataggagagaaaggattaagtctgccttctggctcaagggcccgcccagagctcacagacaaccaattacgtattaatcactggtacctgtcacagccactggaggtggaggtttaaaaaaaaaaaaaaaaaagacaaaaaagttacggtatcctacaagcacagatttaagttcaagactttaaaaaaaattctgtcccggcccaggggactgaacattcagaagccagcctgaccaggcacgttgtgccttggggcaggtccactgctgctttcttgcccagttagcaagcacaccacccacctcccgcattaattgcccaccccgtcggttggag

SEQ ID NO: 702493 - DNA, 168 bp, Homo sapiens
ctgccgggaggtcaccatattgatgccgaatttagtgtggacatgcgatcgtgatagcgcactacaggccagtaactcctgggctcaagcgatgctcccacctcagcctcccgagtagctgggactacaggcacgcgccaccgcgcccggcagagaggggcggagcag

SEQ ID NO: 702494 - DNA, 469 bp, Homo sapiens
  misc_feature (190)..(190): n is a, c, g, or t
gtgaaaccagtttatttaaaaaaaaaaaaatctccctgtgttaatcctcttttgtgggaggcactttagtttttttgcccagctcttggatgtttaaagtggcagagcggaggagcgtgtcacccagctgggcccaaacctcggtcaattgtgtaacatgcttgtgggaaaaagcagaggttaagtgttncagggaggcagctgatttcctgccacagctgctctatagctgcctccctgggcctcaccccctccagactagccaggcaccactaggccctgctccttttgtagagcctccagccttatttggtgagtttgctactggccagcctccctggagcctccccatgatgtcaccagaagggaatgtaaataagtgagctctgtgtcaggctagggagagtgctgcaggctcttttgggattctgaggtccctccttcaggaatttcctcgttagtggcagag

SEQ ID NO: 702495 - DNA, 658 bp, Homo sapiens
  misc_feature (81)..(81): n is a, c, g, or t
  misc_feature (212)..(213): n is a, c, g, or t
  misc_feature (230)..(230): n is a, c, g, or t
  misc_feature (269)..(269): n is a, c, g, or t
  misc_feature (285)..(285): n is a, c, g, or t
  misc_feature (301)..(301): n is a, c, g, or t
  misc_feature (489)..(489): n is a, c, g, or t
  misc_feature (553)..(553): n is a, c, g, or t
  misc_feature (567)..(567): n is a, c, g, or t
  misc_feature (570)..(570): n is a, c, g, or t
  misc_feature (587)..(587): n is a, c, g, or t
gggggaagaggttcccttcaaaggggaaacttttggggtccttcccaagttcctggcgggtggtggtcttcaggaaaaaanctgtccagggctacttccggtccatgtccctgcaaaagtcaggccaaggggtgtccagggcccaacgccagttcaagcggggggcgccgccccgcaggttgtccatccgcaacgcgcacagcatccaccannggttgggaagccctcanccaggacgctattgccgcaacagcgtccgttttttgcancaacgacccgccaggngcggccgggaccgcanagccccgggagcccgctcgaggaggagcggcaaacgcagcgcttttaaccgcagccggcggtgcccccgcggccgagcgccgacctcatcctgaaccgctgcagcgagagcccccagcggaagctggggtttgccgttttaggctggagcgcagtccccagctagcgtttcggccctttccgccccgngcctgtacatacgtgttttataaagcctggggtttggacgccgagggcagccccgacccctgtncagggcggctcccnccnccctcaataaatgttgnttggagtgggcccaggctttgcaggaatgcagggagggccggggtccgccccagggtttttttttagttta

SEQ ID NO: 702496 - DNA, 195 bp, Homo sapiens
  misc_feature (5)..(5): n is a, c, g, or t
ttacncgagatcgagccgctgcactccagctgtgttgtcagagcgcgatccgtctcaaagcaaacaaaaaacaaaaaaaaaaaaaaaaaacaatgaaattattattttgtggaaaaaatcgttaaaacgtgaaaattccccctggggtttccccccctgggccaagggggtagggaccccccacaaaaattttgc

SEQ ID NO: 702497 - DNA, 201 bp, Homo sapiens
aaccggactctgcggccgtgtcggtgcccggccgacggggtggcgtgaccggtggtctgctgaggaccgcgccggtgacccggccgctgtgctggtgtcacctgtggtctgctgagagaacgagagactagatgacactgacacgacgggagtgagtgcgaccaccgggataccgaagactcaaaacttcgatacactcac

SEQ ID NO: 702498 - DNA, 216 bp, Homo sapiens
ggagaagactagtactatctgcgggtcacacggtggctacccacacttctgactcaggacgttcctatcaggtgtcactgaggtggtcgtgaagctctttgactctgatcccatcactgtgacggtccctgtagatcgtctccagtgaagaaccctcaaatatatcggagaccgtggcgagacaaagcgctgcagtgaatacgcgcaacaaagcac

SEQ ID NO: 702499 - DNA, 607 bp, Homo sapiens
gtatatcttaatggaatacactcatttacaaaggacttgaggaaatgtggatgtgaataatacctttctctaataaaacttgatatgtataatagttaataatattgacattaatgatatttaatatggatagacatgcatagattcaaataaaattaaaatcaatgataaatgctaaatatttatctaaatagttttcaagaaacagttatggaaatgtgtatattaacatggctctaatgtggagctcgtggtatttcaactcagtattcattattagtacgtgtgtctggaagagatgtactttacttttacctctttacactacagttgctcttatggggctctaaactgtttaactgaagaaccttcgtctgtatttagatgagcataatttagtattttatgagtttccacagatgatgttcttatgtctatcaaggtctatgtaatcaaattatataaccatccatttacgaccaacaggaatttccacagattacttcagttgcaaattatgcgtttcaatgctcctgaaaatacatttgtggacttaggggtgggaaatatatgaagaatgtggatggaaagaaaaggatagcacaag

SEQ ID NO: 702500 - DNA, 265 bp, Homo sapiens
  misc_feature (228)..(228): n is a, c, g, or t
gaagtgggctggctggtgaaagggtgggctgggaagagggtgccacctgactcagtacaatgaaagaaccggtgaccacccgtcagtgtgcgtaccattgtggaagagtgtccaggatggcaaggtcatctcctcccgcgagcattgtccacctagaccaccctgctgagtgactcagctaccccgtgccggccacccagtgaggcagtgtaggcagccgccccatcntgccccacatgtctccgtgcctctccatgcctcagct

SEQ ID NO: 702501 - DNA, 364 bp, Homo sapiens
  misc_feature (286)..(286): n is a, c, g, or t
gtggcacctaggaaactcatcttgcttgactaatatgagtttcttggtagcagaaagtacttctcctgttctcttgaaattttttaagccaaacctctttctaaaattgtcaaaccatcatctgctggcattaaattcttcaccttcagatccttcatcttctctttgctttaagttgtcacataatgacttcactttttctcaaatcttattagagtctctagtattcctttcttatagcaatcctgcacccacataaaagctgcattttcaattacaaaattanaaaggtatttcacaaaaagtggaaaagtgtttgtgctagctgggcaaaactggaaggcaatggttttcacagatttcc

SEQ ID NO: 702502 - DNA, 167 bp, Homo sapiens
ggagagagagaactagtctcgagttttgtatttgtttcgaccggaaagggaatccccccgggcgcccaggggggggggcgggggcgccggggccggcacccgggaccgggtaggaaaaccaaggcggggaacggaggacaacggagaaaagccaatcagagaagagg

SEQ ID NO: 702503 - DNA, 393 bp, Homo sapiens
cttttggggtctttgctgagatcagcctggcagcatgacaaaaccctgactctaccaaaaatacaaaaaaattagctggacatgatggcatgtgcctgtggtcccagcaactcgggaggctgtggtgggagaatctctcgagcctggaaggtggaggctgcagtaaaccgagattgcaccactacactccaacctgggtgacagagtgagaccccgtttccaaaaaaaaaccttctctgaatggataaagaaaatgtatatacatacaatgaaatattattcaaactttaaaaaggaaattttgttgtgtgatacaaccgtagatgaaccttgaggaattacactaagtgaaagccagtcacaaaaaggcaaatactgcatgaccccacttac

SEQ ID NO: 702504 - DNA, 343 bp, Homo sapiens
gttagctgaagtgggaagctgagctgtgtcgctccctggtcactgtttctcctactaatgtatagtggtcacgcaaaatcaagaaacagaaatcgggaacatcatcatacggtttttcgggtcaccgtcggcgtgacgctcagttcctcattcccccttcccccttaagagtacttcctcgatgcaggagccctccaggttcgatgaaggatgtgaatttggcccatcattgttcgacgctacaagcgcaagcaattcagccttgtttcaaggccctgaattgcggtttcataaacccccaagctcaactccattccatcttcggaaagggaattccatcata

SEQ ID NO: 702505 - DNA, 654 bp, Homo sapiens
gtccaaactctttcatcatcagtagcatgcatcaccaggtctcaggagtactgtcctagagagtagttcatccgtcaggattcgcatgtctgtcctcagtgatccctcctcacaccctcgtctacttatgtgcactgtatcatgggatatgatgttaccaactcgtcattgtctcggtcatacgtgtcgaagatcatgccgttgtgaatggtgatcgtcatgatgtctcccgtcatatgatatgctccatccatgtggtcatcatcgactatgctctctatacttgatcactcagatctggtaatttctagcttcaagctgttcggtgattcctccatactgtgcatttactttgtctccattccagtcgtccatttctatcgtcagttctgtgggtcccatcctggtaaagtggctactgggatcatttgcaatgcaataattcacctgctagtcctgcagtaattcgtgccatctgtttggtcttcatcatttaatgctccagtgtctatatggattccatttccagccatagtcgcggctccgtgcttgctcgattctgtatcactgtcaatcctacgtcatgtgtaatcatgctccagtatgctcgatacggtttgtcctctctgtcaggttgaatgacctacatctcag

SEQ ID NO: 702506 - DNA, 631 bp, Homo sapiens
tggctctagaggaccccaccatgctccacctggcactttactctgccaagcagtggcagcccagtccaaaaggtgtctgcatggccaaggggttggggagtcacttcacattccaggctggaggagtgagaggacttgggggtactcctcccaccccattgccagcaagaggccatgactcaccttcaaccccaagtcctgcatcctggtgggaagtgacaatgcctcctcccagctctccatacctaatggggtcatgaccagacagggtaggacccaggcccccagctttcagttggtaacggtggcctccacggcttgcccctgtccaggtgacaaccccagcccccatgatggggcagcaaaggtctcttctcctccttggtcctcagcaacagacagagccctccacaccaggcaggacagaggccaagtcagaagcagcagcggtggcagggaaggagcagccagcacaggcccagggctctcctgaagtcatttaagctgtctgccatgcggctctgggactggccactaggtgggcgttggcggctgtgatacaggtacttggacacctttctggcctgatgccagctgatacttgtccttgggtgctactgctgtgtggggg

SEQ ID NO: 702507 - DNA, 155 bp, Homo sapiens
cgagctggtaccctcgcaaacaacaggactgaccaaactggcccttttttcatttcttcccacatttgtagattcttctcaatagggttttttctatgtttagattctatcctctgctcacgttctgctttcatctgttcaggttggaagacatt

SEQ ID NO: 702508 - DNA, 388 bp, Homo sapiens
  misc_feature (3)..(3): n is a, c, g, or t
  misc_feature (63)..(63): n is a, c, g, or t
  misc_feature (355)..(355): n is a, c, g, or t
  misc_feature (385)..(385): n is a, c, g, or t
canaaatctgagccagatcaatttaggaagtttattttcccaaagttaagaatgcacgcaagnaaaaatggcctcaggaagtcctgacatgtgcctaaggtggttgggacacagctcggttttatacattttagggagacatgagacatcaatcaacatatgtaagatgaacattggctcagtctgggaaaggtggggacaactcgaaggcaaggagggagcccccagggttattagggtaggatgaggagacaaatgggtcgcatttcttttcgagtttcttgatgagcctctcccaaagggggggattcagatattgcatttattcttcagtgagccaggggggtgatttttnagttaggattggggggccaggtttggcccntaa

SEQ ID NO: 702509 - DNA, 858 bp, Homo sapiens
cttttggaggggatccgcttcgcatactttcgttgcccacactttttccggatggttctctctgcccggttcctagacaatatctccccgggattctgtcgccccttatcctccgcgggcggcgccactccctgccccttctttggttgaaaagcgcttgggcctatatgcccgcgtctggtggacgaccacacggtgcctcgcacagcgaagcctttcgcctttcggtccaacactcgtggggaccacacctctcagagacaactcgcggggtttttcttgcatcctgcccgggcccataatattctctcgggcccccctttttcttttctcgtgcctaaccacgaagagggtctccacaaagatttggagagcgctgttcgctatattctcacgaaaaaaacttggtgaagagatgtccccctcgaaagcctcgcgggaggggacactcctgctggttcgctcttccttgtgcgcaggaaaacacacgtgtgttcgtccttccctgcccccgccaaagcagctcttttgggggcgccacacgtgtcctctcgcttcaacacacatgtgtcagcccctcgtaggcacaatttctctgggaaagcgatcccggccccgggaacactgcccttaaggggcaccgaaagggcccacaaagagaaaaacgctgggggtaaaaaaatccggggggtcacaaaggggaagaccactataacccacactgggcgcttaaaaaaaggccacaaaaagtgcccaggggttggctatccccctcgctgagggaatggggaaaatgaaacccccgctcccccttgccggaaaattaaattttaaaaaccaaggaaaagcccaaaaaaa

SEQ ID NO: 702510 - DNA, 947 bp, Homo sapiens
cataatattctgaattcattccaagtttaaaatcctgtcattctctggctcttcttttgttcacatcaagatatgatgctgttggacttagaggcttccgaactgtatttattgagggctactatctgcctccacaattttcattaagaccactccacctttagacaaaggtgacttttggtcgtgatttatacaatatcaagattttattcacagcgtttctaaatatctgtgaaggtagacccttagcaaaatgtgtctcagttctagtttctcaaagtagaatctgatgcttccaccaagtaagatccatcgggagctagagaaacaatcataatgttgacaaatcaggaacctaacagattattttgtctctcattattaatttgcagagagcctctaaactttcgagaaatcaatgtgtcttcttaagaagagttaagcaccctctcttaactttcccctctatttgctctccttgttctttcttcttaagagtatttatacttatttcgttaagcacaataatggctaagattgctctatgaatttgcacactcgaggagtggattgcaacatacttgcagggcattatcctctttaactttagtcagactttacacaaacaagataaccgcaaagttctaacgccactgcaccttgaaaacgttgccctttggaggaagccttgttaattcacttaattccaacagagtcatgtgccccattccctaatttcctaaagcattgttggcaagagattgttgtttcacccgcgtaatcataacagcctatgtgcgacatacggccaaaactgcggtgtcaaacctgcatgcgcatcgtacataacatttacacagccgtgtcacaactcagcaacacctcggttcacaggccaaccctgctgattacactttccctcatcctgacgtgtctcccgtcccttg

SEQ ID NO: 702511 - DNA, 222 bp, Homo sapiens
tccctaaaactcctgaatcagagaccatggggaagggcacttttgaaaagattctggacgggtctgggagagaaatcaggcatgggggcttggctgtgtgtcaaacactctcaatggccttcctcaccaagtgctacagacagatatgagcaaactgcactagagaccttacacacacaatcccacacatcgtattcccaggcccatccctcagtcctgggt

SEQ ID NO: 702512 - DNA, 105 bp, Homo sapiens
  misc_feature (91)..(91): n is a, c, g, or t
cctactccgaaacctggatggttaggagcccagggtccttgatttccagagctatatcctggttggacctttgccaacagacctgacactnaggggtaatggtat

SEQ ID NO: 702513 - DNA, 777 bp, Homo sapiens
  misc_feature (29)..(29): n is a, c, g, or t
  misc_feature (39)..(39): n is a, c, g, or t
  misc_feature (58)..(58): n is a, c, g, or t
  misc_feature (71)..(71): n is a, c, g, or t
  misc_feature (110)..(110): n is a, c, g, or t
  misc_feature (119)..(119): n is a, c, g, or t
  misc_feature (148)..(148): n is a, c, g, or t
  misc_feature (155)..(155): n is a, c, g, or t
  misc_feature (175)..(175): n is a, c, g, or t
aaaccaccccaacctttaaaccctggganatttaagccngtttccaaaatttggaaancccataaatagcncctaaagtgaataaccctgtagtgatatcctttaagcantcatgaccnaattatatattttaaacagtggtgtgtantcatcanttttattctaaaaagaggantaaatagtgctgtgttaaaatttaagactttgctgagaccacctttcagtctgatttttgaattgcttttatcctgactttttttcttgagacagagtctcactgtgccacccaggccggagtgcagtggtccaatcttggttcactgcaacctgaaaccataaaaactctagaagataacatcggtaaaactcttctagacattggcttaggcaaagctgttcatagccaagaacccaaaaacaaatgcaacaaaaacaaaaataaatagataagacctaattaaactgaaaagcttctgcacagcaaaggaaatgatcagagtaaacagtcaacccacagactgggagaaaatattcgcaacctaagcatccagcaaaggactaatatccagaatctacgaggaactgaaatcagcaggaaaaaaaatgaataacccatcaaaaagtgggcaaaggacacgaatagacagttctcaaaaggagatgtacaaatggccaacaaacatgtgaaaacatgctcaacatcactaatgatgagggaattgcaaatcaaaaccacaatgagatactgctttactcctgcaagaatgaccataatta

SEQ ID NO: 702514 - DNA, 412 bp, Homo sapiens
gccccatatttgatctgttcagaaactgttggtctcgaactcctggcctcaagtgatccgcccaccttagcctcccaaagtgctgggattacaggcgcgagcgaccgcgcctggccaaagatgcaaattcttgattggatttatgctctgcctattcccagcatttccttatctgtagccctgcttgcttgagagtatacttggatcagaagtattgctgctgagggagctataatggattcttcttccagaagtaaagaactcatctttagagtacctctaaatgaattctgttctgtcttttctattttgaggtggattggtcttctctctttttgggtttccagatcactgggactctcagaccttacctttccagctccaccattagtttttccttcattctcattag

SEQ ID NO: 702515 - DNA, 172 bp, Homo sapiens
catgtgctgtaggccagcccagatagctcgaagacagacaagaaattgcaaattcaagaaaaagcagcacaagaggtaaaattggccatcaagccattttaccaaaataaagatatctaccaggaggattataaagcattgtacggagcagtagataagtttgtcatagtag

SEQ ID NO: 702516 - DNA, 721 bp, Homo sapiens
  misc_feature (197)..(197): n is a, c, g, or t
ccctgacacgccaagtggcaagggtgctgtctgcatgagtcggggacaggcacgtgatgctcgagcgagggaaccgcacgactaacgattcggcatcttcgtgtatgaccatgaatatgcaagatgtacaggtacataccgtaactctatatgatacagtacctagctgcataactagagtattacttgacacgcantaggttgcattagccggtgtagacgcattttcagatcggctacacattattagagtacgcactgtatacgcaatcttcaacgaaagcaagagagtatgacatgcgactctaggaggatggtagccttaggtgagcgaagggaacaatgattacatacaggttattctactaatcgatgaccgagtaggctcgaaggattgtaacagctgcttacattggacgtaatacataagtgtaattattatagatggataagattggatggagagagagagatctatcagaaggccactcgaaacttaaataacgcaagatagaaaggggcatatgacttttaggattatgagatgaacggtgatcttaaaaggagggttaaaagtattcacgctttaataaagttggtacaggtcgattaaacaataagttctgaacgggcagatcttgtgaataaagacgatgattacaaggccgaagggtggatttagtgagaatccttggaacgtcccatgaacgcaggggatgaa

SEQ ID NO: 702517 - DNA, 492 bp, Homo sapiens
  misc_feature (13)..(13): n is a, c, g, or t
  misc_feature (404)..(404): n is a, c, g, or t
tactcactgaagncctacaatctctgggctcaaacgatcctccccactcaacctcccaagtagctgagaccacgggtgcatggcaccaagcctggccaatttttgtgtttttagtagagatggagtttcatcatgtcgcccaggctggtctcaaactttcagcctcaagcaatcctcccgcctgtggctctcaaagtgctgggattacaggtgtgagccactgcacccagctggatatcctactcttaagctcaggaaagggaactttcctggagtcaataaccttatcctctgtaaaacagttagaagtaactatcacttagggttccaaaatgcatgaagggagattgtaaagatgatgcacttaacacttcatgtcgtaatgcaaggatggttattagatngggggtagtgtaggagagagggaatcctgcttgcttcttggctaaagagactttcccaaaaaatctggaaatatcctacatttcaggt

SEQ ID NO: 702518 - DNA, 1549 bp, Homo sapiens
  misc_feature (951)..(951): n is a, c, g, or t
  misc_feature (1177)..(1177): n is a, c, g, or t
tggtagtgatgcagactagctagcgtggttgatgcgctgcgctttgtgttctggtgtctaccgcactcttgttgcgactcctcacaagggcggtgtccacccacgggcgatctcgcgttggggagcatctcttctgcatcgtttcgtgttgtgagaaccccactgttgtggtgtatgccgatgaataatggcgggtgttatgtagcctcgcccccccaagcctgtttttgttagccgcggcgcttttccccgatggtacgtctttccacagtagccgcgcgcactttcaaattgtgtgacagcagccgtgttctctattctatggcccacacagcgagatttgtttgtcggggggtttccacacggggggactacccccttcctctttatgaaggggcgcccccctgttgtttgtttgggatgtagtcctcccgcccctttgtcctccctcgtggtgatgtcccccccgcttgctctatttctctccagatcacgccactgtccctagaccccccaaaggggagaataattgtggtataatagttccacactgttttactctcccgcaaactgggttctcccatcgtgggtgaaaaagctcttgccgcatgagatgtctctttttcctctgaaagagtgagtctgtgggaaatgatgtgcccaccacctgtttttgtggggcgttccccaaaaagccattttttttttggggcggcgtcttgtcccccttgcgcgccccctcatccctctggggttgtctcagatggtcgccaccgttgatatttatctccacccccacagagttctgtgagactctcccacagagagaactctcactctgctggccccgctctcccacaggcaacaacccacagagaggggtggggacgacacacaatgtagtgtgagagggacgccaccctctggggcgccctctgtgtcttttcttgncctctcgtaatagagggtgtgtctctctcacaaagagagcgttgtatctccttgtccccaccacaggggccaacattcctgctctgtatatgattccgcttctctcgggggggcccccacgcggagaaactgtggggaaaagtaagttatagtgggtttctccggcgtgatactcttataggacactcttgagatacctcgcgtggttgtgggccacactgtgacncacagatcgtgttctgtgccacacacgctgtttatcccccgcttcccacgcggagactctatacacctctctcccacgcggagaccgagaccccctggtccccaagggttcccctcttgctggcacggggcgcctcggcgtgtgggcccctgcacacttgtctgaaggttctcccacatcactgggcaacatgagaagggagaattctccccacgccctccacgtgttagcttagagggtaactggcctaagccacatgttggaacattctcctatccccgagacctccttctccccaaccccggggaaagagctttctcattttttattttctaatttttgtttgaaataaaatccctttagttagcccca

SEQ ID NO: 702519 - DNA, 707 bp, Homo sapiens
atctcaatttgaattgtatctcccagaattcccacgtatgtgggagggcaccagagggaggtaattgaatcatgggggccggtctttcccatgctattctcgtggtggtgaataagtctcactagatctgacgggtttatcaggggtttccgctttgcttcttcctcatttttctcttgccccttgccacgcaagaagtgcctttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtcttttgattgtagcctttctagtgggtgtggagtggtatttcattgtggtttgatttgcatttccctagtaattaacggtattgataatcactttcatgaacttatttgccacttgtatgttttctttggataaatgtcttttccggtccttgcctattttaaaatggtaccatttgtctttttattgaatttataataatatttatgtattctggatactagattccttattatatatattattg

SEQ ID NO: 702520 - DNA, 107 bp, Homo sapiens
gtggtcgtcaatacatcagtctttggggctgtcctgcaaccctacacctgggccgcctgaccttggactgacctcccgtatgcctcccgtcgctctgccaaagggta

SEQ ID NO: 702521 - DNA, 191 bp, Homo sapiens
tctgtggacttcttcttctagtctgcgactagtacaaggtggccatcaaggtgggcgggcgctacctgaagggcgacacgcaggcgtctgaaggcctcggcggaaaccgtggaccccgactcgctctggagagtactacgggccggcccgtccattccccagcacctgcccacatggctggctcctgccaa

SEQ ID NO: 702522 - DNA, 118 bp, Homo sapiens
tggcccatttctggattgtcgttctgggtctgcctgctctcgcccggcatctggcggcgttctggggcgtgtgctcggttcccggtgctgcggtgcgcgggattacctggcgatcgtg

SEQ ID NO: 702523 - DNA, 354 bp, Homo sapiens
cccccggggccagggggttaacccctcgtgctgaaatggttgtttggtatttaaattaaccctgcgggttggaccaactgtcctcaaaaaaacacagttggtttccctagtacaaaaaacagggcttgggcccctttgaaaaaacaaaatttatttttgggcaatttcacacccgtcctcctttttcaggggtggcagggggagcctggaattcccccctagtgatgaaaaaccagggtttggtggggattaaattccctggccctggggtaaaagtttggggtgttctttttttaaaaggggaaaaaaccccaatcaaattttttaaattaaagccagttttgggaaatttca

SEQ ID NO: 702524 - DNA, 825 bp, Homo sapiens
ggttctaaaaacagcagaaaagggctagagttcttagcaggagagagagctgaggagttggtcaggaaagctgcaggttacttttgagtacagttcgtcccaaagtgcattagaggaactgtaaaagatcggccactagcaaggaagaatgatccatagctccagaaaagttattgccgtcgttaaacaggaaaacccttctgtgtgcaaggatggtcgtagcccaccagttttgccataaagtgcagctatgggatttacatgcgcatgtgagtgtcaattagatgtacattcctgaggtctgtttatctgtggtacgcttggtctatgtgctcttttgacttgtgcatctacatcatggttatattggcctgtgaaagtggtggtaggtggtaccagggaataaagaaattccggaattttgaacttgttcaattatcgtgtagtgtcagtttcttctacattcttagtactagaaaacttgtagcaaaagatgcagttccgaagggtgtttgccttgtgagttaaccaagtaagagaagatcaatggttaatggaccctacttgtgtattgaactcctgtaaaagtgaacttgttaaagaatacaccgtggctgaccttgcagtttacagggcaatctatttcttcaccaattccaacacatgatatggattgcgcgctgacctgtgggcgcggcatacgatacttgggtgttgcaccggcgggttcaggatacatacggagggtattacacttacattgggattttctagcttacgattccttaactgtacaaccttaaatgaatgggcatgggacaccga

SEQ ID NO: 702525 - DNA, 139 bp, Homo sapiens
atgagcatggggccgagggtataaagaaggaatagagggtagggaccgacattcgcagaaccgttcctgagtcccaggtgcatgatataccaatgtgtgctgataacgtaagattttctgatgtgtgatgttatcatga

SEQ ID NO: 702526 - DNA, 609 bp, Homo sapiens
tgggccagctactgaatggccaagaagacagaactcaccagaaaaacttcgacggggagattcataaggggggtgaaccagtatatccaacagggcattgctgagctggtcccgggtgttccggttggtgatgaggtccaaatgctggacattgagtgtgttcaactaactggaacgggccctggacgtcttctatcgatcccatcgtcatctttggagttcaaaccgagggaactggtgtatcacagggactgaggacattaaattccctcacgggattcctcttgaccttctggaccgagtgaagattatccaggaccatgctgtatactccacaggaaatgaaacagatccattaaaatcctgtgccagacggcaaggaatcaacatccatgatgagggcgtgaaaccactgggggagattgggacgaagaacacactgaagtactcagtgcgactgctgacccgggccacttgcttgctaacatcaacgggacaggacagattgagaaagaaatgttgaacagaccgtgacttttctataaagccaagtctcggcatctgctgaccgcaggataatcttaaggagatggtggggtccaccgtccc

SEQ ID NO: 702527 - DNA, 214 bp, Homo sapiens
gcacctcataggtcgcaggtggaacgattttgtttgccctcagatcttcatatgtgccgtccttttcactattacatagtttgatttcacagtaccagtgctgtggtaaatgaaggcttctgtgattactattgctggtgcagaatactgctatttactattttctgtagcatttaataaggtctgcgatcttcagctgcctgcgaatctatga

SEQ ID NO: 702528 - DNA, 832 bp, Homo sapiens
  misc_feature (59)..(59): n is a, c, g, or t
  misc_feature (101)..(101): n is a, c, g, or t
  misc_feature (107)..(107): n is a, c, g, or t
  misc_feature (194)..(194): n is a, c, g, or t
  misc_feature (206)..(206): n is a, c, g, or t
  misc_feature (297)..(297): n is a, c, g, or t
  misc_feature (315)..(315): n is a, c, g, or t
  misc_feature (376)..(376): n is a, c, g, or t
  misc_feature (393)..(393): n is a, c, g, or t
  misc_feature (396)..(397): n is a, c, g, or t
  misc_feature (402)..(404): n is a, c, g, or t
  misc_feature (406)..(406): n is a, c, g, or t
  misc_feature (419)..(419): n is a, c, g, or t
  misc_feature (422)..(422): n is a, c, g, or t
  misc_feature (424)..(424): n is a, c, g, or t
  misc_feature (463)..(463): n is a, c, g, or t
  misc_feature (467)..(467): n is a, c, g, or t
  misc_feature (477)..(477): n is a, c, g, or t
  misc_feature (615)..(615): n is a, c, g, or t
  misc_feature (643)..(643): n is a, c, g, or t
  misc_feature (670)..(670): n is a, c, g, or t
  misc_feature (719)..(719): n is a, c, g, or t
  misc_feature (728)..(728): n is a, c, g, or t
  misc_feature (764)..(764): n is a, c, g, or t
ggctttgcgacgccttagcccgggaccgaaccaggctctcccctacccgaacaccggcncggctccaccgaggccgggtcccccagcccgtctcgccgcgncatggnggacctaaatacgccgaccttcccggcattgccaggaatgagccagatgtttatgaaactagcgacctacctgaggatgatcaagcnggagttcgatgnggaggagctgacaagcacaagtgtggaacacatcattgtcaatcctaatgctgcctatgacaagttcaaggacaacgagagtggggaccanagggacttgatttctcangatcgtattggaaaaaccaagaggacaggatatgaatctggagaatatgagatgcttggangagggtctgggagtganggnnacacnnnancaaaagtaccagngcntnctgcatgaggtccaagagctgacaactgaagttgaaaanatcnagacgacagngaaggagtcagccacagaggagaagctgacccctgtgttgctggctaaacagctggcagccctgaagcagcagctggttgcttcccacctggagaagctgctgggaccagatgctgcaatcaaccttaccgaccccgntggcgccctggctaatcgcctactactncagctggaagcaacaaagaacagcagngggggatcagggggaaaaaccactgggacccccccagatagcagccttntcacttatnaactacattctcggcctgagcaggacaagttctctnaagctgccaaagtcgcagaacttgaaaagcgcctgcacagagctggagacagctgtaacgttgtgatt

SEQ ID NO: 702529 - DNA, 155 bp, Homo sapiens
attccccccgcgtatgtcttacgcagttcatgcatcttcgcaacctattttggtgaccaatacaggtaagcttgagtttaatgaaagtactctaactatgggttctacgggtcgagaagattatgtactctttggcacgtttgacatatccgcgg

SEQ ID NO: 702530 - DNA, 195 bp, Homo sapiens
actacgtcgcatatttatagagtatactgtgatgtactgatagacgtatacattgtgtaatgataaatcaaaataattagcatatccatatctcaaacacttgtcatttctttgtggtgagaacagtcaaaattcctctctaaagtatattttattttaattaattaatttatttttttcagagggcgggatggt

SEQ ID NO: 702531 - DNA, 430 bp, Homo sapiens
  misc_feature (22)..(22): n is a, c, g, or t
  misc_feature (79)..(79): n is a, c, g, or t
  misc_feature (295)..(295): n is a, c, g, or t
  misc_feature (355)..(355): n is a, c, g, or t
tgagacaggttctcactctgtnacccaggctggagtgcaacggcatggtcttagctcactgcaatctctgcctcccagntaaagcaattagtgtgcctcagccttccaagtagcttgtaccacaggcatgtgccaccatgttcagctaatgtttctctgttttgttttggtttggtttggtttggttttggtagagacagggttttgccatgttgcctaggctggtctcgaactcccaaagtgctgggattacaggcgtgagacaatccgtgcccagcctaatgatattttctangtttatttcatcttgttttaaatgctgataattgcctaatttcataacccactagtgggnttatgacctgtagtttaaaaactactgtaggaaagaatatagacaaacccatgattagagcacagtttaataggg

SEQ ID NO: 702532 - DNA, 115 bp, Homo sapiens
gatcttttggaggcaggacactggaggctggggagtagctcaatgttgagcccagtcgagttcagtgtgggcgtaggcaggcctggagctctgggccagctgcacagccagagag

SEQ ID NO: 702533 - DNA, 154 bp, Homo sapiens
attacgcactcacatcacacacagtacactacgcacacagcacacacacaaagacactagcacacacagtgcacatcacagcacacacacgcgaacacaggatactacgaacacagcacacacatgcacacacacaatacacagctcacacgtt

SEQ ID NO: 702534 - DNA, 371 bp, Homo sapiens
gacatattcttttgactaattagaccacttatggctgggattacaggcatgagccaccacacccggcctatgctctgttttttcagaagagatgcaagagagggagggaggcagccttctgaccattgtctccaaggttgtagtgcagtggcatggtctcagctaactgaagactccggctactgggttcaagtgattgtcctgacttgaccgctgagtagctaggatgactggcacccggcacatggcccagctaaattatgtatttctagtagagacagggcttgattatactgtacaggcatggcacaaacgtcctgactacaggtgatccaaccgactaggtctccgtgatgggctatgacatggcc

SEQ ID NO: 702535 - DNA, 355 bp, Homo sapiens
atttcaaaatatggcaaagaaacatgctttggggtaaaatattttgattttcttccttgtgttgtatcttgtaattttatgccagactcaggttagaaagtaagtcacgatgtatagggttaaataaaatacttctgaagagaatttgtgatttgtagggcatgactccccaaaccccttagataggaatttgggcaagataaaaaaaaatcagagtttagttgtcataatattctatgtaacaaaattggaagtatgtataaaggttttgttttgttttgttttgtttgagacagtctcgctctgtcacccaggctgagatcgcaccactgcactctagcccgggcgacagagc

SEQ ID NO: 702536 - DNA, 140 bp, Homo sapiens
tattataggactgagagcttgtacggctgcagtgaatagcgctcctgggatatagatccctccctcagcttatcctttgagtacaataatccattacattagttattcaaaatatacattattcactgtagtcaccctgt

SEQ ID NO: 702537 - DNA, 874 bp, Homo sapiens
  misc_feature (83)..(83): n is a, c, g, or t
  misc_feature (96)..(97): n is a, c, g, or t
  misc_feature (122)..(122): n is a, c, g, or t
  misc_feature (134)..(134): n is a, c, g, or t
  misc_feature (168)..(168): n is a, c, g, or t
  misc_feature (181)..(181): n is a, c, g, or t
  misc_feature (197)..(197): n is a, c, g, or t
  misc_feature (200)..(200): n is a, c, g, or t
  misc_feature (209)..(209): n is a, c, g, or t
  misc_feature (238)..(238): n is a, c, g, or t
  misc_feature (257)..(257): n is a, c, g, or t
  misc_feature (268)..(268): n is a, c, g, or t
  misc_feature (271)..(271): n is a, c, g, or t
  misc_feature (320)..(320): n is a, c, g, or t
  misc_feature (325)..(325): n is a, c, g, or t
  misc_feature (332)..(332): n is a, c, g, or t
  misc_feature (339)..(340): n is a, c, g, or t
  misc_feature (359)..(359): n is a, c, g, or t
  misc_feature (361)..(361): n is a, c, g, or t
  misc_feature (373)..(373): n is a, c, g, or t
  misc_feature (376)..(376): n is a, c, g, or t
  misc_feature (400)..(402): n is a, c, g, or t
  misc_feature (405)..(405): n is a, c, g, or t
  misc_feature (408)..(408): n is a, c, g, or t
  misc_feature (410)..(411): n is a, c, g, or t
  misc_feature (436)..(436): n is a, c, g, or t
  misc_feature (471)..(471): n is a, c, g, or t
  misc_feature (486)..(486): n is a, c, g, or t
  misc_feature (491)..(491): n is a, c, g, or t
  misc_feature (516)..(516): n is a, c, g, or t
  misc_feature (522)..(522): n is a, c, g, or t
  misc_feature (528)..(529): n is a, c, g, or t
  misc_feature (536)..(536): n is a, c, g, or t
  misc_feature (657)..(657): n is a, c, g, or t
ggagaatgcacctgccatcatcttcatagacgagattgatgccatcgccaccaggagattcgatgctcagacaggggccgacngggaggttcaganngatcctgctggagctgctgaatcanatggatggattngatcagaatgtcaactgtcaaggtaatcatggcnacaaacagagcanacaccctggatccggnccntgctacggncaggacggctggaccggaaaattgaattntccacttcctgaccgccgncagaagagatngantttgctccactatcactagcaagatgaacctctctgaggaggttgactntgganagactantggtggnnccggccagagtaagatttncnggagctgatatnaanctccactctgtcaggagagtggannngtnggntnntccgtgaaaaccgctacattgtccntggccaaggacttcgagaaagcatacaagactgtngatcaagaaggacgnagcanggagcatgagttttacaagtgaccnttcccnttcccnnccagcgnaccactcaggggctggggcttctctcgcagccccagcacctctgtcccaaaacctcattccctttttgcctttacccagggattaggtttcttcaagttagatacggataaagatcgtagntccataccgggatgaggatgatagaaccttcgagagcattttatgctcggggtcccgaacagaacaggagttctcgtcttggtcaccgtggctcgtcctgttgttccctggaacccgggcttcctttttgtcgcaggcgggataatctgcccgggcttccctataaagagggtccttataatgtgggaaaccccggttcacctgtagaccccggcaa

SEQ ID NO: 702538 - DNA, 268 bp, Homo sapiens
ccttccagggcccaaggtgatcccgggtggtgggatccacgctggggccgaggatgggacgtttttctttttgggcccggtccacaggtccaaggacacccctccctccagggtccttttttccccagtggggggcccaatcagccccgagaccaccccaacctcaccctcctgacccccatgtaaatattgttttgctgtttgggactcctgtttaggtgcccctgatgatgggatgctctttaaataataaaaatggttttgatta

SEQ ID NO: 702539 - DNA, 279 bp, Homo sapiens
tgtctttgtttacatccaggaaaaactgataactcagattacaaaaactcttaaatttgaacgcattattgttctaattgacttataaaaataaataagtacttatattttaaatatgagacaattcttataaaaagaagaaattgaacttcttatctcaaatgacttaaatatcttggccctttaagaaaaaatcttggccctttaagaaaaaaaaagtctcattgaaaataccagtcaagaaaaagtaagctgtaatatctatggcagatgcacagg

SEQ ID NO: 702540 - DNA, 343 bp, Homo sapiens
aaaccatctataagttcatctgtgagtcgtctattgggcgtttataaagtctgagcatcttttcctgatgacagtaaagacttcacttgctcttagtcaccaaaggggtctatggttatacattctacttgctgaagtgtatcaactttgtgatgattttacaattctagaatcttatgccctaaacagtgctagggcaaaagaattccatatgaaaacactagagatacttcgagtccaaaaatacatgctgactttctagtattagttatatggttttttaattgtttatatgtagcatttgacaaaattatttaaagtctatataattgttattcgatgg

SEQ ID NO: 702541 - DNA, 130 bp, Homo sapiens
  misc_feature (5)..(5): n is a, c, g, or t
cctantgcaggtgaatgcattattactagaaagtgtgaatctatgctatatgttccgaaatcctaaatggtttggagtcgcgtggtgtttgaaatataggaagcatggtggcataaaatgcgctcatgta

SEQ ID NO: 702542 - DNA, 859 bp, Homo sapiens
  misc_feature (18)..(18): n is a, c, g, or t
  misc_feature (46)..(46): n is a, c, g, or t
  misc_feature (71)..(71): n is a, c, g, or t
  misc_feature (123)..(123): n is a, c, g, or t
  misc_feature (125)..(125): n is a, c, g, or t
  misc_feature (139)..(139): n is a, c, g, or t
  misc_feature (143)..(143): n is a, c, g, or t
  misc_feature (170)..(170): n is a, c, g, or t
  misc_feature (176)..(176): n is a, c, g, or t
  misc_feature (178)..(178): n is a, c, g, or t
  misc_feature (185)..(185): n is a, c, g, or t
  misc_feature (194)..(194): n is a, c, g, or t
  misc_feature (198)..(198): n is a, c, g, or t
  misc_feature (203)..(203): n is a, c, g, or t
  misc_feature (207)..(207): n is a, c, g, or t
  misc_feature (212)..(212): n is a, c, g, or t
  misc_feature (217)..(217): n is a, c, g, or t
  misc_feature (230)..(230): n is a, c, g, or t
  misc_feature (260)..(260): n is a, c, g, or t
  misc_feature (264)..(264): n is a, c, g, or t
  misc_feature (274)..(274): n is a, c, g, or t
  misc_feature (317)..(317): n is a, c, g, or t
  misc_feature (321)..(321): n is a, c, g, or t
  misc_feature (332)..(332): n is a, c, g, or t
  misc_feature (347)..(347): n is a, c, g, or t
  misc_feature (358)..(358): n is a, c, g, or t
  misc_feature (380)..(380): n is a, c, g, or t
  misc_feature (421)..(421): n is a, c, g, or t
  misc_feature (464)..(465): n is a, c, g, or t
  misc_feature (468)..(468): n is a, c, g, or t
  misc_feature (751)..(751): n is a, c, g, or t
  misc_feature (763)..(763): n is a, c, g, or t
  misc_feature (847)..(847): n is a, c, g, or t
cccggctcctccagctcnttactcctcttcctcctcctcctacaantcaggcttttgggggataaatgttntctctcggcagcagaatgagcaggcaggtggtcagttccagcaagttccgcnangtgtttggacagcnggcnaaggccgaccagtgatatgaagatgtncgcgtntnaaagaanaactggganagtngtttntgtnttgtnaaacntaagtttgtggcnctgatatgtgaggccagcgggggaggggcnttcntggtgctgcncctgggcaagaatggaagtgtggacaagaatgcgcccacggtntgtngccaaaaagcncctgtgctagaaatngaatggtgaangaacaatgaaaacgtcattgcnagtggctccgaggactgtacagttatggtgtgggagatttnggatgggggcatgatgttgtacctgtgggagcccgttgttaannttnagggtcacaccaagcgtgtgggtattgtggcatggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcattttgtacctcctgccgtgacaagcgcgtgcgcatcatcgagccccgcaaaggcactgtcgtagctgagaaggaccgtccccacgaggggaccnggcccgtgcgtncagtgttcgtgtcggaggggaagatcctgaccacgggcttcagcggcatgagtgagcggcaggtggcgctgtggggacacaaancacctcgggagg

SEQ ID NO: 702543 - DNA, 907 bp, Homo sapiens
gagagagagagagagagagagagagagagaggagagagagagagagagagagagagagagagagagagggcggctatatggctgtgcatatatccaaaaagaggatgtgtgtcgcagatggtctctcaaagctgaagtgagtgatctctcacgcgggagctggctgaatatggcactctggatgtaggagcgccgcagatgataacacaccacacagagacgagaatctccatcttcatctcttaccccacacaaaaaccacgatgatggtgcttccgtgggaagaagagagcggccgccggcgctactgccgagcacgtcgtcgcgcgtgtaactacacaagaagagtgtgtcgtctcccacaagagggggcgatgtgtaggcagctattagctgcgtgaaaagcggctgcgcatcatagagtcgtcgtcgtgtcgccaacgctgcacaggagggatgatctctcgtgctgattaacaacatctccccgtagaggaggcggcgctgcgtggcgcggcgagcgcgcgccgctgatagtgtgctgctgcgctgcagaggcacacatccagtaggatgatgttggcgcgccaacagggcgatggcgaggaggcttgtggtcggtcgtcgttgaagaacaacctcccgaaagcgaagacgagggggtctaaatactcctatggagacgcttggtggtgggtagttgcgcatgagaagtactacccaagaggaggagaagaccctctgtttaatacaatctaacggtaggaacaacgtgggttggcgccgccagtgttggtagcaacaagaagaaggtgtgctgtcgtggagctaatccagggtgaaacatatccagcgctgcccgtgacacccccacggcgggaagaggagccgggccaaaaaaaggcct

SEQ ID NO: 702544 - DNA, 284 bp, Homo sapiens
gggttctgatttctccacattctccagtgaagtggcatctcactataattgttgatttgcatttccctaatgactatgttgaatagttttgcatatgctttttggccatttgtacattttccttgaggagatgtctcttcagatcttttgcttattttaaaattgtgttgtctttgtactgattgtaggactctttatatattctggatgcaggtccttatcagatatatgatttgcaaatatatctccatcctgtagttggcttgtacttcctggtggtatct

SEQ ID NO: 702545 - DNA, 381 bp, Homo sapiens
gtgagcacaatgtatgctcaggcagaggatgtctatctcggcatgggggcgcatcactgtgctagaaggcatcctgataactctgacgggctgctgttgagacttgccaagacatatgaaaccactctacacaaatgctgtaccagtgtagatcctcatgaatgctatgacaacgtgtgcgatgaatccaaacctgtcggggaagagcctcagaatttaatcacacttacttgtgagctttatgagcatcttgtagagtacaaattacataatgcactattagatcgatgcaccccgaaagtaccccaagtgtcaacttcaactattgactaggtcatacgactcctatggtgggcatctgttaggaacatcctggcgtgt

SEQ ID NO: 702546 - DNA, 1172 bp, Homo sapiens
acaatgagagcacccgacagaaacgacgagataacgaactaacctactttaaaagattagatcacatactacatttgcgacagaattcatgagatgttaggcaacgagcagtcaacctcctgtctctgatttaacgtcggcacacatgcagtttcaactctcgcgcaaagctataggtatgcaaccgaatgtggggactcagcacgtttagcaacaagatatgtctatcccaggcttgatggagaaagacaataaatggcacagatatgggacacagcagggcacagagcgatatctgagctataacgatccagcatattcatcgggtggagcttgtcaggttgccgttcattggtcttcatgcaccattgtctaaaccatcctccacgataatgcaacacatgtcaccaagcggcactgggcctgcaacagcaacctgcaggcagcaatcccattgccttgcattcaggtcacaccatttggttccatcgcattgccttggatagggagcgacatcaaagcaagttcggattctaaaccggtcttatcttcccagggccagttaccttaaccagggcatttgcacaccgccaacacgacacgccgtttttctggccaagtaaacaacacagacaattggggtttttggttccaatttccattctgccagccagcttttccgtgggcgcccccttaagaaacattcttaagcgcaaacactttgtttacgaacaaggcctttggccatttttttttccacgggaaaccaaaaattcttatcttacaaaccaacggacggcactttttttcaacccccgggcaactttgggctatcttccttcccgaagacaaaggcccaacaacttggtttcgaagacaccacaggaaccgggccggacacaacactatttgaaccgacttctgtgtcctatctcgcccaaaaaagggcgaaaaccgacaattggtttggggggtattactcctttaaattttccgccattggttttttccccgaaacccaaagagaccgaacttgtgagaacatgagacggcaaagggcccacacacaagggggtgggccaagttggaccttaggtcgtccacgaaaaaaccgaattctttcaaaggggccaatttattactttccttttactttgccccccttaggaaac

SEQ ID NO: 702547 - DNA, 356 bp, Homo sapiens
tatccttatgagattccaccccgaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtg

SEQ ID NO: 702548 - DNA, 1237 bp, Homo sapiens
gggctccgacttggaactccctgctccgctgctgcctgcttctggcccggcagtgcagcatgcctgcccgtgcctgccgccctggccagctcccgcctgtggcccttgcggcggtccctctcctggtcccctcccggttggtcctgggggtgcgcagggggcagggctgggcgcccagggggaagctcgaggggacgcgcgccgcagaaggctcctttgtggacttcacggccgccaaaaatctggggcgcagacgcggggccaaccgtgggcccgacttcgccagccggggtcggccttggggggaccccagaagggggggctcaccaagccccaaaagggccccggagggaactttccgaaatcgcgggcgaacccaaaggggatcagcgcacacggcgacgcggaagccgcctggacagttggagagacgaagggcggcgggccataacggcaacacaagaccaccgggggaaacgcataataaaccacgggagggttacccaccgattaccccagcagttatcgccggggagaattcaatatacccaggggggacaagggcgacgcggggctatagacccacaagggcggaacagggcgggcacacaaacccgccgggacatagtggaaaacggcccggggaaagaaatcaccccagggggctaccccaggggagaaaataaaagtccccggggcatgcggggcaccacgatacaggggaggcatactaccaccgcagtggtacccagcggtcgccagaataaagccgccctgagagagcccaacagcaggagtagacacaagccacaaacccgggggaacacaacagcatgagcacccgggaggacacacaaacctgggggcacttcggaccacgcgaagagcgccccaaagaggcgcgtttaacagagagacttgtaggaccaacaaccagaacaaacttggggagacacacaaccgcagcagtcgcagagcacacagacccaccccaagggacgaagaggaaaacacaggagtgaaaagacactgttacgctccactcacgcaccggtgtggacaccgcgagggaactaacaaagagcgagtaggagaggagagacccaggagaagagggaacacacgattacgcgtggacgccacagaaacaccattcccgatcggcgggacgagcgccactgctaaaaccgaaagggatcccaagagtgtcacacctaggcggagcacgcaagaaacc

SEQ ID NO: 702549 - DNA, 752 bp, Homo sapiens
taggtctagaaaacgcttctatcctcgtatcttattacagcttctcagcttgcttgaatattgcgatcttatgcatttgcccgtacttgttacaagtcctgtgtgcccgtttgccgaacgatcaggacgtagaatgaacgaatactgagcatttctcgaggaggctcatgaaaatcataagaacgtcccggatgatgctgacgggacaatcaatttatgtcctctgtcggcctctccagtatcggctaagtcattcctgaatgacttaagaaacgaaaggctcgacggatccccgtcccttaccgatgcgaattcaaaagggacattcattgggtgacgggaaacccacgaagttacacccggaactaagggggggaactaagtcgttcagctccgtacattacgttcccgccattattccttagatccagggcgaccttgagacattcgttggacggttgacaacgcgggttaggtactcccgactggaaggccccagtggggattaattagtggcttcacaacacacggtctttgccatcatctgacgcgtgtcccaagcttttgtgctttaacaacgagtgtgatgtgcccgggagggttaaacaaagaccaatttacaccggtaacgcgacgggggttattctagggacagcgctccatgaagttggagaaccaaatgtacagccacactgctaaaattatccccaaaaattgtagacatgagggcgttattccctaaagcccttcac

SEQ ID NO: 702550 - DNA, 369 bp, Homo sapiens
atgtttctgagcatttcttagcccagttccccagtacgtattattaacagcacctcattatttataaaattcttgggtgggcacagtggttcatgcctgtaatcccagcactttgggaggccgagcaggtgaatcacctgaggccaggagttcaagaccagcctgaccaacatggtgaaacctcgtctctactaaaaatacaaaaattagctgggcacagtggcgggcacctgtaatgccagctactcaggaggctgaggcatgacacttgctcgaacccaggaggtggaggttgcagtgaccagagattgcaccactgcactccagcctgggaacagagcgagaactttggccaaaaaaaaaaaacaa

SEQ ID NO: 702551 - DNA, 122 bp, Homo sapiens
cccttagtgttgtggtctatttctagtgtagtgttatcgtctttgtggttgctgatgccggtgtgtgtgtgctgtcggttggttattgtatcgccttttagtgttgtgtgtttgttctagta

SEQ ID NO: 702552 - DNA, 414 bp, Homo sapiens
  misc_feature (3)..(3): n is a, c, g, or t
  misc_feature (56)..(56): n is a, c, g, or t
  misc_feature (93)..(93): n is a, c, g, or t
  misc_feature (112)..(112): n is a, c, g, or t
  misc_feature (121)..(121): n is a, c, g, or t
  misc_feature (134)..(134): n is a, c, g, or t
  misc_feature (153)..(153): n is a, c, g, or t
  misc_feature (165)..(165): n is a, c, g, or t
  misc_feature (222)..(222): n is a, c, g, or t
agngccgtaactaatgtccctcaacaggtccagctgttactgtccggcctttttanaatagcctcatgagtaggggcttctttaaataatccngacatatctttggcttatncgactaagncagacgtatatgnatgttttcattcctgtttngtacgagtgccntcattttgtagtcatgaagtaactagtaccttaataaaaatgtaatgactaatctanggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattg

SEQ ID NO: 702553 - DNA, 365 bp, Homo sapiens
agacagtaaccagcagatttctcagcagaatccctgcaggcataaaagggtgggataatataatcaaagtgtagaagaaaaacaaaactggcaaccaagaatacttaactcagcaaagctattcctcagaaataagggataaataaaaactttcccaaacaaacaaaaactaagtaagtttatcaccactaggcctgcctaacaggaaatgctaaagggagctaagctgaaataaaaggctcctaattgatacataaaacttataaaagcaaaaagcactaaatggtgtaagtaagacatagtcatattcagaataatactgtaaggatgatgtgtaaaggaattttctctctccccggatacag

SEQ ID NO: 702554 - DNA, 255 bp, Homo sapiens
  misc_feature (43)..(43): n is a, c, g, or t
  misc_feature (219)..(219): n is a, c, g, or t
aggatccgtgaattgacagaaggacagcagtcttacaacaggntagcagtcatcagtgcttgaacctctcccccttggactcagccaggagcagctgctgtctgtttccagaaattaagggggggcgcgagcaacatcgctgaccttcagtgagtgcatgtaaaacatgttttccagaaccgggcaggggaccccgaggccagactcgctgaccttcangtgaagtgcaatgtaaaaggtgtggtttaggggttg

SEQ ID NO: 702555 - DNA, 738 bp, Homo sapiens
gttctatttgagatcaatgacggagaggtacgtaatatcctgacaggtaattcagatacagactatgtattatgtgacataatgtatgcaaaattataaaaagatttcagtttacctagttgggattatacttaagaacactttcggaactaatgctcccagacttgcccacgatttgtgtattgtatcttatagccactggccgtcgttttacatgctttctctaatagtcttatttgccacagtctctattttgaatatgctcctagtttgtacagggtgctgtcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaacaagaagagctgcagctttgacagtgcttatttacaagaaaaatactgctggaaaatttcccaatttctactacgttcaccatctctagtaagatctgacatatgctgaagttatgtttgatttgggcacccagcatgttccatgatgggttacctcgcctagtcacaaa

SEQ ID NO: 702556 - DNA, 103 bp, Homo sapiens
aggtgtggatggagggtctgcagtggtatcactgtgggcagagcctgggtgaagaagtgagccttgtactttccactcgcgacagaaaaaccccatgggacct

SEQ ID NO: 702557 - DNA, 454 bp, Homo sapiens
  misc_feature (90)..(90): n is a, c, g, or t
cctcgacccgacgttggatctgcattgtctgcggcactctacatcacccatctggtcgagttcgactacccggaaaagttcgtctccacncaggtcggacacacctacgccgccacaaccgccatctacaccggagtctccgacgagtaccgcaaccgactcctccgccgtgccctcgatcggcaccccgacctgtgggagcagccgtgaacaagaagatgacctaccggtggaacctgcgccaactcatggccactcgtggcatgttcgcgaccaccgacctcgtcccgctgttggccgaacgcggcatccacctctctcgcgaacaagtcttccgcctcgtcaccaccaccccgcagcgcctgagcttggacaccctcgccgccctgtgcgacatcctcgacgtcggcgtcgaggatctgatcgacatcaccgccgccgaccatcaggtccc

SEQ ID NO: 702558 - DNA, 228 bp, Homo sapiens
  misc_feature (18)..(18): n is a, c, g, or t
  misc_feature (60)..(61): n is a, c, g, or t
  misc_feature (73)..(73): n is a, c, g, or t
  misc_feature (77)..(77): n is a, c, g, or t
  misc_feature (84)..(84): n is a, c, g, or t
  misc_feature (88)..(88): n is a, c, g, or t
  misc_feature (91)..(91): n is a, c, g, or t
  misc_feature (96)..(96): n is a, c, g, or t
  misc_feature (108)..(108): n is a, c, g, or t
  misc_feature (114)..(114): n is a, c, g, or t
  misc_feature (152)..(152): n is a, c, g, or t
  misc_feature (171)..(171): n is a, c, g, or t
  misc_feature (212)..(212): n is a, c, g, or t
gatgaagtttaatgaaanttttttttgaataatgtagttgttatgatgctttgggatgcnntggtttgggggnattnaggtgcnttcnttnattcntgtgggaacccngggttnagggccagggcctccttggaataaatggttattgttantaggtccccaccttccctnttttttggaagccaaagtcaccctccccaataaagtcctcnctgccaaaaaaaaaaa

SEQ ID NO: 702559 - DNA, 518 bp, Homo sapiens
  misc_feature (423)..(423): n is a, c, g, or t
gccgacctactactactaaattcacggccgctcgacccgggagcagcttcgttgcgtgtcaggccatcgcaattcggaaacactcggatggtcaaacaccacgccgggatgaacgtccagctgcaattgcttgcgcaacgccgacaccagtttgatcaccagtaacgagtgcccgccgagggagaagaaattctgctcgatgctgagccgctcgacccccaacaactgcgccatgccttccgccaacaaggtctgcaacgcggtacttggcgccacatagacctgcgccgccagcagcgactcgggtgccggcagcatagacggtccagcttgccattggccaaacggggcagatgctccagggcaaagaaatgcgccggtaccatggcgcccggaaggctcgcattgagctgctcacgcacnacgtcgagccaaccttcggcaggcgtcccttgcgcctggacatacgccaccagttgcacattggcctcatcaccttcgcacgcacgccaggcagt

SEQ ID NO: 702560 - DNA, 139 bp, Homo sapiens
  misc_feature (83)..(84): n is a, c, g, or t
agcggattgcgcaggcgcctcaggaagagctcggcatcgcccctcttcctccaggtcccccttccacacaacatacgagcaannagtgaagctgccccaatcagtcacaatcaatgacaaaaaagagcaaaaaaactta

SEQ ID NO: 702561 - DNA, 253 bp, Homo sapiens
tctagagttcccgggctcggctatctgtccagaacatcttcctttttttgttttagtttcttttttggagatgaggtctcgctatgttgcccaggctggtgtgcagttattcacaggtgcacccacgggtcactgcagctttaaactcctgggctcaagcgatcctcctgcctcagcctcccaaatagttgggactagactgcacgcaccaacacgccatgactcaggacattattcttaacacgataggccg

SEQ ID NO: 702562 - DNA, 149 bp, Homo sapiens
ggtatatcggcacaaccagttacagatttctttgttcttctccactcccaaagtcgctggaactgcaggtgtgagccactatgcctgggctctggacgcaattttgaaaagcaacctgcagcctctgtagggtgcctgatgaatagcga

SEQ ID NO: 702563 - DNA, 1056 bp, Homo sapiens
gggtccttcaagtacaacttgcaagatcttcccccttactatttgtatgggtattccgcgagcattcctagtagctatccttgtgaggcaagacggcaagacttttggacgcgtctaacttctaggtgcccgctattagcacgtagtgccatggaacctctggcatgtaacttaacagggcggtctggtgatcacatcggtggctccattcgctctctagtgaatttcccacactggtatagatggcctcaaacgccgcaaaggtccacaggatcctgggtatgattcgaacacaagtgccaccgccaaagagggcattgtcttatccttatcggtggaccaaagccacaggggccaccaagtagggccatatctgccccgggaatggtgttccgatgcttatacctgcgagcactcgagccctgggcgacttaccgttgcagagacctcagttgtgtccgcctatcctccctggctagctgtctagccatggttgatgagacggtcagatgagagaattttgctggggccactttgaggagttaccttgagggtgaatgcctagaccctttatgtctctcaaggagaccctggatcactggggcactgcgccaaattccaagacaggcattctctggagagtgaactggggactagcatgagtatataaagagttcgaagggagacgtacaggaatagggtttggcctgcgctgaatagaaggcctggccagggcgtcaccccgtcactctggatcctcaccctaggaatgctgattcagtttcgggcattactgtagaaacctcactcaggcaagaacgtacagaagataatcctgctgcgaggtgactcgtggaagagcagagccaccctgcccaggcttgtatactatggctgccacagctcatgcatgaggtatctggctgcaagacaggcatgagcgtaccatgagcaggatcgagcggcttgataatgaccccaacatcatcatctgatggaacgtgaggctggtagtgactaggatggacacattgctgtgggtagtccattacatcc

SEQ ID NO: 702564 - DNA, 549 bp, Homo sapiens
actcatgtaaagctcattgtaatagatgtagtttttctaatctacatttttattgactgtcatctatcaaaatattgacttaaatcctgtaactatttgatttcaagctttaaattgatctggtattccttgcggggctccagttgcatctaaatagatgtgagagttgaaagacctataaggagcttctctcgctttatgatggcttattttttttttttcctctggttgatgaaatgccagggtaaaagggatagccaaatggactaaagcacaagtgccactctagttattcagcagagtgcccagtaaaggtccaccacaataccaccatacatccactcggggatgaacagaggctgactgattgataagctcttgaaaattcttaagctcactgcatcccttcaggtctccaaggaatgctaaatctcctccctgccatgagagacaagaagtgaacttagtgttgggagacataaattggatggccctccggggctgaccccccagggccttaggatttttcaaaaagagcttggcatgact

SEQ ID NO: 702565 - DNA, 185 bp, Homo sapiens
tcactctcctgcacattgaatgtccactctctcaatgcaacctgggcacttttctggcatactcatcctcacctcatgttttcccacagttgctttttctccccccctctcttcccagggcataccatttgtcttcactgtcgggctcgtcgggggggtcacgcgctcgcattcgtactcctggt

SEQ ID NO: 702566 - DNA, 1376 bp, Homo sapiens
  misc_feature (11)..(11): n is a, c, g, or t
cagccaccctnccttctttctcgctagactacatcatctatagcagagtagatagactgagcaagacacatagatccatagatcgatctcggtcgtgttatcacatcgctgttcgttgttttgtcagttaatttatcactgcggtccgcttgtcactgagtgtattcaccctcttcccccgatggtggcgctggctgagactccacctctctagtatgtactaccatgtgggggttttaccccaacttttttctggggggcaacacaacatggaggagccacagcgacagtaacacaaatgtcccacttgttcctttccgcggagtgacctggttcctaaatgtggcccagagaacccccctgattgtccccagtcccatttccgacggcaccctgggagaaaccaacgcccacgactttttggggaaaatctgctgcccgtctatattccgggggaaattttgggccttttgtgttcacccacaagggggcccttctccgtgagatttccaggggaccaattgtcgtgccccacattgaagggtgccacaacttactttgccaccgatggctgtggggccccatgtgccacccaatagtaggaagtccaccttgtggcccaaagcgccagaagacaactggttctctcggggccctgaagaaagaccccccccttttttcccaagaccttttaggtatcgaccccccgtgaaatcctccccaggggccaccccattggaatctctgagtgatgtgcagcctgatccagacctggagaaccaagatggggagacccaactgatagaccaccccttgctgaacactgcgtcaacatctgtccccccttttcctttgggctggtcaatccaaccaaggtgttcgacacaatggcaacactttacacaccctgaaagtgccttgaatatcacccgagagggaaactttgcacattttcgcttcctggaagggtgtcccccaatgttgccacagtgtctgtctgcacgaattggctaacccacaactgttgcacatcacgtatcccccattttattcactcacaacggggaacacacaacgagagtcctggccctgtctgtggagacggagttacacccttcccaccttgctgaaaaggtcaggcctttttggctgagtccactctgcctttgtggctgctgcccccgtggctgctgcccccaccagctgctcctgctgctgctgcagcccccagctaaggttgaagcccaggaagagtcggaggagtcggacgaggatatgggatttggtcttcttttgactaatccacccacaaaagccaacccaacttagcccagttttatttgccaaacacaggaaattaaggcttacttttttta

SEQ ID NO: 702567 - DNA, 508 bp, Homo sapiens
ccttgagcacagagacttgccctgccgcccacattggatttttttgttttaagggcgggacactgaaaactgcatcttttttttacccagaggcagagtgaccaaagcgccctcgtaactgttataaccctttcccacccagcttcttggccttcccctaaaggacacgggccaaaggggtaggggctatgcccccgggaggaaaaatgtcccccattggtcaaaaagcctccctctaagaaggtggttttgcccctggcttggggggtcgcaccttggccccaggggactgtggggaccagggggcctgccctaatatccccttctcgccaagaccggaaaggggaaaaacctgggggccttttcattagggagacacttcccccggggtgaccactgacagctagcgtaattttttttttccagggggcccaataaacttcaagggtggacattaagatttgggccagttttttgggcaaccaaatttccggcaacttttgaataa

SEQ ID NO: 702568 - DNA, 330 bp, Homo sapiens
tatgaattactgcttcataccatgtttctcttcgtccttcgattacttgttaacacctatgagtatctatgaaccattacacttctatgcctcctcctcctcgcatggccattggccgcctgtacacaagaaatgcacctcctccacgaattgcacttggatgagtaggagaagcagctggatgttgcccgggacgaataggtatagcaatctgtgcagaatgccctcttctggccatattctatgacctgaactgcttcctttatgcgatctacttcttgctgatagcgtaagcgatcacaagatgcattttctttagctactttctgt

SEQ ID NO: 702569 - DNA, 625 bp, Homo sapiens
cccaagcgcttgttcagctgtacctggcgtccatggaggcttaggcgtgttttatgttagcgccaccgccgttcctcttcacatcgcttcatgagtaagtaccgaggcctcaccaatgccggcgggaggttctactgcacccgcgagcaccctgagacatccagaccgaaatgcgctccagcgttggggcgaagattggatagccagacagaatgaaacagcaggcgactctcgcagtgctgaaagaaaactacgctggacggcccggggcaaagctacccatgcccaagaatcactgagctgtgatgctggaaccatacctggggatgaaggtcacaagagaggcgagctgacgaaccttccccttcgtgtgattagcagggcggacttgagaacagacgcccgcaggcgaaccaagccaggccgactggggtcctatctgccaagctttctaagttgaaaacaagcccacattgtggtggaaacaaaatcaaaacgtgcggccccttttatccaccgggagaagggtgccccacattatgattcactctcgcatgaggtcaacggcgagcggctatgttgccaatgaatcgcatccctccccggcagggtttggtcgccctct

SEQ ID NO: 702570 - DNA, 439 bp, Homo sapiens
caattttttaaatgaacaacagatttgagcagatacttcatcaaagaaaatgaaaatgtatagcacttgaaaagatgtttaacatcattagtcattagtgaaatgcaaattaagatcaccatgagacattactacatgtctgttagaatggagaaattacaggtggctcacacttgtaatcccaacacttgggaaggctgagactgcgagatcaattgccctcaggtgttcgagaccagcctgggcaacatggcgaaacccctaggaaatctctacaaaaaatactaaacattagccaggtgtggtggtgtgtacctgtagtcccagctactccagaggctttggtgggaggttggcttgaacccaggagagggaggttgcagtgagccaagattgtgctaccataccccagcctgggtgacagagccagatcctttct

SEQ ID NO: 702571 - DNA, 135 bp, Homo sapiens
ttggcccccccccggggtttttttccccccggttttaaaggttttggggaggggcccggcccccccctttcccaaaattttaaaaaatttttttaaaaaagggtaaaaagggggcccgcccttttggggttttta

SEQ ID NO: 702572 - DNA, 256 bp, Homo sapiens
ctatgttattaccttcccctacattggaagtactgagaaccattaactcttgacccaaaggttaagggatttgctactggtcccttacaggaccattaaaaatgagactatattcacttcactaaaatttaattgctaaagctaacttatgcacatctattaaactaaaagaaacgactttaaccctcttccgttgtttttaagacaagcactcctttacagggagaccagcctttaggtagggtaccgagctcca

SEQ ID NO: 702573 - DNA, 246 bp, Homo sapiens
aagatcatgcagtttgaaagcttccatcttctgatgagagatgttctacagaacttgtcacgtctttgaaatttagaatatattgctttcataatacgaattttactgccccactgaagtgtctaatttttcaagtttgtaagtttattaagtggtttcaacattttttgtttgttcgttttgactatgaaaaagacagtttaaagaaaagccaaattctattaaaacatttgcggcatgtttgta

SEQ ID NO: 702574 - DNA, 279 bp, Homo sapiens
ctttgccctgcctgtcctctgtctgaaatggtctcctctagatttttcaaggttggcttttttcttgtaaatttgtttgagttcattgtagattctggatattagccctttgtcagatgagtagattgcaaaaatttcctcccattgtgtaggttgcctgttcactctgatggtagtttcttctgctgtgcagaagctctttagtttaattagatcccatttgtcaattttggcttttgttgccattgcttttggtggtttagacatgaagtccttgcc

SEQ ID NO: 702575 - DNA, 1178 bp, Homo sapiens
  misc_feature (1)..(1): n is a, c, g, or t
  misc_feature (11)..(11): n is a, c, g, or t
  misc_feature (284)..(284): n is a, c, g, or t
  misc_feature (389)..(389): n is a, c, g, or t
  misc_feature (443)..(443): n is a, c, g, or t
  misc_feature (544)..(544): n is a, c, g, or t
  misc_feature (686)..(686): n is a, c, g, or t
  misc_feature (691)..(691): n is a, c, g, or t
  misc_feature (755)..(755): n is a, c, g, or t
  misc_feature (762)..(762): n is a, c, g, or t
  misc_feature (786)..(786): n is a, c, g, or t
  misc_feature (792)..(792): n is a, c, g, or t
  misc_feature (863)..(863): n is a, c, g, or t
  misc_feature (879)..(879): n is a, c, g, or t
  misc_feature (1086)..(1086): n is a, c, g, or t
  misc_feature (1090)..(1090): n is a, c, g, or t
  misc_feature (1156)..(1156): n is a, c, g, or t
  misc_feature (1165)..(1165): n is a, c, g, or t
  misc_feature (1178)..(1178): n is a, c, g, or t
ncccccacagnctcaatagtacaccttaccaatatactaacactacaatttccaacacgctcaagatctcctcacactctatccactctgtcctcggaagataatattatagatctaataaatctttacccactcaccgacaaaccgcgcccgatcccccgtccacccccacacagcccctcacacgcccccgaccgtacaccccacgcttgaagggtgagtaagatcgtctaacatgaagaagaaatctaccagcacatgtacagcgataagagacgaaccanaagaatcaatacatatatcccgccacaccctcgcacacctatctcacctcgccactaccataccaccccaccacgcccaactagttcgtataattataaatatantggttgggataacgacggtggacagtaagataattggatatttgtctatatgcntatgtaataacacactcctactaattgcaagcatatacttataactggatactactctactaatagagagtgctgttgcgaggggtgtgttcacgcccccntccatttggcgctcactgacgtactcactcaccgatcggtccgtcacctgacttctgtcacatctcgcctcgttccccatctacttacgcccgcctcccactcccacagctatctcacgctcacgcgctaggtgctctctcnaattntgtattcacctttgatacgtctctcctcagattgtctcttcttactcacgtcacacaacttacntccttcntcatacacctccacacatctatancatacnctccacatatacctacacacgctcctctcacatgtgctcgtcagctaccttcgctctcgcgtcgtaccatntcgtctcttacttcanatctctcaccatagtaccacgtctcacgccgcactgtgataggaggagtactaagctcaacacacactccgatatactgtccatacacgccatcactgtatcacctactccactcatcaacattcactagtaagacatatacacaagactacatactctgactgtacctatcatagactgtaagtaagtaacatgatatcgcacgtnatanacgtgtaacacgtcgacatacaacgcagacgtagtatgcgacgcgaacacatccgctacgatcgcncgacctcangagcgatacatan

SEQ ID NO: 702576 - DNA, 441 bp, Homo sapiens
gtatccgctgggacacctgcttctggtttcgacgaggaccacgctccttgaccacctggcatgctggacattttgatttgcttgcagctgggggggctcctgaatcccagggctggtagcgtgtggtcgaaggcacctgaccttgcataacagttcggattggcctgtcctgctgagaagccaggtgggaggcgtttaggcattcctcctaggcctggatgtaaactctgtggcccctggtaaggagatagctgctgcatcaccatgaagttaggtcgcacatttccctgttgaaccataggattccgacccggagagctgacaggctgctgaaatccctggggaagtgggttattttgaggtggccttggtcccatctgctgctgagtttggttaaccgtaggggaggatgcaggggatccctacggtgcgttggcccaa

SEQ ID NO: 702577 - DNA, 210 bp, Homo sapiens
gaagacaaaagagatcgaaaaacctatttcatggaataatagctgaaaacttcccaaagtctagcaagagaattaaacaacatccagaatacaggaaagcttagagattccaatacagaattaaaattcaaaaaaggcattcttcatgccacattattgtcaaatctgtcagtaagtcaaaatgtcaaagagagatttctataaacagca

SEQ ID NO: 702578 - DNA, 190 bp, Homo sapiens
ccctgtctctactaaaaatacacacacacacacacacacacacacacacacacaaaaaaaaaaaaaaaaaaactttcccctgttttgggtgtccccctttgttcccccagctcctcggggggcggggggggcaaattcgcttgcccctggcaagcagagcttgctgtgttctgaaatcgcaccattgacc

SEQ ID NO: 702579 - DNA, 1433 bp, Homo sapiens
  misc_feature (657)..(657): n is a, c, g, or t
  misc_feature (1111)..(1111): n is a, c, g, or t
ttgtggggcgtcccacacacccaggggcgcgcccgacgcggaatgagtagacccccctgagcacccgggggggggccccccaaggcggaccccccgcgaagaaagggagcgcccgcgctcttgtgagcaacacaaacttctgccggggggaacccccccgggggctaaaaactcacccatggagcccgtccccctgtttgcgcgaccaaaagcctattccctcgggcgcagactccttctcgcgggggggggggaccggcccatggtgaaaaaggttgggtcgtgcccgcgccccacaagcaaaccaaccggtgttagagcgcccgtgtagccacgtctaaagacaacacacccggggtggtaaccacgcacctgtcctctccccgggggccctcgttgttgtcccggggccacttggagggagagaaggagttccggcgtccagtatatgggaggaattaattgacggcggttggtgacaccaacgccgcacggggggggggctccgccccgggtggcaagacccagtgttttgaccttgtcggttgtgcgcggaaactcttcaatacagagggccgtcacgcaacaggtattgtatcccttctctttccgcgcaacagggtggcgcaaccccgtctccgcaccgaagattgtagngagctatttccctctttttcgcaaaacacccccccccggcgcacagatgtatggcttggtgcgttcggttgttctctcccccctttcgcgggtacgggtcacgcccacctggggggatatttcctctggttcggggtggggcgtcttccacagctgggggtgtctttacacagtgtctctgtgttctgtggcgaccccgcgagttggagagactctttctccctctatgtttggtctctggttgaaaagggcgacagaccacaaagggcactcggcgtgagatgtctaaactctctcgtggtacaccacaatggggcgtgtttaactaatagtggagacaaacggttttcccccgcggttctatagggagttctgagagaatggttgaaacacaccggggagagcctctttcacaggcgcacctttagtcccacggcggagaggctttttttgngggggaaaacaatatactataaccggagcacgaagcttccctacgagacgtttccacccgccctgggggcgtgacacccatgcggccccccaccgtgagaactcggttgtaaacggggctgggagaaaaaagcacgagagagaattgtcacgacgaatcagacttcctctttccacgggcctcagctgccctcccacgtggtgggcccccctcgtaactgccccgaacgagttccacccgtgaaactacccattttttacttggttaaaaccgcttttgtatcattttggtataaaattattgggttaaaactgtgttaaga

SEQ ID NO: 702580 - DNA, 718 bp, Homo sapiens
  misc_feature (425)..(425): n is a, c, g, or t
  misc_feature (476)..(476): n is a, c, g, or t
  misc_feature (491)..(491): n is a, c, g, or t
  misc_feature (512)..(512): n is a, c, g, or t
  misc_feature (545)..(545): n is a, c, g, or t
  misc_feature (562)..(562): n is a, c, g, or t
  misc_feature (593)..(593): n is a, c, g, or t
  misc_feature (608)..(608): n is a, c, g, or t
tcagtggctcacacctgtagtcccagcactttggaaggttgaggcaggcagatcgcctggggttgggagttcgagaccagtctgaccaacatggaggaatcccgtctctgctgaaagtacaaaattagccaggcatggtggcacatgcctgtagtcccagctgctcgggaggctgaggcaggaggatcgcttgagcccaggaggcagaggttgtggtgagccgagatcgtgccattgctctccagcctgggcaacaagagtgaaactccatctcaaaaaaaaaaaaaaaaaaatagccctatgtttaaatggctcaaagaaaagactataaatggaattgaacatgtttgttagctgtttgagcattttatattggtaaattttttattttcttattttttgtcttacagtcgaccaggctggantgcagtggcaaatcatggctcactgcagcctcagcctcctgggctcaagcnatcctcctgcctcgncctccccagtagctgggactncaggtgcacaccaacatacctggctgatttttntgttttttgtagagacngagttttgccatgttgctcaggctgatctcnaactcttgagctcangccatctgtctgcctcagcctctcgaagtgctgggattacaggcctgagccaccacaccttgccaggaatttttaaatctaaccccctgttctattgcctagccctacat

SEQ ID NO: 702581 - DNA, 650 bp, Homo sapiens
  misc_feature (444)..(444): n is a, c, g, or t
tcagtggctcacacctgtagtcccagcactttggaaggttgaggcaggcagatcgcctggggttgggagttcgagaccagtctgaccaacatggaggaatcccgtctctgctgaaagtacaaaattagccaggcatggtggcacatgcctgtagtcccagctgctcgggaggctgaggcaggaggatcgcttgagcccaggaggcagaggttgtggtgagccgagatcgtgccattgctctccagcctgggcaacaagagtgaaactccatctcaaaaaaaaaaaaaaaaaaatagccctatgtttaaatggctcaaagaaaagactataaatggaattgaacatgtttgttagctgtttgagcattttatattggtaaattttttattttcttattttttgtcttacagtcgaccaggaggatcgcttgagcccaggaggcanaggttgtggtgagccgaaatcgtgccattgctctccaacctgggcaacaagagtgaaactccatctcaaaaaaaaaacgcagccaatctcagtggctcacacctgtagtctcagcctctcgaagtgctgggattacaggcctgagccaccacaccttgccaggaatttttaaatctaaccccctgttctattgcctagccctacat

SEQ ID NO: 702582 - DNA, 797 bp, Homo sapiens
gaacagaaagatccggaaactgagtttccaacagtgaaatacccgaatcccgaataggtgaaaggtgtcttgactatgtattatgcttttggctgacaagaaccaaggccagaattgttttagctacacgacccggatgctgatagacttgctgtgggagataaagcatagacagtggtgaatggagggtgttttcaggcacagtgagttcgggggccctcctgggtctggtggctttttacatcttggaaagagaagaaccaggatcgcagtgctctcaaagacacgtacatgttgtccagcaccgtcgtcctccaaaatcttgcgggccattgccattagaggaaggttttcatttcgaggaaacattaactggctttaagtggagtgggaaacagagccaaacagctaatagaccaggggaacaactgttcttattctgcattgtgaagaagctattggatacatgtgctgcccttttgttctggacaaagcatggagtcagtgccgctgtcataagtgcagagttggctagcttctagcaaccaagaatggtcttggtcgtcagcaagctaaagggcatttcatgtgggagtatggtaccatattactaaaagcttcctatttaatctgcatgatcaagaaaccattgcgacactttttgaaaaccttcagaacttacatggaaaacaataatattcccaaacttgttgcaaattgaaattcttggcattagggacttacaatggcaagaaaaattgcacctggtaaaaagggtctccgcaggaaaccgcaat

SEQ ID NO: 702583 - DNA, 426 bp, Homo sapiens
catcaaacaacaagtatatatcaacaataatcctgtattacttatgactgaatcactattttcacagaaactttcctccctaatgaataagaatgcaaactccaagtgtatatcgggtgctgtgagtaacagaagcttgagttagccccatcagcttctgcaaaggttatttttacatcgtctcatgcttctgtgtctagggaagttctttttcctgggaaaagatttaactaagcacaaaactaaacatccagagcagggatcagggaagaatgcaggcgtacttaagtgaacacatatcagcatcagggacatctttctcttaacacactggaactggtagagttgaagacacttctttcactcaatacttccatcattctttgtatccatacagctagagggtccacacacacaattaacttg

SEQ ID NO: 702584 - DNA, 182 bp, Homo sapiens
  misc_feature (143)..(144): n is a, c, g, or t
  misc_feature (157)..(157): n is a, c, g, or t
gatctagaggactcgggagtagtcaagtcacagcatctcagctacattaacagctgctgtaagatcaaaagatctctgcagatcaggaaacgagtactgcgatttatgcaccctctgcacacaatatacctgctgtgttactnnaccatagagctgngtaagattcattcgaaatatttcaa

SEQ ID NO: 702585 - DNA, 373 bp, Homo sapiens
gtttgtattgtggtatttattattatgttccttattacgcagtccttgtgtgtttgttgtggcagtgtatgttggttgaacatgtgcgtttagtgttggtgtgtttagaattcttggtgtgggtttgtttgttatggtgaggcgtgtgtgactaatgattccccgcgtccctgtgttttagcccacaatcttttgggtgaggggtgaaaacgctctagtacctctcctaaggattcaagttggtgaatgactcaacatcctaccccttgagattctcaaataattattttgtcgatttttccatgttttgatggttaaaaagtttgtccctaaaagtggggaggggtgtttttttaaaaacgcccatataaaa

SEQ ID NO: 702586 - DNA, 139 bp, Homo sapiens
ctggacacctgctctgctatataaactgaatcttgggcatattttctaagaattcttttcttttagagacagtgtctcgctctgtcacccaggttggagttcagtggtgccatcatagctcactgcagccccgaatttc

SEQ ID NO: 702587 - DNA, 357 bp, Homo sapiens
agccagaagacaagttacaatggtcttaagaaacataagaggatggggggagaggttgagtcctcgttgactatactttgagcgatgtggacaaaaatatgctacagatgatgcaagtggatgaacacctggattgccatggggacgaactgatgccgattcttcaggagatgatgaaccagattgactatgatggcattggctctgcctctcaagctgaatgtgtccgatctggggccagcaccgggccactgctagtgctgctgggtctggaaatgactctgaaggacgacggacagcacatggggaggcccaaggggttccccagaccagtctactgcaatctgtgcgagtcaa

SEQ ID NO: 702588 - DNA, 1181 bp, Homo sapiens
tagatctctataccctgcaaagatagctgtttacaatgcaatgtgaaataaagatatttccagacaaacaaacaactgaagaaactatttactagaaggtctaaagaaacaaaaaatcataacatgcaaattctccaagtgcaacaggcacaacattcatatggcaacatgtacacatgccagtcacggcaatgcaaacaaccaatggcaacagtgttcaatcatgtcactatacccatttggctaaagtacggtgcgtgtaccagaacagaggtacattctcatgaacccaggtaacttccagttgcttacaggtatacatggacccctcaagtaatgcacttcctaagtgcttgcaccaagagagctcaccgatataacacaacttctacaagaggtaacacgaatcaagagacagggcagcaatacttgacaaaaagtcagaagtgctcgtactcgaacaggaaaggaaacaacgatacagatacagtgtggtcaacaagtagttcactactaactgggacagtagctaattcaggcaacatgcacgaaaagcgcatcacggcaaagctccttaaccgcagcagagttacctcatggactacaacatcgcttttagaacactacttcgcacagacacgttaacaattaacttcgtaattggtcttcacaattggtggtgattacacattcatcccgcaacgagacccgttgcttgacgacagctcacagtcagatggggtcgtttcaccagtaagccagagacacacacgtagggtgatctgacaccacatttaaattccaagggttcaaacgggtgaggcataaaacgacacgtggtggtgaatcttacccagacgtggccactgacagagacaattccacaggacattgactcaatggagaagcgttggaaaatcaagtagggagttacgaggcgcccacttcaattgggccagcgatctttgtagttgagaccaaaaacggtggccagatcccacgcggcaccacagttagcacactttgtagagaaaacaacgcggttggtcccagcaactttctgataatcagtgggtcaaaatgaagatgtacaaggacaaagagacagaccgtactaagtatgctgtggaacacaagggtgaccgaacgaggcgaataaacgtggtgcgcgcacaatataa

SEQ ID NO: 702589 - DNA, 158 bp, Homo sapiens
cccggcacgcggctgcggccggcgatggcatgatcttggctcaccacaacctccacctcctgggttcgagcaagttctcctgcctcagcctccaaagtgctgggattataggcgtgagccaccatgcccggccagttccagttttttgtattatttta

SEQ ID NO: 702590 - DNA, 482 bp, Homo sapiens
tatatatacacatatttaactctgattgtatatatcaaaatctccatttaatggagtcttgaaaattgacttttaaaaacatttacaaacatccttggtgattctgatgcccacgaaaatttgagagctgctgatttcaggccaagctcttcatttcacaaataaggatactgaaacagataaggccatgctttcccagctagctcacaacagaggctggactaggacatacttcaacatagtgctggtctcattctgaagtttaccacttcctattaaagtatgaggaagtcatgtccttaatgaggttaatcagtgccgtttcacttctacgaaatactcttcttcttcctcaatgctcctttcagtggaaacatacttttattatataatttgctagaaattatttcctcatccctttctgaaatttttgacatgattgatcctccatctcattcactaccttctttttgattaatgga

SEQ ID NO: 702591 - DNA, 161 bp, Homo sapiens
ctcgcagctcggtcctgttgctaggtggagtgaagagctgtctttacacaagtctctcattaagccactgccctgcagttgactcaagccatcatcatgtatgtgcgtgtataagaaaggacactggccgggcatggtggctcgcgcctgtaatcccagca

SEQ ID NO: 702592 - DNA, 352 bp, Homo sapiens
cctagacgacctctataggacagcctacgcagaggagagcgcatcggtgagtctagcctggcagtatatcggaacatggctctgcaacacactacagaagtaacactaactcagtactgtatgcacaacccgaggacctgactgagaggcctgacagtgctacagagagtgtagtactaagctcatgcgctggaggctcgtagtagcggtgcgtcatggcctggacaggagcaagaagcaggaatcagcactacggaggcataggtcacgctcacggaatgcagtatggtctgagcagtatagtggtacacttgcgtaactggtacatagcagttgattgctcacggacggt

SEQ ID NO: 702593 - DNA, 226 bp, Homo sapiens
  misc_feature (33)..(33): n is a, c, g, or t
  misc_feature (95)..(95): n is a, c, g, or t
  misc_feature (101)..(101): n is a, c, g, or t
  misc_feature (109)..(109): n is a, c, g, or t
  misc_feature (174)..(174): n is a, c, g, or t
  misc_feature (186)..(186): n is a, c, g, or t
  misc_feature (208)..(208): n is a, c, g, or t
ggtggtacatgcctgtaatcccagctacttggnaggctgaggcaggagaatcgcttgaccccaggaggcagaggttgcagtgagccgagatcgtnccactncactccancttgggcaacaagagcgaaactccatatcaaaaaaaaaaacctgagaggacgttgcaccaatggngatgcatcaagngaaacatgtttggttttttgtnagctctcaccaacttttt

SEQ ID NO: 702594 - DNA, 355 bp, Homo sapiens
atgccccggtttaagcccaaaaaaaaaaaaatgaggcaggggtccaagtaaacccctagcttgttgccccgtgggggccccaggagcaaaaacatggaatccccacccctggggattttggtacaaattgtggggctgcatgctcctgtttaaagcttgtttcaatgggtttaaaaatttttcgccctttggtcgccggtcccctttgagaccccccttgtttataaacaaaaagcccatgttggtcctttgcccggggcctgggacattttgggctatttttgggtttttttggggccggggggaacacccaaaaaataaatcccctcttcccctgttttgggggaagaattta

SEQ ID NO: 702595 - DNA, 191 bp, Homo sapiens
cacggtatgaagtacagggctgtgcatgctctggcccagttgtagggacagtttgccacaagaagccagcagccaggtatggtggctcacagctgtaatcccagcactttgggaggccgagaaaggtggatggctagagcccaggagttccagacccatctggacaacatagcaaaaccctgtctctacgg

SEQ ID NO: 702596 - DNA, 759 bp, Homo sapiens
gaatcagacggacgtggacgcccccggagtggaagccgaagcaggagtgtgttgctgaggggctgccggagccgccgcgagcctccggacagacgccagagcgaggagggcgctacgcgacttggcatgatgacccagttccttgccggagccagactcgttcttggccccttctttgccgccccgtgacccgtattccatacgcatgcgcaccgcctgtgtagaaactgccgactatgaaaaacagccagcaatcaacccttattgtgcgcatttgcgccggtacattcgcagagtttgtgaggacccctcgagatgccccctcctccaacctcgtgcttgagaacccgagagggcagcgcatggagcaggaaacgacgggaaacagattgcagcggcgacagcaagaagtggagacagagcttaaaaactgtgggaccctcacaatgatcccaatgctcaggggggatgccttcagagactctcttcgtggcgagagtgaattatgaccacaacagaatccaagctccggagagagtttgaggtgtacggacctatcaaaagaatacacatggtctacagtaagcggtgcaggaaagcccccgtggttatgcccttcatcgagtacgaacacgaggcgagcacatgcactccgcttacaaacacgcatgatggcaggaagcattgctggccggaggggtccgttggtgggacgtgggaagtgggcgaaccgtgagggctggaggccccgggcggcta

SEQ ID NO: 702597 - DNA, 856 bp, Homo sapiens
gctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaacacgataatagagtggtcttgttgaaatggaagccagaaaactggatataaggatctatttggcaaagtcaagaccccatacctgggaaattccaccaagcagacatcttgatggaaactggcttaatggttccatcggcacagaggttgttacaaaacaacttgaatcctgtttggaggccttttccagatctctcttaactcactggtgtcaccggagatatggacccaacacatttaaggtggccgtggtactgacttatgaccatgcatgctcacatgatctccttggaccttttccgacc

SEQ ID NO: 702598 - DNA, 233 bp, Homo sapiens
tagggctcacttgcctcctgcaaagacccgatagcagcgctctggaagcgcacatctgtatgaaagccctgagcaatttctcgcaccagactgctggacggaacgtttgcgaatcagacgtaccgtggacttctgataccgtctaatttcacggagcgccacagtcccaggcctgtaacgatgaggtttctacacccctccagaagagggcgcactctagcgaagcggattag

SEQ ID NO: 702599 - DNA, 340 bp, Homo sapiens
aactttcaatcttttatttaaaggccatgacccaggaggggttttaaatcttggggaaagcagccccatccatggactggacataggcctcaaaagcagggatctggtcctccagcatatttgttccaactttatcattttcaactacacactggttttgaaggttcttaattccgtatcccactggaactagtttagatgagccccaaactaagccgcctggttgaatgcttttgacccacccctttaatttcgccatatctggctcatcatcccaaggtttcacatttagtaagagggaagacttggcaacaagggcaggtttttgggctttctttga

SEQ ID NO: 702600 - DNA, 531 bp, Homo sapiens
acaccatctgagtcctcacgttggactgggccacggtatggggaggggctgcagcggtccagtgcacctggagaggctgctcagagctgggagaggcctgtcgccactgctgtcggctacagagcctgatcttgagcttcctgtcgcagatcgaaggtcaatcagaaaaatcgggtggtgctctaggattagctgggcatatggggtaagggagggactgcagatcctgattggtacagaaaactaaaatagcagtatgtagcaataaaatgaaaatatgtcttactcaacaggagtgtgatagcaaaaacatcccccaatacgtgggtcacatttggtatactgatgccggggatggctctccccacataagtaggagcgtaccttgaatacacttgtctggtatcacatgagtagaagaggagaaaaattatatagacacacatacacatgtgtgtacgtgcataactgatctctggaaggatacccaagggacaaaccaatagtaggtatacatggagtgaggagcgg

SEQ ID NO: 702601 - DNA, 965 bp, Homo sapiens
gctaggttctcctgaatccctgcggtcccagcgtcgctccggacgctgccaacctgttctccaccgtcgctcgacttccacctctaagactcccacgaaactcaggttgaataattcatcaaattacacaactgctaattaactattaattagaggctttagtgctctgaagggatttggcataaaggggaaaatacctgggtttatgctgtggtggtgacacttactagcttgtgatcccataactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaacacgataatagagtggtcttgttgaaatggaagccagaaaactggatataaggatctatttggcaaagtcaagaccccatacctgggaaattccaccaagcagacatcttgatggaaactggcttaatggttccatcggcacagaggttgttacaaaacaacttgaatcctgtttggaggccttttccagatctctcttaactcactggtgtcaccggagatatggacccaacacatttaaggtggccgtggtactgacttatgaccatgcatgctcacatgatctccttggaccttttccgacc

SEQ ID NO: 702602 - DNA, 291 bp, Homo sapiens
cccatgcctccgttgccagcagttccgcatgactatgaggtccgtgtgaccccctacacttactctcactggggtctgcgcccatctcgattcatgcccgtcactcccttcacttaggaaggctgtgattagctgatcacctcctctcaagatctacctgaccagcttgacccatcttggttgaccgccgtctgtcctgcgtcatgcactagttagcccgcgtatcatggtgcatgcctgtaatcccagctacttgggaggctgaggcaagagaatcacttgaacctcgga

SEQ ID NO: 702603 - DNA, 321 bp, Homo sapiens
  misc_feature (38)..(38): n is a, c, g, or t
cggatacagatgcactttgctatatgatatagcatcanatatctcatcaacctcagattgattgccacactgacttccataggattgcttgtaatcaaaggcgtcagctcctgggcacgggtgtaatcagcagaaacaaacttgagtccaatatcatactctgggaagcagtggtctaacacacagatattcaatccagggatgcaaacctttatttaaccaaaggatggttccccattccatagtaacaagatttccaaaaccattgattgggcagttcattgtcccacaaacaaagcaacccactgggcgaggctagga

SEQ ID NO: 702604 - DNA, 196 bp, Homo sapiens
  misc_feature (168)..(168): n is a, c, g, or t
acgggagtataccggtatcgctgatggtacaggagaagaatgctcagaggagtctgatcataaaaggacgatatactggtcttcaggaggctctgtcattcttcacacttgagcgtcacctcagagaagatcttctctttcatccagcttagcgggtattcgtgccgncagctggcgctgttgcagtgtgcttccg

SEQ ID NO: 702605 - DNA, 246 bp, Homo sapiens
  misc_feature (153)..(153): n is a, c, g, or t
  misc_feature (227)..(227): n is a, c, g, or t
gaagattatgatgctctactgaaggaaaatgacagtcctgatgttcggcgagacaagacctgtatacaggagaacaaatagaggtatttgccaacaagtctgggtgaacaatgggaagattctggctccctacttgggaaatgaaagactcangaaattaggcagacttgacgtgtgacatgtgaagaacatagaagatgagaaagctaagcagctcctgggttgcnctgtgcaagatacaagacg

SEQ ID NO: 702606 - DNA, 296 bp, Homo sapiens
ttggggaaggaaggaaggaaggaataaaagggggcccctagttaggccagtattaaaaagctgatagattccaatttttatagtcaggtttttaaatagtctcaggtcttttctttaaaacgcccccttattggaaatttaagaacaaatttttctccccccggggggaatgggatatcctcttattcgggttttcccaaatccttttgtttgcccttattcaggcttgaaaaagctttttatatccaattggctggtttcccataattcccgaaataaagaattttagcttccca

SEQ ID NO: 702607 - DNA, 789 bp, Homo sapiens
  misc_feature (11)..(11): n is a, c, g, or t
  misc_feature (78)..(78): n is a, c, g, or t
  misc_feature (100)..(100): n is a, c, g, or t
  misc_feature (103)..(103): n is a, c, g, or t
  misc_feature (165)..(165): n is a, c, g, or t
  misc_feature (187)..(187): n is a, c, g, or t
  misc_feature (190)..(190): n is a, c, g, or t
  misc_feature (194)..(195): n is a, c, g, or t
  misc_feature (209)..(209): n is a, c, g, or t
  misc_feature (212)..(212): n is a, c, g, or t
  misc_feature (223)..(223): n is a, c, g, or t
  misc_feature (233)..(233): n is a, c, g, or t
  misc_feature (248)..(248): n is a, c, g, or t
  misc_feature (254)..(254): n is a, c, g, or t
  misc_feature (276)..(276): n is a, c, g, or t
  misc_feature (279)..(279): n is a, c, g, or t
  misc_feature (374)..(380): n is a, c, g, or t
  misc_feature (382)..(386): n is a, c, g, or t
  misc_feature (398)..(398): n is a, c, g, or t
  misc_feature (401)..(401): n is a, c, g, or t
  misc_feature (423)..(423): n is a, c, g, or t
  misc_feature (425)..(425): n is a, c, g, or t
  misc_feature (442)..(442): n is a, c, g, or t
  misc_feature (447)..(448): n is a, c, g, or t
  misc_feature (451)..(451): n is a, c, g, or t
  misc_feature (454)..(454): n is a, c, g, or t
  misc_feature (457)..(457): n is a, c, g, or t
  misc_feature (469)..(469): n is a, c, g, or t
  misc_feature (474)..(474): n is a, c, g, or t
  misc_feature (480)..(480): n is a, c, g, or t
  misc_feature (485)..(485): n is a, c, g, or t
  misc_feature (490)..(490): n is a, c, g, or t
  misc_feature (494)..(494): n is a, c, g, or t
  misc_feature (496)..(498): n is a, c, g, or t
  misc_feature (502)..(502): n is a, c, g, or t
  misc_feature (506)..(506): n is a, c, g, or t
  misc_feature (510)..(510): n is a, c, g, or t
  misc_feature (512)..(512): n is a, c, g, or t
  misc_feature (532)..(532): n is a, c, g, or t
  misc_feature (674)..(674): n is a, c, g, or t
  misc_feature (701)..(701): n is a, c, g, or t
  misc_feature (775)..(775): n is a, c, g, or t
aactattcaanttagtccagtaattccaaatggtcttaggacttctatacataagagatgatcttacaacattaatgnagctaaatacttaacttcccangcnttttgaggattcccaaaagacttgagggggttcccaagagtttcagggtttttttttttttncacaataaaagaaaggaacagngtnaatnngtaaagtcagaccngcngggtaataagntcctcttcanagctcagttctcagngcatanagagattcaatatagccccatngcnctcagggattagaatctgagagggataaaagcaataactattggggaaaagcctaagagtgaaaacagatgtccaaaaaaaaaaagaaaaaaaannnnnnnannnnntcatcccaggangtntgaaaaggagagactctatggngnggggaggtagaaaaggngtgannccnacnggnaaaaaatgaacnggggncacagngactnaagancagngnnngaancacnaggngngagtggcttgcaatttcacngtgaccaggggggcacacaccagaaagcctgggacaaagcccgggctagagccctcaggattcattctcaggcttcctggtgctgtggttcaacagcctttgtggggatggggagaaccagagactatcaccatcacatgtnaaaaatattaccacagcaacagctgtnaaaaaccagctggagctgaagttacacaccatttgaaatccacactgtacttgctttcttgtgatgggcttganacatgtgcagagac

SEQ ID NO: 702608 - DNA, 142 bp, Homo sapiens
  misc_feature (67)..(67): n is a, c, g, or t
  misc_feature (72)..(72): n is a, c, g, or t
accggggccctgggcgggccccccaagaagcctttgtattttggttggggaggggtgggagaccctncaggncattcccaccctcccccatgctgccaagttgtagcatagctacaaataaaaaaaacccttgttttccaga

SEQ ID NO: 702609 - DNA, 119 bp, Homo sapiens
tcctgggcacgagtgagacctgtctcaaaaacaaaaaacaaaacaaagcaaaacaaaaaaacaacttgggagagagtcaggaatcctggagaatccacttcccaggcgtcagagtccta

SEQ ID NO: 702610 - DNA, 239 bp, Homo sapiens
ttcagtaggtacccgattttcaatagtgaatgtgctgctagaaacatgcatctgcaagtacgtatttcaaataatcatttctttactctgggtagatactcagtagtgggattgctggatcaaatgctagttctacttttagtactatacagactctccacactgttttccaatatgcatttatatgttctccatggtggctctatcagtatacattctcaccagcagtatagatgtgt

SEQ ID NO: 702611 - DNA, 440 bp, Homo sapiens
atatagatagcccttggattgtctttgtattatgctaaaatagtggtgctttataggattaacattattgtatctcttccaatacaaagtatggggcatgttatagaatacagtacaccattttcatacatgtacaacattggtggaatgtagaatgtctcttagcagtaatactggctgtagccttcagattttaccagctgcaaactctaggactattatataagtaaaaatctctcttgtgatactggaaaggtgattagaatgtgcaaactgatatagtagctttcatccgcctcttaaagggtaccaccacaggaaagtccatttaagatgttggtaggtttaacaaagttggaatgctggcactgttgaattgggcaacagttcttcagacctggctcagagctacaatgcatttagtatattaaagcagctga

SEQ ID NO: 702612 - DNA, 128 bp, Homo sapiens
ttgtctaaggtttttagagctgtacaggtaaagcgttctggcttaaaatgtggtaagaatgaactccaggccatgtgtcctcctttggtgttccaagaaccagaaatattcgttcaagttgatcctga

SEQ ID NO: 702613 - DNA, 408 bp, Homo sapiens
taccaaagctgattattcttttttgcaggcggctttaattcatgtcgttctgcagttgcggtgtattgaaacggggtaaaaagcgcatagcccatggtgaagaatgtgatacgaaactctttgacctatgaggtaacttacaggcatggggtttgctaaacaggctgtcagtgaaagcccgtatgtgtctcgaggtgagtgtaatttacttccgagtactttacgcagaggatgtatggcccaggtgggcagagtacaggtgatctctagcacaggcggagatgggggcgtgtgcatattgcgaggtgtctgggtgtacctcccattgagtagagaagcttaagataattggggagagaagaacactgctgattgtgggagcagttgaggagtccatggaaaaaaaaa

SEQ ID NO: 702614 - DNA, 874 bp, Homo sapiens
gcaatgctgtccccatcaagctaccatcagctttcttcacagaattagaaaaaactactttaaatttcatatggaaccagaaaagagcctatataacgaagacagtcctaagcaaaaacaacaaagctggaggcatcatgctgacttcaaactatactacaaggctacggtaaccaaaacagcatgattctggtaccaaaacagatacatagaccaatggaacagatcagaggcctcaaaaataacaccacacatctccaaccatcttatctttgacaaacctgacaaaaacaagcaatggggaaaggattccctatttaataaatggtttgggaaaactggctagccatatgcagaatactgaaactggaccccttccttacaccttatacaaaaactaactcaagatggattaaagacttaaacataagacctaaaaccataaaaaccctagaagaaaatctaggcagtaccattcaggacatagaattgggcaaagacttcatgactaaaacaacaaaagcaatggcaacaaaagccaaaattgacaaataggatgtaattaaactaaagagcttctgcacagcaaaagaaactaccatcagagtgaacaggcagtctgcagaatgggagaaaaattttgcaatctatcatctgacaagggctaatatcagaatctacaaataaacaaatttacaagaaacaaaaacacatcaaagtggtgaaggagttgattgagacttctcaaaagaaaactttatgcggcacaacttaaagcagtcatcatcatggtcatagagaatgcaattcaaaaccatgagattctctaaccattaaatggtgtctttaaagtcggaacactgggggaagattg

SEQ ID NO: 702615 - DNA, 309 bp, Homo sapiens
agtctggagactacagaaacatgccaccacgcccggtctaatagatgtatttttatgtagagatagaggtgtagtacgtgttgcccacgtaggtctcaaactcctgagctcaagcaacctgcccaccgtagtctcccaaagtgctgggattacaggcttgagctgccatacctcaccagatcatgagagttcaagaactactgcaggtaatcaaagaattcaaagaattgacaattagatcgccaataatatcttatcaacattggatgccagaaaacaacagaagaatgtcttagagaagctccttgt

SEQ ID NO: 702616 - DNA, 852 bp, Homo sapiens
cgtttcttcattgcgtcctttcattggcgcgtcgccgctaaccacagtaccacttgtccgctgttcctacggaagtgttcttccaggggtcctccctcgcgccctgtgcctaagagccgctctatcgtcggggtattctctggttggttgcctctcagagcgtcttttctcacgcccgagattgtctgcgggcgcgttttaccacacgtctgcgcgtttgttccttctccccccccttttgtggaggtgtcactgtggcgcccacaacacagggtgaacttccgccctgctataacgccccctggggttagtggccctccttctcctttatcaccagatccgttatgacggcccccactcccgggttttccaaccacctgggggggtccccccactaggtgtgttataagggccctccgctccttggaactccctaatatgtgcgtcagcgcccgtggttactttcccgcaagtttatactcgggtgtgcttgatgttttatcccctcggacttaatcccccgcgaatgcgaacgtcgcaggtttttcccccataaccacattttggcggcctattttaggtcgcacactctgtgttacaccccgcggcgtatccaccgggatactcgcgtcacgtttttgtgggcctcaagctaggtcccctcagctaatgaatgggagctgatacactcgcgcccagcaaaagtgttcatctccttttaaaacctccgccccagatagcttctggatgtgtggaactcgacgccggggctgaatctggcgcggttcatgggactggggttgacaaatatcgatatgacagtccaattttgtaagggcgccccacaaaaca

SEQ ID NO: 702617 - DNA, 1233 bp, Homo sapiens
  misc_feature (455)..(455): n is a, c, g, or t
  misc_feature (599)..(599): n is a, c, g, or t
  misc_feature (714)..(714): n is a, c, g, or t
  misc_feature (729)..(729): n is a, c, g, or t
  misc_feature (778)..(778): n is a, c, g, or t
  misc_feature (831)..(831): n is a, c, g, or t
  misc_feature (840)..(840): n is a, c, g, or t
  misc_feature (851)..(851): n is a, c, g, or t
  misc_feature (872)..(872): n is a, c, g, or t
gaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaatctagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgagagacagtgcaggatgagtcagatgaggcggaggaacgaagaggaagcaccacgtgaggnaatgcagcgaggaagcaggatggctacagcagtgaggaggcagagaatgaggaagatgaggatgacaccgaggaggctgaagaggacgatgaagcaagcaagcaagaagcagcatgatggtgccagggatggcaaggcaacagnaggagcctggctctgacagtggtacaacagcggtggtgggccctgatacgagggaagcagttgagattgtagccacacgcaaggagactctcgactgtgtggtactctgaggctnggcaaacgcgtttangaccatgtcctatgatcacaaaccagaggatgaagtagaaactagcacngccatcaaagaaatgctggtggcaaggtcaccatggatgggcgagtcaacggnggcctcaanctctccagagnccattgtggaccacttctatnagagaagaccaagaatcgtgccaacctgaggacacagagtgatttacagccgcgtatcctgacgatcaaggtgcattgactctcactgacgaccatgaattcactggtcaattgcctgtgatggcatctggcaatgtgatgagcagccaggaagttgtcgatttcatccacatcaaagatcagccagcgtgatgaggaatgggcggagcttcgggctattgtcatccattgtggaagagctgctggatcagtgctggacaccaaacactcctggggatgggtaccagggtgtgacaacattgacctgcatccatcatttgcttcagcccgaaaacacagaagaggctccagccaagaagtg

SEQ ID NO: 702618 - DNA, 241 bp, Homo sapiens
ttcctacttcagcctaccaagtagctgggactacaggcatgcagcaccccgcctggctaatttttaatttattttttgtagagattgggtctcactatgtttcccaggctggtttcgaactcctgggctcaagcaatacttctgcctcagcctcccacagtgctgggattacaggtgcagtcactgtgcttggccaaaagaagctttttgatgtagatgaaatcaggtgagaaagccaggc

SEQ ID NO: 702619 - DNA, 387 bp, Homo sapiens
  misc_feature (4)..(4): n is a, c, g, or t
  misc_feature (77)..(77): n is a, c, g, or t
  misc_feature (83)..(83): n is a, c, g, or t
  misc_feature (116)..(116): n is a, c, g, or t
  misc_feature (125)..(125): n is a, c, g, or t
  misc_feature (163)..(163): n is a, c, g, or t
  misc_feature (228)..(228): n is a, c, g, or t
  misc_feature (376)..(378): n is a, c, g, or t
tttnccaacccgttaaaccccccaggatgctgttgcttgtaggacgcttgctgcccctggagcccttccccaggatntgagcnagtcccctcgctggtacggaatgccgctgggtnccggaaggnggccatggtgtctcgatggacggcagccaggatggagnacccatgggtctcacggccatgcttcagggtcttcaggtcctgccccggccagtctccaagaggnacccccttccccagcctctcgcctgcactgatgcagacaaaatctcacctgcaggcccaaccccccccacccctcccccgccgtgtgtgctcctcgccgcatcggttggggttttgttatgtgaaaatatcctggaaataaatacatnnntctgcactt

SEQ ID NO: 702620 - DNA, 685 bp, Homo sapiens
  misc_feature (557)..(557): n is a, c, g, or t
gaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaatctagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgagagacagtgcagcgcatgtagctcatgagtgatgggcggtatggatatgaagtaggataggcatcaggtgtaggcaattgtcgagtccgaggcatagtgactgcgcttacagtcacgtcgaggaaggcatgatgaattgcacgtgacagcactgtacgtgcnatgaccgaaccgaagcgaggtcgtgaatgagcgacgattggacaggacatgacatcacacgaatgtacgattgtagtgtgatgtctcagggagaacttgtggaagtgacgaactagctatgggaagac

SEQ ID NO: 702621 - DNA, 237 bp, Homo sapiens
tttgttttttcccccccgggggggttttggtcccgcccccccccaaattaggtgccccccccccaaaaaggttttgggggttccccagttacccgggcccccccttcggggcccccaattcggcccgcctttcccccgtttgggttctgcccttttacccccggttttgggggttttggggagaaccaaattgttcccgccggccccttttttcattaaactttttttttgggtgga

SEQ ID NO: 702622 - DNA, 768 bp, Homo sapiens
  misc_feature (7)..(7): n is a, c, g, or t
  misc_feature (24)..(24): n is a, c, g, or t
  misc_feature (60)..(60): n is a, c, g, or t
  misc_feature (121)..(121): n is a, c, g, or t
  misc_feature (167)..(167): n is a, c, g, or t
  misc_feature (188)..(188): n is a, c, g, or t
  misc_feature (241)..(241): n is a, c, g, or t
  misc_feature (243)..(243): n is a, c, g, or t
  misc_feature (270)..(270): n is a, c, g, or t
  misc_feature (413)..(413): n is a, c, g, or t
  misc_feature (419)..(419): n is a, c, g, or t
  misc_feature (421)..(421): n is a, c, g, or t
  misc_feature (426)..(426): n is a, c, g, or t
  misc_feature (454)..(454): n is a, c, g, or t
  misc_feature (459)..(459): n is a, c, g, or t
  misc_feature (466)..(466): n is a, c, g, or t
  misc_feature (474)..(474): n is a, c, g, or t
  misc_feature (483)..(483): n is a, c, g, or t
  misc_feature (488)..(488): n is a, c, g, or t
  misc_feature (494)..(494): n is a, c, g, or t
  misc_feature (498)..(498): n is a, c, g, or t
  misc_feature (501)..(501): n is a, c, g, or t
  misc_feature (511)..(511): n is a, c, g, or t
  misc_feature (519)..(519): n is a, c, g, or t
  misc_feature (533)..(533): n is a, c, g, or t
  misc_feature (554)..(554): n is a, c, g, or t
  misc_feature (576)..(576): n is a, c, g, or t
  misc_feature (581)..(581): n is a, c, g, or t
  misc_feature (593)..(593): n is a, c, g, or t
  misc_feature (596)..(596): n is a, c, g, or t
  misc_feature (605)..(605): n is a, c, g, or t
  misc_feature (614)..(614): n is a, c, g, or t
  misc_feature (616)..(616): n is a, c, g, or t
  misc_feature (621)..(621): n is a, c, g, or t
  misc_feature (625)..(625): n is a, c, g, or t
  misc_feature (631)..(631): n is a, c, g, or t
  misc_feature (643)..(643): n is a, c, g, or t
  misc_feature (645)..(645): n is a, c, g, or t
  misc_feature (662)..(662): n is a, c, g, or t
  misc_feature (668)..(668): n is a, c, g, or t
  misc_feature (674)..(674): n is a, c, g, or t
  misc_feature (685)..(685): n is a, c, g, or t
  misc_feature (697)..(697): n is a, c, g, or t
  misc_feature (702)..(702): n is a, c, g, or t
  misc_feature (759)..(759): n is a, c, g, or t
taccccnccttagctttatgcgcncagaaaccaaattaaacccccccccatgtaacaggngggcagtgacaaaagcaagaacgcacgaagccagcctggagaccaccacgtcctgcccccngccatttatcgccctgattggattttgtttttcatctgtccctgtngcttgggttgagttgaggggngagcctcctggggggcactggccactgagcccccttggagaagtcagaggggngnggagaaggccactgtccggcctggctnctggggacagtggctggtccccaaaagtcctgagggcggaggggggggttgggcagggtctccacaggtgtcaggagggagcacggaggccacaggagggggctcctggctggcctgaggctggccggaggggaaggggctancaggtntntaaanaaagggttccatcaggctggggcagggnggccnccttccncacacttnaggaacccnccccnctcccncggnganatcttgcccncccctcancaccctgccttttntccaggaggtccgaagctctntgggacctcttgggggcaaggnggggngaggccggggantanggaggtcangcgggtctnancccanaaancagganagctgccaggtntncccatcgaccaggttgnttgggncccggngcccacgggtntggtgatgccanaacanccaccaccgcggcgcctagggctgcggcagggactcggcctctgggaggtttactcncccccactt

SEQ ID NO: 702623 - DNA, 269 bp, Homo sapiens
  misc_feature (78)..(78): n is a, c, g, or t
  misc_feature (115)..(115): n is a, c, g, or t
  misc_feature (135)..(135): n is a, c, g, or t
  misc_feature (153)..(153): n is a, c, g, or t
  misc_feature (172)..(172): n is a, c, g, or t
  misc_feature (192)..(192): n is a, c, g, or t
  misc_feature (238)..(238): n is a, c, g, or t
  misc_feature (263)..(263): n is a, c, g, or t
ataggtgagaagaaacccagagaaggtttttaggtccagaaacctttaaccgataccaaggatatggtatgttgtccnagctggaaccaagtttgccatttttgagggcttgagncgaagggaagactcttaccngatagtaagacagctganctttcctcagttttctcgncttaacactagtggacaatnctagcattttgtttggaggatttcagagttaacctcatgggaattnaggattttttcagcaagttttggcntttggg

SEQ ID NO: 702624 - DNA, 119 bp, Homo sapiens
tgcactcgaggtcgggagtacaggagcaccagcaggacatcagcaccagggactttctcgccagcagggacaggggaccaggtggacaacttcaccaggacgtccatctgacccatctt

SEQ ID NO: 702625 - DNA, 992 bp, Homo sapiens
  misc_feature (992)..(992): n is a, c, g, or t
ggtggctcccttgatggtcggggcggccctggaagctgggccttgagtgcctgcttgtgctgcttcgtggccttcgtcgtcgtcctgcctctctcgtcaatatctccctctctttgtccctccccagttccggacctgggatcccggggtagccttgagcaggcctcgtgtctcctcagggtgtcccaggagcagccgtggcgacagagtggggctccgattagagtatgtgggatgtcggttacgccaggtgagtgaatgagaggatgcgaacaccgcagtatgaggccactagcatgggccatgcgaggagtactagagtgcgataggctggagggtggagtgcatttagagaggtgtgtgagcagcttccgaacccgtggtccatgggaacgggggccttgcgtgggtcgcgtcgtgtgaattcatcccgacgcgggcatcccgtgcatccaaggagattgagtcctaactgaggcacgcccacgggcctggtctgggctgggcacgggccaccgaaggccatcaacttgatgggcgtctggtgtccccaggagggcagggcggaggggttgccgaggggcgtgggaggccgggactgtggtccatagaggtaggcggagggtgtgccggcagatttgagctatcccaggggtctgcacgggggagagcagggcctgctccgctatcggtgctcggcacgatcctgaatgcaaaatggacggaccctggaccggcgtctgttcggacagagtggcgcggaccgctgtgtgtgttccccgggtatggccaacggtacatcagagagaggtgggagtaccctctggcagaaagcatcaccgcgcgtggcaggctaacccattggggggcccctcgggggacgggaccacgaacgggctggcgccggggactcgagtatacgcgcacaggcggggtcggaggaaccctaacgaatccaccgtgcacgtgttctcgttcgggacgccgtggan

SEQ ID NO: 702626 - DNA, 401 bp, Homo sapiens
ctcgtacaggctagtcttgaacttgtgagcttatgagccacccacatgaggtggctaaagggcttagaggacagtcttgcgtcactgcatccagcctttaacacacattaagctggccagcgtatagatatctggggagagtcaagacatgtaaatgacgactacagatcttacagacaatatatggtagctataagcagaactatttaacagggtacaggattctagctagaaggaacgaaatcaggaaaggcaggcagacgtgacttcatagcacacactgaaactgactgcggtgaacagcactgctaactgctacatgaaaggatgactgaaggaggttgatctgtgacagacgaatgactctgagattcgcttttagagtgtgcaggtactggctc

SEQ ID NO: 702627 - DNA, 959 bp, Homo sapiens
tccatattggttaaaaaaaaaaaaaaaagtttctcttaaaaatttaagtgaggggacctgccaagggggtggaagggttgggcccaacccccttctcggccaagtggggggccctaggtccaccccaggcttgtgctgtgtgggccccggggcgctttggccgcggggctctgcagggcgggggcggggcggtccgcgcctactattccgcagactgtgctgggttgggggccacgtgtgaaggctgtcgtaggccttgagccaggctccctccaggggggtagcctggttcccagcacgcaccagggcccctggaggcctcgcgactgtggcgccggggaacagccctgcgcatgtggtcccagggtactgttgtcgcgggggtcgccatctccttcacttggtgttcacggacacgcgggtgtgtttaagaccacctcttccagatgtccggcccctcgttcggccagtagctagggctgggcctcgtcctttttgaaccacgggccacgtggattgacgcagatgtttctattccctgtggccccgaacaccgaggcctcttcggcgttggcccctggggcaggccgcttctcccgggcactgtgccgcagggccaaactccttgactcgttcttcgaaaccaatcttcgggggccagcgagatttcggaccggctgcggagccacggttccgtgaccgcttgagatcattgcgcgccagagcggtttgcgacggttcttcaccctatttccactccgtttcgttcccagggcccacttggtccttgatagggggcgtagaggggcccccctgttccgggcaatgtcgtgttcaccaccccggtggctggccccagtggcaagcccggtttaacccaaagaggttcccggggtcgccccaacgcggcccggcaatgggtgttacagctcccggttggcccaggaccgtcattcacg

SEQ ID NO: 702628 - DNA, 678 bp, Homo sapiens
gaaaattaaaagaaagaaaggaaagaaagaaagaaaaagaaagaaagaaagaaagaaagaaagaaagaaagaaagaaagaaagaaagaaagaaagaaagaaaggaaaggaagaaggaagaaggaagaaggaaggaaggtctctaagtgtaagatgtttcatgtcaccaatggtattagcgcagttacaaagatcaattctgcttgtcaacgatttaacaaattcctacaaaccctatggagtctggagggaccaatggtttcttcaaacctttaagctttaaaaatatatagatttctaggtcccaatgtagatttactgaatcataatcatctaggataaggctagaatttgcgtttttaacaactcctacatgattctcacttgtcaggtggccacatatgagaataccagaccagatgatattgaaagagcttttcatacttccttgattctacttctagtccatgtcataggaggcaatattcacagggggaggagtatagactctacagcccagatgtgtggtttaaaacccaactttgtctcccactacctagatgtttctgagtaagcctgcatacctacgttccttctttggtaaatgggattaccattatttttaccccacaagtgtcccaaagactaccttgttttgcagggctcgtcccccttcttt

SEQ ID NO: 702629 - DNA, 596 bp, Homo sapiens
  misc_feature (13)..(13): n is a, c, g, or t
  misc_feature (45)..(45): n is a, c, g, or t
  misc_feature (55)..(55): n is a, c, g, or t
  misc_feature (77)..(77): n is a, c, g, or t
  misc_feature (99)..(99): n is a, c, g, or t
  misc_feature (136)..(136): n is a, c, g, or t
  misc_feature (185)..(185): n is a, c, g, or t
  misc_feature (212)..(212): n is a, c, g, or t
  misc_feature (229)..(229): n is a, c, g, or t
  misc_feature (285)..(285): n is a, c, g, or t
  misc_feature (302)..(302): n is a, c, g, or t
  misc_feature (334)..(334): n is a, c, g, or t
  misc_feature (347)..(347): n is a, c, g, or t
  misc_feature (457)..(457): n is a, c, g, or t
  misc_feature (487)..(487): n is a, c, g, or t
  misc_feature (517)..(517): n is a, c, g, or t
  misc_feature (537)..(537): n is a, c, g, or t
  misc_feature (589)..(589): n is a, c, g, or t
aagggaaaaaaantgaagtccaccggtggggccgctcaaaaaacnagggaacccncgggttaaagccctcgtgtttnacccaaaatttgtcccgtggtngggaaccaagtctcccggtcggtaatggtatccaacntgttgggctttagccattaccccccagaaaattgctcctcccttagganaaggctctgtctctgatgctgctggcntccctcaagtgctgccntcctccgtttggggcttggtggatacaagtgctgacacacaaagcaggcaggcaanctcggcccagggtgtcntccagcccctctgatggcagggaccagcgagncctggggaaactnacagtctgtgcctgtctgtgctctcaggagactgaggaattagtgggtgggagagattttatgttggattaaaaactgacctccaggccggcatggtgtctcatgcctgnatcccagcactttggaggccaaggtggagntcacttgagccctggagtttgagcttcagnagctatgattacaccacttnctcttccagcctgggcaaacagagtggcaccctgtctctaaaaacaaacaanaaaacaa

SEQ ID NO: 702630 - DNA, 407 bp, Homo sapiens
  misc_feature (112)..(112): n is a, c, g, or t
  misc_feature (114)..(115): n is a, c, g, or t
  misc_feature (180)..(180): n is a, c, g, or t
taggtttagggttttattaaaattaagtggcccccaagggaccccattttgcggttccttatgggatccccccccccgggggggatggggaagggtttcccctggaaaaaancnntttgggttggggttcaaagttggaaaacttgggcccctggaaagggtcccccaggggtccccctncaaccctgggggcccccgtcccccccgggcccccccgggggggtttaggggttttttcccccccccggcccctggggttaaggcggaaaaataaggggggccagcccccctcccccttttctttttccccccgggttggggggtggggtttgggggttttttttttttttcccctttggtttgaaaataaaggatgccaaaaaaaaaaaatccccgttttttcccca

SEQ ID NO: 702631 - DNA, 246 bp, Homo sapiens
tcccccccctttccccccccggttcccgggggttttccttggggtttttgacccccccccttccctttcaaccccaaggggggaattttggttccccccccctttttccaaaccaggtttggggtggccccaaattttttggcccaaatttaaaagtttttttttttaaaatttaaaaaagcccccaaccccgggggtttttaaaaatttttttttttaggtaaaaaaaagccggtttttgtccca

SEQ ID NO: 702632 - DNA, 658 bp, Homo sapiens
  misc_feature (627)..(627): n is a, c, g, or t
ggaatactagtgtatcgctgacacctcatatcctcgctactatgcctagaaggaataatactatcgctgctcattatagctactctgatcaccctgaacaaccactccttcttagccaatatcgagcctattgccatactagtctatgacgtctgcgaagcatcgacgtgcctagccctacgtagttgagtgtccaacacatatgggctagactacgtgcatagcctagacctagtccagtgctgaaactaagcgcaccaacacttgtattactaccactgacatgactttccaaataacacattgctgggatcagcacagccacccacagcctaatgattagcatcatccctatactataggctaaccgcaacatcatcctatctagctgttacccaagctttagctaggagcccctaacagcctcactgctagtactaactacctgactgctacccctgacaatgatggcaagccaacggcacttatccagtgaaccactatcagcgagaatgctctacctcactatactaagctcccatacacatctccttaattataacgatcacagccacagtactaatcataggataggtcttctatcgaacccacattgatcccactttngtactatcaccgatgaggcaccgtcggcgcc

SEQ ID NO: 702633 - DNA, 345 bp, Homo sapiens
ggtgcctttacaagtatgagctagatacaaaggttctccgtagtccccatcagattaattagatacggagtatggacacaaaggttctccaagggcccaacagaacagctagatacagagtgtcgattggtgcattcacaaatcctgagctagacacagggtgctgattggtgtgtttacaaaccttgagctagatacagagtgctgattggtgtatttacaatccctgagctagacataaaggttctccaaggccccaccagagcagctagatacagagtgtccattgatgcactcacaaaccttgagctaaacacaaggtgctgattggtgtgtttacaatcc

SEQ ID NO: 702634 - DNA, 1006 bp, Homo sapiens
gggcgattatagtggaacttcaccttcacctgctcatgcgccccgcagcgcgccctgctcccacgcccgcgtagttgaggacccagactcgccaggaaaggctagtgagtgctggtgtgccctgggctgggccctggactgggccgggtcacggggaggggcctggcggcagggtgcggggcctcagcgtaaaggcgcggagcacactcggcagccagagagcgctgagtaagagcggcgcccgtctcgagagacaagtggtggccagaagatcgattgcacgatcacaagaacccaagccacgaccaggacagtcttgcagcgtagcatcacggggcggccccattaacccattactagtgccctttagacaaaagggcgccggaccgagcaggacatagaaaggacaccagtgggcttagaagtgccactgcccccactgggcaaaaagccaggagagatgatcccccaggatggtagacagcgaacatgtgggcacattgggacggaaaacagtttccccgagataaagggtgccgcactaccacgaaaggaagggccgcaaaagcagaagagatatgacggagcaacccgaaaggtgatctgcgcggcacaccaccgaagacatcacggataccacccacaattgggaagggacaccgttggctgcactgcgggtagccgaggaagcgacaattgccggggaatcccagagggaaagggcacaacgcgaaagcaactacaaggaaaccccatggcataggacccaaagacgaccaaccctgcccacagcaatggagcggcagaagacaaggcagcagcaggcggccagcacaggtccgatcataacaagcagacgctatgacagggacaggaagaacacacgaaagcaaacaaacccaggatccacagagagaggccggagcagaactacactacaaacacagaccagcacgctggcagccgggagcagctacagagccaaaaggagacaagccagagaggg

SEQ ID NO: 702635 - DNA, 136 bp, Homo sapiens
aggatcccctctctaatgtttcatatttacacttctttttttcaggaggaagacctgaacatcttttcccggtccttaatttcccacacatcaggtgggcagctgcggtgcttaattttggcccggtggaaaagta

SEQ ID NO: 702636 - DNA, 360 bp, Homo sapiens
  misc_feature (16)..(16): n is a, c, g, or t
cggctgcggcacgggnatgcctacactgtaactagcagcatagtgcttaactagttacaagaaatgctgcttccctttgacattgtttccgggggtgtatgaaagttgcacttatttctattaaccccatggagggatgcccacagctgagcctccaggccaggcatggcacgtcagtgcctggccgctgagcatccacgggccacagggcgggatcctccctgcccccagggactgccgcctctgcggccactggtgctgcgatgcaccggaaccccccgggggaacctgagccacgtctgaggtgccctgaagtggctcctggccagaccggagccacacagtcccgtgccgctcccg

SEQ ID NO: 702637 - DNA, 163 bp, Homo sapiens
cttgaggatccccgcgtatgagcatgggagtggattagtttgacatttagggattgagacagaatacagtcttagggacctgccctcttgtctggtttatgttattcctgggaagtatattctaaatcatcccagtgattggcttgatccacaaatacttatg

SEQ ID NO: 702638 - DNA, 475 bp, Homo sapiens
actcggtacactcgaagaatactacacagcgtgtacacactgacaaaaagcacaaatataaataatatcttaataattccactttcactgaaagtataattaaggtaaacttacagactggcagagctaacacttgtatggaggtacaaagattcaaatattctgtttgcatgcgtcagactggaatgttatattaaatccaaaattaagtttatgtacatccaaattctcattagatcaatttagtactctaagcatgctccatttaccagcatcatcctcacaaataaagccttcattaacaatgccaatcagccattgtttttaatcaattactccccaaaagtacatggtttccaaatcccttcctctcagttaactgaaacggatatacaggtaataaagatttatagcttaggattgatggaagtttgaacggctttataaatattactactatcatcaattcatgtca

SEQ ID NO: 702639 - DNA, 239 bp, Homo sapiens
  misc_feature (166)..(166): n is a, c, g, or t
tcatattgctagacaacatacatggtgcttcaatgtttaaaatgtagaaggtgaaaggtacccaagagtagtttggaatgctccctatcttccttttgtacctttgaccatattcacagagagaccatcataaatcttgttcccctcacacctaccattcattctngtcccgtctactcccttctctccagtacacaccattgttctttgcctttttgtgtttcacaaagtaaagatgg

SEQ ID NO: 702640 - DNA, 615 bp, Homo sapiens
acatttgtgttcatggtgaagggtggtagtccatgtggcccagagtttgtgctgtccatcagtccatctccaaagccctggtggcctattaccagaaatatatggatgaggcttccaagaaggatatctaagacaccctcatccagaatgaccagtacattgctggtagactggcctcgttcgaccgtgtgagtccaaaaagtttggaagctactggtgcctgtgctcgctactagaaatcctaccaataggccaggcatcactggttgcacacctgtaatcccagcactttgggaggatgaggtgggcggatcactgaggttcaggagttcgagaccagctggccaacatgcgtgaaagcactgtatttacaaaagtacaaaaattagctgagctgatggcgggtgccccgtaatcctggctacttgggaggctgagatggtagaatcacatgaatctgggaggtgcaggttgtcagcgagctcaagcttgtgctagtgcattccagctctgggcaagagtgtgagacctccatttcgttagatagcaagtaagagagagagagacgagagttgcagtataaagagagaagaatcattacccgagcattcacaa

SEQ ID NO: 702641 - DNA, 201 bp, Homo sapiens
agatcccggggggcacaggtgccagcattatatacattcctcagggtctgatcaaagttcagctggtacaccagggaccgataccgcagagtcaggatgaccacctagggatgggggaccgccgggaacagggaagccaccgacacgttggagaccatgcggatgcccacagcaacagaggggtggtccccaccgcggccg

SEQ ID NO: 702642 - DNA, 927 bp, Homo sapiens
  misc_feature (927)..(927): n is a, c, g, or t
ggcgacgcatgagggcgcactatcgatgggaggtggacgttccgtgataatcacacggacctggctagaggttcaggaggctccgaggatgcccaagatccacgatatatatctgaggctgtcggtcacagttatactagggtatctggtcagaagaacctcaatgcactatacaactcgagtgctttgtgtagaagcaggttgtttactgacatcgcactcaaccgtgtccgtgtaactgtccgctcgttaacccctcggatggactccggatcaatggaatctgtcgcgtggtcggaagagaataagactgggcgtgagtttagaaggcttacctataactagatgatcgtagccgtggttcaggaggaatcgcaaagttgaaggtatgtcgcattagacgtgtagcaaccttggcccggtggccggcattctcaaggtcacgccaggtcgacaaggattcctcacttccgcaccacgttagggtccttggtagctccccctgaaaggagtgtgtggtgacctggtacgtgggttcgtccggatccatcgacagaagtccgagaagatgtcaccgaagaattgtcgggaaaaggccccaggaaccccgaacagtcaaccaaaccctacgtccgctccaaggggccggaaggttcgaaacgtgccagaggtgcgacggggccagttcgagggctacaaaaactaagcctggatctactctcttattaaaaagattttggctgaccgtggaacacacaaacacgatgtgttgtcaccaaaaaaatgatgccggaattctttcggggggggacaaacggtaaaaaagcggcagagggctagggggttttctcacccccgtttttttcccaagggggaacccggcgggcccccaaggggaggtataatgaaacgcggtaagataacagn

SEQ ID NO: 702643 - DNA, 452 bp, Homo sapiens
  misc_feature (161)..(161): n is a, c, g, or t
  misc_feature (165)..(165): n is a, c, g, or t
  misc_feature (167)..(167): n is a, c, g, or t
  misc_feature (170)..(171): n is a, c, g, or t
  misc_feature (315)..(315): n is a, c, g, or t
  misc_feature (358)..(358): n is a, c, g, or t
  misc_feature (386)..(386): n is a, c, g, or t
  misc_feature (393)..(393): n is a, c, g, or t
  misc_feature (400)..(400): n is a, c, g, or t
  misc_feature (417)..(417): n is a, c, g, or t
tgactgtgtatggtactttgtgcacgtgtgtatgtgtgtgttcacatgtgtgtagtgtgcgtgcattgcatggctgtgggtggtgtgtgcacacctgttttgtgcacacatgtataagtgcttacatatggttgtgtgcacatgtgcatgcatgagtgtgntcanangtnngtgtgtggtgtgtggatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtgntgtgcatgtgtgcacatgagtgtatgaatggtgtttatgtgcntctgcatgtgcgtgcccatgtatggtgnttgtgtncacatgngcatgcatatgtgaggntgtgttcacataatggggtatccgggtaccgagct

SEQ ID NO: 702644 - DNA, 169 bp, Homo sapiens
cgaggatccgtgcaccgtcctttctcgacggactacggtcacccgcggggtatcttgacgacgcgtgacttcttctggcctttggttctcttctttgtcagccctttttccttggagccagtgtccacgaagccgagtttttcatttcgggggagcacgtacggttgca

SEQ ID NO: 702645 - DNA, 153 bp, Homo sapiens
atgaggtatacgggagctgtggtcctgcagagctgaatagtagctgttcggcagacattcttaaagaaaggatgagaagtctcgataaaaggaagagcaacagaaacttttggaacagcgggcccatcttcccgggaagacgggcccgatctt

SEQ ID NO: 702646 - DNA, 410 bp, Homo sapiens
agctagggaatgttgtataatgggagaaacctggtactttatctttgaatggagggtggaaggagggaacttggaactttttaatagatgtgtgagggtgctataccctgatttgttgtagagttgcccccatgaattcagctcgcccaaaacagtacatagtcttccctcctacacttctgcattctctctgttaatggcatcattatcccacctgccaatcaggctcaaaaaatgtcctgtttcattgttcctttaaccacatgtttccacacataggaatacttgtcctgtcccccctgtctctgcctctttccattttcatgatcactgccttacttaagagccctttagtctctcccttagactcaccccgtctgcccagtaaaagcctttctgcagcagctgaa

SEQ ID NO: 702647 - DNA, 1007 bp, Homo sapiens
ttgtttttttgttgtgtgtggcgttcttggtgggtctcggtttctggagtgcttgaatcgtgtgccgtgtttgctattgggtttgtgagacctggtacccgcgtggatactcctgtttatttcttctccactgcatgggcctgtgattgtcccacgtgatgttcagttataagggctatcaagaatgtatgattaggcccgttttctagtctgtcatctgaaatatctgtaccgagctctttctaaagtggtcactttcgccactcttcgttctgcagtaatggcttagaggatgcaggccaaccgttctactgtcagctctgcaccggcggggacctctaggacattgttgacgcttggttctgcaaggctgttactgaatgggagcccgcctatctggggattagtacctctttggttaaacaaatacggtaccccatgctaggtacgacgtctgcggtaattactacttcgagcagtatcgtcgaggccgctaatagtgagaaccacctctcgttcttcgattgcgcatgcctgaggatcacgccacagaccaccaagctgaagggcaaaatgcagagcaggtcttgacatggctgagaatgtggtaattgtggcatctcagaagcgacctttatgggtggtcgggagctccagctgccttctatgttcatgttgacatctcaagacatctacccagaagttcttactatgagggtactacaggtcatcatccagctccgggacgacacgcgccgggctaacaagaaaagccaagcagacaggcaggcataggttcctccggtttaggctcagcaggagcatccacgcgcagctgttcaggcagctggaggctgaggacgtgatgccacttatacaaatctcggagtgtagccagtcagaggcgtcagtccggagggaggaatcacccatggatgtcgaccagccatcgcccaggctcaaatactcaatccattgccccgatggaaccaaagggggagttagaa

SEQ ID NO: 702648 - DNA, 503 bp, Homo sapiens
  misc_feature (95)..(95): n is a, c, g, or t
ttggcaacatgatttcggtaagggcacctttgcagaatttcagcttcccatcaatttttcagcctacagaggttcaaaagccagagtccatgcanatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccgtagctgcctttccacagataagtatggttctattaaaaatgctaattagcctggtttgatcagtatacattgtatacatgtgttgaaataccactctgtattccataaatttgtacaattattacatgtcaactaaaaataaaagggaaaaaatttgttaatgttttacctgtagagcagattataaggataataaagacattctcactcagaaaaaaaaaaaa

SEQ ID NO: 702649 - DNA, 225 bp, Homo sapiens
gacatggccccactcccatcacatcgcaccataatcctcttctgcagaatggcgttaatctcatcccgcaggattactacagaccttctataaagaaagtgaaagtttgacttcaaagaatgaaaggtgaaaaagatgtgtgcgggaggagctttagagcaatatatactaatctaccaataaaggagtaaatggcgtttataaaagatgcacacataacgggac

SEQ ID NO: 702650 - DNA, 477 bp, Homo sapiens
agacagtcattaaaggaggtcatggtttttcaaagtggaaagatacaataacagatgaatcgaatgaaatagcagataaatgtccaacttaggaaatatatgtcacatcacatataatgacccaaatcaccacttgatccaaagtcaaggaccttgaaccaaatgcatttaaaatgtattggtttattcggacatagatttcctttataagagaaaagcattcgaattcacccatttaaaaaaaatcatctttcattctttctaaattggacattaaatttgccaatgactgcattgtgttaaaggtgtggtccttttgctttctgatccaaattggcttggaattgatccaggatttcaagctgggattcttctgcacatttaaatgtatgtgacttgatcggaagttgtcaaagacaactcattaaactggaaatctcactatgtcattgtttaattggtctttttttgttgttg

SEQ ID NO: 702651 - DNA, 169 bp, Homo sapiens
gtatcgcatccagtacgatgtagcagatgtacacagataggatgtagcatcgcttgcgaaactactccagaaaaattgaggaagtggattctcctaaatcatccatgaggaccgggatccatgaggaccccggatccatgatgaccccggaatccatgaggaccccgga

SEQ ID NO: 702652 - DNA, 175 bp, Homo sapiens
gtctgatgagcgtggatgggcgcttaaccgggtcgttatcccgcagcgcagtctgctacaaaagtggccactagcactcgcatacacgcctggtccacgcagcgagccgggttcttaccccattaaacgttgagaataggttgagatcgtctctggcccaaagaccttctaatca

SEQ ID NO: 702653 - DNA, 755 bp, Homo sapiens
accgggagaaaggccgatgtccccagatgctgagtgcggtggtgggcagggctcctgataacgccggggtcagggcagtggtgtcttctgtaggctcatatgaggaacatgctgatggtccatggggacgcaggaagggatggaggtgaactccggtgatggggccggacagggagcctcacgcttacatgagcctggtgttggcactctcctggcttcctccgtcaatacctagccatcgtggtcgagggagcccgggcctagcagacggtgccccagcgcttgacatgaatccccatgggtcgtgcgtggcggtgggtggcgatcttcacatgccgagatccgggcctaatcgctgctgtctcgcagtcacccctgcgaggccgctcagggcagggctctggtcctgacgggggttcctggacactgcctctgagccggcatggccctagccgtagcccgtgcatccttccatcgcgccgtctcctgtcagcccgcgtgctccggatgcctgcatctcgcctgcaccgtgccatcgccttgtctccagagcaggccctgccgttggacctgcatcgcgtgtaggatagcgtatgtcagtctactgataggcaccttagctaacgaacccgtgtacctggtaagattttagcccagggacccgagaagctttgcaaccgtgtgtaagtccgaggctcgtgacaagtcccattgactcagcagacggaacccatcctggcagcaactctcgattg

SEQ ID NO: 702654 - DNA, 1273 bp, Homo sapiens
  misc_feature (814)..(814): n is a, c, g, or t
  misc_feature (1273)..(1273): n is a, c, g, or t
gctcatctgcatgacctagcaacgggtacctctgcattgcagctaggcagcgaggggccggtacagcgactacttcctcttcagctcggatagcaaggcatgtgcgctacgtggatactcacaagaagcacttgctcacttgtagcattcaaaccttcctactggacgtggccgttacctcgagattgcaggctgggaatgattgctcagaaagatgttgaatgaccgtgatatccctggatccaatgtcaatcccgttcttgcctccgtcgttctgttgacagcagtgatccaacgagcacctaggaacacttaccatcgagcgacagcgaacaacgagcgatcggcccgtgttcctcttgaacgaggaccgttgttgaaccctactacaaggtcctcatggagacctaaggttggtgaagttagaccgtcgccacaataggttgttgtgtgtccctacgttagagtcaaagggtccatggagggtaacttaaccacgcaactcccttccagtgcataattagaggaggagggcaatagggaccgaatccctcgtagatggcaaggtaacatgtgtgctttctttctcccctctatcggtactcaatagtcaacttctttgtaaagggagggcctgagcactggtgtctagcttgtgttgtctctgctggtgtgagttgcaatattacctactgctatttagttacgttccttgtcttgtggcggaccttccggaaatgagaaccagttggggaagtactacattgcaataggcctatgctccgccattcgttgtggtgtcggccacgaggtngtgtacttgtgaaaaaccgataagcaagttacgcactgagcaacgagctaacacagcgttgcgcagaggcgatggtggtgttatagtaccctgtgccccacctgcgcggggtgcattgccaggttgcgacaagtgccggaaaacaagggtgggtggtatacaaaccaatgttgacatgcgcgccaagagacggcaatgtacgggagggtagagaaccaaaggcgttggcaccgttatgtacaaaagctctccttgtggagagctagggctataccccttgaatagaccccacccagagagtaaaaaccttccgaggcagatcttatagagctacctttacccacaaagtaattaaagcgagggtccctagtggagagggaggctctagagaaaggactttaatgggtgggagccctcgaaggttccggctctgttgggattgagacctcccacccggan

SEQ ID NO: 702655 - DNA, 151 bp, Homo sapiens
tgaatccccgacccccctaccccatgctgtacttgtggttttctttttgtattttgcatttgaccccggggggttgggacagattggcgatgggccgtcccctttccccttggttttgcactgttgccaataaaaagtttttaaaaacgca

SEQ ID NO: 702656 - DNA, 454 bp, Homo sapiens
  misc_feature (1)..(1): n is a, c, g, or t
  misc_feature (27)..(27): n is a, c, g, or t
  misc_feature (31)..(31): n is a, c, g, or t
  misc_feature (126)..(126): n is a, c, g, or t
  misc_feature (130)..(130): n is a, c, g, or t
  misc_feature (193)..(193): n is a, c, g, or t
  misc_feature (250)..(250): n is a, c, g, or t
  misc_feature (342)..(342): n is a, c, g, or t
  misc_feature (405)..(405): n is a, c, g, or t
  misc_feature (438)..(438): n is a, c, g, or t
nctgcaggaattcggcacgagcagcgnccantgctgccctcaccacccgcacccctcgacgcctgaacccagctctggggacccgctgaccgcagatgagtggacccttggctggtcctgaatgantttntcctgagctccccggccctgctctgtctgccgtctgattcctgtgcactttctggtggttganagagcccaggcccagaagacccaacccaaggctcagatcctggggtcaccacccgcnagctctgtgcgtggtttccctccctagaaaacgggggaaattaaggcctgctgtgtatggctgtttggatgcaatgaatcagatacaacggncacacaaagcttgagcccgggtcttgaggtttctatgtcttgaggaacatattatgttctccngtgaagtgctttccttcttgcttaaggggtttngggccatagagttggg

SEQ ID NO: 702657 - DNA, 131 bp, Homo sapiens
tcggggtggtggtggggggcaggagtcaacggatagagcatatcttgcttggtttggtgtggagacaagttcttactctgttgcccaggctggaatgcagcggcacaatcatagctcactacagcctcaac

SEQ ID NO: 702658 - DNA, 659 bp, Homo sapiens
aacatggtgaaaccctgtctctactaaaaatacaaaaattagccaggcatggtagcaggtgcctgtaatcccagctaccggggaaagctgaggcaggagaatgcttcaatctggaaggcagaggttgcagtgagatgcaccattgcattccagcctgggcaacaagagggaaactccgtctcaaaaaaaaaaaataaaagtgccttttaggccggatgtggtggctcatgcctgtaatcccagcacttggggaggccaaggcaggcagatcacttgaggtcaggagtttgagaccagcctggccaacacggaaaaccccgtttctactaaaaatacaaaaattagctgggtgtggtggcgtgcgcctgtaatcccagctactcaggaggctgaggcaggagcatggttgaacccgggaggcagaggttgcagtgagctgagatggcaccactgcactccagcctgggagacacagcgagactctgtctccaaaaaaaaaggtgttttggaaaatgttgaggttgaaatgtatgggaaccaaattcttggattagtggggagcataatagcaaaacccccttgtgttcgacatgtacgggaatggcacccagttggggcacagcatgggattccccgcctgaatgtgtggtgcaagtggg

SEQ ID NO: 702659 - DNA, 992 bp, Homo sapiens
  misc_feature (674)..(674): n is a, c, g, or t
gaggcgctgccgtgcctgtcgcgcaagggacatcgtgtcctcccaggtttgatggcggtcaggcggggtctatgccaggcatcggggcgcgtctgcgttgcgcccgacgtctccgtcggcttaccttgtgcctatgaggtgatttgaagggctaggggccgatgagattcgtaggccctgctgctggagcctgtccctggagtttccccgtgcccatgaccaagacccgcggtggctgccctcatcagcccgtccgtcttgcactcggcagagcggtcctggtcaggaaggccggctcagatgttgcaactcggattcagtgggcccccttgacgcccaggtgcctgagattagaatgtgccatgcccgctagatatagacggacgctctacgtagtggacaaccaatcgagcggtacccagaggaacctaagctttatattcgcatgggtaacttcttacaacattttcccaatctccattgttgtgcacgcctaatttcacaaccagatgatatatcacctgttcactcccacttcttgacatacgcttacataatttcgtgggattcgaccccccttgatccctacaaggaccatttcctaaacacacaagtattgatactccgctcaaagtgaatatacacggtcaatcgttaccgtgcacaccttgcgntgtactcttctaggggcaccatgcttagaaatgatcgtcactgggagatagtgatatttcctagctcctatggcgtaaacaattgtagtgcgcccaggaaaaggctataccacagtgtataacctgaatagaacaccttattacaccaagcaaatgtcttggtgtaaaaccagaagttggtactcataacacacttccccaatggcacgccgcgaaacagtgtgaatttgcaccagtatttacacacccttgagacatttcttaggcggggatgcacactgccccaaaagaatgatcttgcaaaaattagtacttccc

SEQ ID NO: 702660 - DNA, 414 bp, Homo sapiens
catgagatttggtgggaattacaaagatccagacccatatcattccacccctgtctccacatctcgtgtccttttcacgttgcaaaatacaaccatgccttcccaacagtcctgaaaagtctttactcattccggcatcaactcagtcaaaagtctcaagtctcatctggacatgaattccttccacctatgagcccgtaaaatcaaaacaagttatttactgccaacataccatgggagtacagcttattgggtcgctctccaaaagggagaagttgaccaaaagaaaaggggctacaggccccaatgcaagtttgaaacccagcagggcagtcattaaaacttaaagctcctgcagtgagccgagattgcgccactgcactccagcctgggcaacagagtgagactccagct

SEQ ID NO: 702661 - DNA, 882 bp, Homo sapiens
aaatacaataaaaaaaaacaatagcatagttctcgatcttttgtgccccaaactagacccatacatggtttagactcattgacgtcacttctcgtaataaatcgcttccaatagcccacgggcacagaactcctttccagcactataagtctcccccttaagttcttcctttgtacacctcccatgtccctccttttgcaaatttgatccggtgtcccaattctgaaacttgaaattttaaaaacccctgtaaatgtaaattctctctgttccttcgggacaggtcccgcccaaaagtccaaaggtttaatcggaacagtatagctcctcccaagggatcctccttctcccaagttttccgtgaaatagttctagcctttgtttccgaagaagacgtcgaaagacaccagccctattttgttgtacaaccaccctctttctgctgaactaaaaccaaacccttctcctccccctccttgtgaaagacaggaaatttcctctttttcacaggaactcgagtctcccccaggtaagccgttgaacatgatatggatccatgttccaatcagggggataacccatacccatctggcacaaagtcataaccccaagcctacttttttattatagtttacatgctcggtatataaataacgaccgcggcatctaatcatcatgttaactagagggtaaaacacggctttttaatgcgaccaattcgttaaacatcattacagagccctcctttttatttcacaccggctaggtacagccccacttcacctccatccaccaatttgttgctagtacccatttgcaggggaaccgtgggttccctcaatttggagaaataaaaagacaagccttcctcccaaacaagac

SEQ ID NO: 702662 - DNA, 211 bp, Homo sapiens
tacccactagtcaaatattcactccactatgcatataccatgataaggtagagtgtattatcagtattcaatgacttcgaataacttcactatatgggatgatttacaaatcttcattattcttacttactctgaagagcttttgtagacttgtaaggcttcaaccagagttttgtcaattgatttttattcgcacacctctactgcctgt

SEQ ID NO: 702663 - DNA, 1045 bp, Homo sapiens
  misc_feature (222)..(222): n is a, c, g, or t
gggaccttgtggggtgagtctggctttttggctggcaactccctggccaagtgtgagcacctggaagcaaaaggatggggcaggactccagcgctcgcgggtgctctctgtgtggccacggggagaagaggctttgggcggcggcgggtgccaatggtcatgggcagatgtgtgtgggctgtgaccccgcacgtgggctttggactggcacagatctgaagntggagcctggctaggccttgctgtgggctggactttggcggaggaggcctctagtgggggccagggtgtggtgggggagtacgggtggcctgctgtcttgtgttaccagtgtgaccttcgagctccgaagaactgcctggtccctgccttaagctcggtcgcatttggcggcccagatgctataaccctgtgctcttgagcgctcaatccttgtccacgataacaggacgtggagcaccggtccaccctccagtgagggcgaaagaactcgctgtccatgggatccacgccatgcgcagatcgtggcgctcttcggggtcagcaggagccgccttatcgggggcaatagggctcagctggtgacaccttctgcccacaggtgccaagtcctgccctgccaaacttcttggcagctgccgacgacaaactcagtgggttccagggggacttcctgttggccatactggtggttgagttcctggtggccgtggccagcaatggcctggcctgtaacgcttcagcatccggaagcaggccatggaccccgccgtggtcttctctgtccagctgggcatgtcagcgactgtctgggccttgacgttgccctggtggcgctatctctatcccccaagcactggcgctattgggaagccgcgtccggctggagcgttcttcttcacttgaacttgttggcaggggatcttcatcacttggtcagccttaacggatctgggattgggcccttttttgccgagaccccttgggccagccgcttgggcgtagcctccggtggctgcgccttggcgtgcaatcagtttcactt

SEQ ID NO: 702664 - DNA, 203 bp, Homo sapiens
aatctttcctgcgacagattcacgtcaccgtaactcgggctgcgcgatttacgcaccgagaaactttcgcctcccaagttcaagcaacttgctctgcttttgtctcccgaatagtgggactactgtcgcccgccaccatgcccagctgctctttttcttttcagtaaaagacgggtttacaccatgctgggggagtcccgagc

SEQ ID NO: 702665 - DNA, 107 bp, Homo sapiens
tcagttagggagcatacggagcatcagtagcagcagcggagtgtccaaccaatgctcgttactgacaacacaacatacccccagcagacgtgaccgctccgcttact

SEQ ID NO: 702666 - DNA, 626 bp, Homo sapiens
  misc_feature (235)..(235): n is a, c, g, or t
  misc_feature (342)..(342): n is a, c, g, or t
tactttcagggcaagcagtaattttggagttttcagaacttttaccaatattcagcttgaacttgtttgtaatgaattttaaagaaagtcatgaatatatagattgattccctttatcactgttcttacccagttctggttcttgagactttttttggtggggggcaggtgcaaaatggaaaacaaatttgcttgttttgtttctcagatgtcttttctgtcagagtgcatgttntaaaattagctttaatcaagtataaacaaagaaatattagaaaataattaaaatttaactgtgaaacttaatctatgtgttgctactcttaaattatgggattgtanctaaaaagtgaaaaataatttgccttggcttaacataggacagaaacatgaaccagcaagctgaactctcagtgtctgtttggactaaacttaatgcatttgtgtaaaatctaccagaaatgaattcaaagatgataggtagtattataaaagcttcctctcttacaaagactttacctcagcataccagaaagagtgagcccctacagtgcatgtttatttctgaagatgaactagagcactaggcaaacactaaattattaagagctaaactgaaccggtta

SEQ ID NO: 702667 - DNA, 601 bp, Homo sapiens
  misc_feature (9)..(9): n is a, c, g, or t
  misc_feature (27)..(27): n is a, c, g, or t
  misc_feature (35)..(35): n is a, c, g, or t
  misc_feature (69)..(69): n is a, c, g, or t
  misc_feature (114)..(114): n is a, c, g, or t
  misc_feature (137)..(137): n is a, c, g, or t
  misc_feature (154)..(154): n is a, c, g, or t
aatattgtntcctatcactcatccccncgaggtgncaattaggcatctgttgcttctcccttgtgagtnccacacccaactatcaccaggcttttggagaaaacttcttaccangaaaaagatcaaaagaagcaaanggacctcaacagaagcngaaaattcaaccattgacaaaactatgattaatattcttggtgagatgagaggagattttgcacctgtgaaacagtgctattaaaaagacattttagccaagaaaaacctcatggatattaaaaaaatgttggaagaaatgaaaaattcagtaaagagttaagaggttcattctaccagaaaatagaatgaaaagataaaaagatagaatgtaggtaagaatagataaaattagtgggtcattctagaaggaccaatataaactatagataaatagaacagagtaaaaggaagaattagcaaagcataattagagaaaatttctcaaacctcaaagggcatgagttttgagattgagaagacctactgccttgcctctatagtgaatgtttaaagatccacgcaaaggcatatcatcatgacgttttagatcctacaaacgaaaata

SEQ ID NO: 702668 - DNA, 116 bp, Homo sapiens
tgagggcccgggcgctcatcccgaccccgtcgggaccgtcggcggtcagggtccggatggcagtaagcaccgaacggtaattggccatcggctcacccatacccataaagacaatg

SEQ ID NO: 702669 - DNA, 838 bp, Homo sapiens
ggatagtgctgacactacaaggctcggagctccgggcactcagacatcatgagctggtccattgcacccccggaaatttgaattcatctacattctatgctcttcttatttcttctcttcaactatgtgtagcatatgtagctaccagagacaactgctgcatcttagatgaagagattcggatagtttatttgtccaatctacctgtggtcgatcgcagattttacctgtctacttatcaaaccaaatgtagactagaggatctacagtctttggcaagacattcttacagtctaacgttgaaaacggaaatcatacagaatgtcaacacataactgatacaaaggcaatcgcaactcacttataagtcctgtatgaatctagtcagaaacaaattatgatagtacgcgtggtacttggatagtcccaggcaacaatgttaagaagaaattcatgcaagtatgaagcattgattttaacatatggactcaagtattcggatatattgctggaaatatactaagttcaacaataagtcaaacagattgttaaacctgaaaagtagacaggtatgccctagctctgaagctacagtgccaggaaccttgcaaagacacggtgccaatccatgatatcactgggaaagattgtcgacgacattgcccaataagggagctaagcaagtagcgggcttaactttaattacaaccttctgaaaagctaaccatagaattctcaagtctagtgtgaaatcgatgggtctggaaatgggttggactgtgtttcagaagagacttgatgggagggtagatatgcagacatagtggattcggcataa

SEQ ID NO: 702670 - DNA, 994 bp, Homo sapiens
tctatattgtggtcaggatggtagcccggtattccattaagcaagcgagaggtcattttcgaccgtggtcaacgggttgatactttacgccctgggcaaggtgtagggctggcggtagcccgcgaaatcaccgagcaatatgagggtaaaatcgtcgccggagagagcatgctgggcggtgcgcggatggaggtgatttttggtcgccagcattctgcgccgaaagatgaataaatatgcccatacttcacgcattacgttaagcatccgttataatcggttgcagataccagcctgtggatgcttaacatggaatacaactcaattctttactggggcccgattttcttgaacgtctactggcgagaaacagcgcccgtggtgtgtataaacagcgcggttcttatataattatatagacccgatctctccagacgagttggcggcgtctggcgatggaaagcgaagttgacagtcgactggtcagtcaccaggatggcaaatggcaggtcagccacggccgttcgaaagctacgatcatctcggtgaaaccaactggtcattactggtacaggcagtgaaccactggatgagccgaccgcgcgcttgattgcgaccgttccgtgaactaccggacttggcgtcttgatgatctgattgatttccttttctgtgacccggcgggcggcgttcggcccgacatcttcgactcagtaccgacgtgtttatcattccaggattccccggacgttcgtcactggcgagtgggcgaaaaagcttgcatatgaaacaggagtgccaaacatccggagtcttgtacaaggtcgacccgtcgaagccatctatcgtgaagagggtgagcctggggatatcttaaatttccgccagaatccgattaaaggttccggctgatactcgatacattccgggggtacgggccaatacgggaacgatatggatgcacatttgtcgatgaaggggcattacagccgtc

SEQ ID NO: 702671 - DNA, 100 bp, Homo sapiens
gttgcagaaggcggattggaaggacatggaaggaccagagagtgaaaagttggaatgagaggatgttaaggggtggcacggaagcaaagttgaggaaaga

SEQ ID NO: 702672 - DNA, 199 bp, Homo sapiens
gctcaggagtgtatcctattagatagacgatgactacgcctctgcgacaggatcgagagcagatgaggatagtatagagtccagaggcagacaaatctcgaccacatcccaagatactgtagactaatgctgactccaaaagtggaaaccaatacgctgaatatacagaacaagatacctgttgacccaggtgcctggg

SEQ ID NO: 702673 - DNA, 329 bp, Homo sapiens
aaccagatgagtgacgcgagaaaaaataatagaagagataataagtacgaagaagaaacaaagaggggggctggggcacaaatgaactaaaacaagttgaataagaagtaagcgcaaaaagtatggaaaaagcaaagaaaagagggggaggacaaaaaattataattaaattggagaaacacgtataataagaataacgtagcatggggacctagcagtaattgcggtggactagggaggaccaccagctacctgataaactttaaagcacgtcatagcagaaaaggtgtaggcagataatggccagagcatgacacttgtagggacga

SEQ ID NO: 702674 - DNA, 1257 bp, Homo sapiens
gttgggtgtttcctgcttcaacagtgcttgtgactggaacccgtgctgctcgttccccaccccgtgcctggctgcccatagccagccctccgtcacctcttcacctgcaccctctgtgactgccccaatggcccccgcctgcctgcatccagcgcctgctgcagccacctgccgcctgcctgcctgcctctccttagtctgcctgccatgacgacctgctgtccacctcgcaggtgctgccagaactaccaccatgtgactcatgagtgcctgccatcaacctgccatgatcaacctgtgagctctactgcctcctactgtttacctgtccatgtcttactacttttgaccgcgatgatgtggcttttgaagcaactttgcccacatactttcttcacccaatctcatgaggagcagggacacatgctgcagcaacactgcatgcaagctgccgcaaccacatgcaggttggccgcacatcttccttcaggcatctccagacaacctagacttgtgctgacttgggaccagcgtggctgcactgcccctgcgcttgtgcattagcatcttggcaccacacatgtgacttcacgtccactactggacactggcacacaactggcccactgccccacgccatgcaccctccactgtggtgctgacttcactatgccgacacagttcaccttgacattcatccagggtgaacggccatcacgaccaccttggcgctcaactatgtggcaccagcttgccgcctcgtcatctcgcgccccccgaattctggcgttgccggcatattcgccttgcgcaaatgtcacccccatgcgacccacactggacttacttcccaccctcagtccattcgggctaatttccgccataacccgatgcgttggccattccgtatcccccaggtgggctatgtcatattgggggacttcttgtacctttcccatctagagcgtatcctacacatcccatctagcacctcgacgcgttcaccactctctcaaacaaacaatatcagtccccccccaccacaccccatcctcactcacatcactcacccccccccccccccacgtccccaccccacgacacgacaaacaacactctctcctcacaccctctctcactactccatcccttatcctcctcaactcagcccacatcctcaccccgccatcacacatcctcatacttcttattagcatatccaccaacccacacctctttactagtcgtcctttcgcg

SEQ ID NO: 702675 - DNA, 1440 bp, Homo sapiens
gctttagaaagcattgttttagtccaggcacagtggctcacgcctgtaaggtgagaggtgtgggagggaagagcttcggttcaaaagaggctaggggatgtgcgtgtgcttgattctccagccatggtcacgacagggtctcccaggagccatcgatggaaagccctggagggaatcagcatgtgtactggtagctatgaagctttctggcaaagctgcagtctgcgaaacagcgtaggtcaaactcgaagcataactgtccaggagctcgacgtgcataggtggccacaggttatttggggacagcataaccagactcagcatgaccgtgaactgacctatctcagaacgctcccaaagactgggccaaagacgtgctggacgaaacacgcagcaaggaaagggaagacctagaggcaactccgagcgcagctacgcacgaacagcctcaaccagaaaccacaacgcaacacggcgccgcccccgacgaccccacgcaacccccaccaggcccacgctaccgccggggcacacaaagcagaccagtcaagaaaaagccatccgccacccaagccaggaaaggcaccagtaaaaaaaaaaacaaaccaaaaacacgcaaaaaaaacaacataaggaagacaacccgacacaggaaaaaaaaggacagaaaaaacacacagacgcaaaacccgagaaaaacaacacaggaccagcacaaccaaggggagcaacccaatgaaacgcacggacacacagacaacgcacacaccagagagcaaaacaacgagaaagagccacgcagcacaaaccgagacaaggaagaaacaaacacaaagaaaaaaaacgaagacaaaacaaacaaagaacaacaacaaccaaacagcggagacagacaggagcacgcgaccaagaagacgagaaaaacagcagaagagagacagacagcaaccagcagccaagaccgaaccagaaacagaaaacgacagacaacccacacaaaaagaaccacaagagcaaacgagggcaacagacagcaacagagaaagacggcgcagcgacacagaacaaagccaaagcagcaaacagaaaacagagacagaaggacaaggagagcaggcagagaaagacacagacaagaacaaagaacgcagaaaagcaagacacagcgaaaagaaaacgacacaccgaacaacgaaacgaagaataacgagaaaacaacagacaaacaagaagagaaagacagaaacaacagactagacgacaacgaaagatgaaacacgacacaaggacaaacaaaaccacaagacaacagcaagaagcacagaaagacagaagacagacagacacaacgcaacagcacgcaacagcacgacgacggagagaaaagacagacggctcaggggacgatactcttatcactgatgcgcgctcgcgcacacc

SEQ ID NO: 702676 - DNA, 414 bp, Homo sapiens
  misc_feature (150)..(150): n is a, c, g, or t
  misc_feature (187)..(187): n is a, c, g, or t
  misc_feature (191)..(191): n is a, c, g, or t
  misc_feature (211)..(211): n is a, c, g, or t
cacgcgtccgcggcttcccttccacagcacggcgaccggggcttcccctcagcagctgccggcgcctcagtctccgcggccagcccagctccgccgcgtccgcggcccgccgccgccatgcagtttatgttgctttttagtcgccagggnaaagcttcgactgcagaaatggtatgtcccactgtcngacnaagaaaagaagaagatcacnagagaacttgttcaaaccgttttagcacggaaacccaagatgtgcagcttccttgagtggagagatctgaagattgtttataaaagatatgccagtctatatttttgctgtgctattgaggatcaggacaatgaactgattaccctggaaataatccatcgttacgtggaattacttgacaagtattttggcagtgtatgtga

SEQ ID NO: 702677 - DNA, 1064 bp, Homo sapiens
  misc_feature (16)..(16): n is a, c, g, or t
  misc_feature (65)..(65): n is a, c, g, or t
  misc_feature (67)..(70): n is a, c, g, or t
  misc_feature (72)..(73): n is a, c, g, or t
  misc_feature (76)..(76): n is a, c, g, or t
  misc_feature (110)..(110): n is a, c, g, or t
  misc_feature (167)..(167): n is a, c, g, or t
  misc_feature (176)..(176): n is a, c, g, or t
  misc_feature (192)..(192): n is a, c, g, or t
  misc_feature (197)..(197): n is a, c, g, or t
  misc_feature (212)..(212): n is a, c, g, or t
  misc_feature (224)..(224): n is a, c, g, or t
  misc_feature (237)..(237): n is a, c, g, or t
  misc_feature (272)..(273): n is a, c, g, or t
  misc_feature (289)..(289): n is a, c, g, or t
  misc_feature (293)..(293): n is a, c, g, or t
  misc_feature (298)..(298): n is a, c, g, or t
  misc_feature (308)..(308): n is a, c, g, or t
  misc_feature (327)..(327): n is a, c, g, or t
  misc_feature (345)..(345): n is a, c, g, or t
  misc_feature (390)..(390): n is a, c, g, or t
  misc_feature (596)..(596): n is a, c, g, or t
  misc_feature (636)..(636): n is a, c, g, or t
  misc_feature (646)..(646): n is a, c, g, or t
  misc_feature (745)..(745): n is a, c, g, or t
  misc_feature (783)..(783): n is a, c, g, or t
  misc_feature (828)..(828): n is a, c, g, or t
  misc_feature (873)..(873): n is a, c, g, or t
  misc_feature (901)..(901): n is a, c, g, or t
  misc_feature (926)..(926): n is a, c, g, or t
  misc_feature (934)..(934): n is a, c, g, or t
  misc_feature (942)..(942): n is a, c, g, or t
  misc_feature (963)..(963): n is a, c, g, or t
  misc_feature (965)..(965): n is a, c, g, or t
  misc_feature (984)..(984): n is a, c, g, or t
  misc_feature (992)..(992): n is a, c, g, or t
  misc_feature (1004)..(1004): n is a, c, g, or t
  misc_feature (1057)..(1057): n is a, c, g, or t
tcttctacaccccccnattatatcaaaaaacaaaaaacaacatacacccaccaaacacaaattcncnnnncnnccnaacccccacttcacttacatccctaacccaactnacaaccctcacctctatcccccctctcccttacccctcctcttccccctcctcaccnaaattctcntcctcttcttccctcncatcntcctattcctcatantcacactactanctccttcatcttnctctcatctcttcctcaactccatctcctctattnncttcccttttttccanttcnccaancccttccccnccaacatcccacttaactnctcccacattccctttanttcctcctccatccgctcttctattcccaattaaccgtcactccnattttcaccgccaccaccgtccgcatctcacacacccctcttttcacatttttccccatccattccacaaactacctcctcttcttcttctccacctttataccatcttctcatccacctccttcatccacatcccaccacccaacacaccccccaccctcacctatcccccctccccccccttacacccacccatcatcttcttnccatccaacacctcctccctcatttcccccactctcacanctccatactnctcccttccacccctcctcacacccccaaaccacccataaacaaatccacacctcccaaccccaccatcttcactcccaacttccccacctcaccattnacctccccacccaaacccacccacctcctcacacactnatcctccctcacacaacctccttcacatccccctacttctctctnctcaccttcacacttccccacacatatcatacacccctccttctnaatccatacctctatcactttctctacnactcatccacccacaccttccattntaccctcnacaccctntaaaactttcctcaaccacanantcaactattatcatccatncctatctntccatctcctanaacaaatccattcaaactttcccccaataatactactcaacctcacactaacntttctct

SEQ ID NO: 702678 - DNA, 227 bp, Homo sapiens
caatgatgtgaacggcccagtttcttgaagtccagtgtttccacggctggatacctgtgtgtctccataaaagtcctgtcaccacggccgttccaggccttttattccagcgtcttctaaagagcttagtgtctcacagcatgcagggtggtccgctgctgcttaccttcggaatccagtgcttcccacagagcattcagccttgtagcttatcattttgcagcatt

SEQ ID NO: 702679 - DNA, 880 bp, Homo sapiens
  misc_feature (188)..(189): n is a, c, g, or t
  misc_feature (352)..(352): n is a, c, g, or t
atgcaaagcaagaaaagaaggtaaagcggcgtgtggcctctgtatttttaatatgatttaaggggaataaggggagaggagagatcaagagtgctacttgcagctgtagaacttgaagtcgtgggaaactatagagtcaacacttgcaaactcaagcactggataccgtccgggagaggcacttgacnnctgccttagaagaatttgaaaacaattttgtaggccaactttcagttatgaatcaaaagcattaggttttaaaaaggaaaggaatttccttcttgaccatttaaaatttgcattttttccacagaaacccagcagacattcaacccattcccaggacttgtanatttaatggaaaattcgacaagggttgccaaccttgcggtattcttctcttctaatgaggagggaacaggggaagtaatttttgaggggaaactggggaacctttaatggggagattgggcgaatcttgccttggcaagaaatggtggtggcgcaaactccccggggaaataactgtaagcagttgattatataaaatgtggggttttcttttggtaagggttaggtaggattgggcagtcctttctcatagaggcggacagaaatttgtgggtattagcaatgattcaatcgtgcatatccactctttgttgaaacatgttgactgtcttggtacataatagtggtgctattatcgtctgtatctctatagggtagttatcaagacattcattctttgcaccctcgccttttgaaacacaaacaggttcggatttgtacgtgatgtaactcgtgctagacgctccggctattatgctgtcatctagcacctaccttgaggcctacctagatacgcatgtttacggag

SEQ ID NO: 702680 - DNA, 951 bp, Homo sapiens
gccgagctggaggaggctgggtgtgggagtgcgttgtggctgtgtggaggcaggcctagatttgggtgcaacgtaggtctgattgagcttgtgttgtgctgaagggacagccctgggttctaggggatagagctccgctgatgtgtgagagccgccttcccctggtcccaggccctcccagttcccccatggaacgggccgacttcctgtgtcgcccgacgtcgagatgcatgtgctgtagagaacaagcggcagggtcgaagtcgtgcggtgtagagggctgggcatgtgatgtgggccaagaattgggcaacgtgcccgattctcccagagcactgtctcgatggtactgtggctcgagggcagtccccttcaatgtctagcatcggtagacgaccagggaggcggaccgatgaccagtgcatacaagctgtgcccatgggagggcaagcgtccactattccttgcggtatggcactgaagtgctcgacgagacgatccgaacgaagattgacggaatttctggatggcagtagctgatgccctcccaggtacccccaagctggccaagcttctgaatccctgagtctcaacacagctgggctggacagtattggccaaattttctgcctacatcgaagaattcaaacccagcactcgaatgacaatctggagaagggactcctgactgccctgaaggttctagacaagttacttagcatcccccgtcccagaagaagtggatgaaaccagtgcttgaagcatgacggtgtctctcagaggaagtttatgggattggcaacgagctcaccctgggtgactggaacctgttgccaaagttacacagtagtacaggtggtgtgtaacgaagtaccgggggaattcaccatccccgagggccttccgggggagtgcatcggtacttgaggcacatgcttacgccgggaagat

SEQ ID NO: 702681 - DNA, 294 bp, Homo sapiens
gcagaagttgcagtgagccaagttttcaccactgcactccatgtgcgatagggagactctgtctcaaaaaaaagagacgaaggcgaattagatacagaaaccattcttcatgtatcaaattattaacaatgaggccagtcacggtggctcacgcccgcaatcctagcactttgggaggccaagttggtaggatcacttgaggtaaggagttcgagaccagccatgccaacagtgcaaaaccccatctgtactaaaaatacaaaaattagccaggtgtgcctgtaatcccagcta

SEQ ID NO: 702682 - DNA, 200 bp, Homo sapiens
aggatagagtgatctaatagagccattgtaacgatggagctgtgcctgtggatgagctgttgtggggcatgtaggctcatctgcggagactgacgtgactgtagggtatgggcctaatataggccattgtgagtcatgatcttggtctgtagaggcttgattggagaaagttcttgggcctctagcaggcaccctgtgga

SEQ ID NO: 702683 - DNA, 392 bp, Homo sapiens
tgctcccttccccctccccggtgttatcccggagaatgggttttttgttgaaatcccaaattttttggggggaaaatacctccgccggggttgggtgaggcccgggggtggttggtccggatttccaggcccgaaagatggatttatccctgaagggaaaggccttggggttggtttcaattcagcgggtttggttcagccagccccccccggttaaaaccagggtatccgggaatttttgggtggggtttttgtttttgaaaaagggactggtccgccgggtggtggattaggttttaggggttcctgggttccgaaagaagatggccggtggccctttaggcccccttggggttttttaatgatgccattaaaggccttttggtttggga

SEQ ID NO: 702684 - DNA, 131 bp, Homo sapiens
tcatattctcctcctgcctcagcgttcccgagctagctgggactacaggcgcccgccaccttcatccagctaatgttggtgtatgcctgtttagtaccagacgcgggtttcaccgctgttagccagagatg

SEQ ID NO: 702685 - DNA, 127 bp, Homo sapiens
cactgttgttcatacatgcactgttgttcatacctgcactgttgttcatacttgcactgttgttcatacctggtcgctgtatctgtgtgttggcgcctgagtatgcaaggtggtatttaacaacagt

SEQ ID NO: 702686 - DNA, 513 bp, Homo sapiens
cgatggtgcaggaggttaaggtgtagatctgaagagtccctgtgggattattagaaaatagatgctcccagagcaaaaacactgtcagccaatgttcagccagctcagcacttagattatctttggtgtgcaagataacagacttgaaattgcttttgaaatctctccaagactgtccatcccactcagtcttttatgtcaccgtctagtgagttaagttgtgaaaaactccaattttccttaaatatagttatacaaggctaaaatgcaaggcattttccatgatcacacttcaccttgccacttatgatacatgttgggcagtaaccctttcctgatgcgatctaccaaacagaaccaaaactttatggggaaaatacccatcttagaagacttaaaaaggaaagaccttaagaattaacacattgccttatgggggaaacaagttgaactttacaaagaaaaaaatgttaaccgggcacctctgttgcacaatgaatagagttaatgttt

SEQ ID NO: 702687 - DNA, 212 bp, Homo sapiens
ggctggcgcagctagtgtgaacactaacgctgcatgtccatggcatcttgggctaaacaaacaggtgaggcctggctctgtctacacagcagccacaaacgtgactgatcagcaggaaatctgtagtgcacaaataatggtagagggtgtgcttgtcagcattagacaatgactcccaaatgtagtgtaaacccacaaggatgggtcaactc

SEQ ID NO: 702688 - DNA, 389 bp, Homo sapiens
  misc_feature (52)..(52): n is a, c, g, or t
  misc_feature (383)..(383): n is a, c, g, or t
ccagggaaggaacccaatcatttgctctttacaaaaagcaacacatttctanaaaacccaacagcatgggaaattcttcaaataagctcttcccaaactggcacagtggcccatgcctattataatcccagcactctggaaggccaaggtgagaggatcgcttgggccccaggagtttgagaccagcctgggcaacacagcgagacctgtctctacaaaaaaaaaaattaaaacattagccgagcatggtggcatgtgcctgtagtcccagctactccaacaggctgaagtgggaggactgcttggcccaggggattgatggagcagtgagctgcaatcgtgtcactgcaatccagcctgggcaacaaagcaagatcagaccncaccgc

SEQ ID NO: 702689 - DNA, 273 bp, Homo sapiens
gctatttttagggaaaaaatatgcattcaagtttacatagttttttttgagcggggaaggaaatatactcacaataaggtccattatacaaattcctacttaagttatggccttcttggggttttaaaagaatagccccacgaaaagaggggagaggcctaaatttgggtaatctaggaaccccaggggaaagttggcttaccttggcattgaatatccggggactatctaaagtttgcgggttttgttcaagaagggcgggacctgctgaat

SEQ ID NO: 702690 - DNA, 957 bp, Homo sapiens
ttgccctgcccccccgtggatagcagagctggtggttggaggagcacccatcgcgattgtgtgtgtggaagagccctctgggagccgtgtttttagcccaccaccaaggagaggtgttgtctccacccgtgtgtgggcaggacgaggagcggcagcagctttgtctttgtggcggacgcacactcggttttggttgggtggcaccgctgtgtccgccgaaaaccctctcgtgtgaacagatcctccgtacctatgggggttgttaaaaccttttgaggggcctttctccctcataaacacgggttcgttgaggagcaccaggcacgttggtttgcgccgctggtacgtctataatactggtcgtccgagcgaagcgttgtcttacgccccgggtgggtttccacgcaggtgtcaccacaggcagcggtccacctctcggcacgctctttctgtaaggggcacacgcgcgtggggttggataggagagggcggggtgggtacaacaaacaggtcctcactcgggcggcggtctcaacaacttggcacagagcgccggctcgctccgctcgccaccccgcccgctcgcgttttgtttctggggtctatgccccgcccccccgctcggcggggcgcaagaattgttgtctgtccccggcgaggtgtccccccctctcctcccgcttttgggtgagagggaccccgatgtgtgtgtggggggccaaaaaaccacgcgcgggaggaatggtggtactccgcctgtcgggtctcaaattactatcgcgcagacctcgtctgggtgggggaaacaacccctcttccccctggggttcctcctccttttcgcgtcgctgccttcttcgtcgggacaacgtgggtgcttgggaaggggggcccccaccccggggggggccgacttgggggggcccgcggggccccccaaaggcttttgccgttgga

SEQ ID NO: 702691 - DNA, 315 bp, Homo sapiens
gtgtaacaatgtggctgaggatatggatttgtagagcagatggccttgagatttggtcctgtatggccagatctggtgggcatacatggcattcagtagatctatctttcaggttgtgtatttctatgagaagtcttgtaggaaatatgactattactggaagtgaggtgctgctcaagcagatcacatattcgtatatatgagcacatgcggagctggtactgtaggaggtatatgtggtgggtctaagtaacatgcggggagactcgatacgtcatgaaggaattgaaagcatggtatagatgcgaacagatc

SEQ ID NO: 702692 - DNA, 889 bp, Homo sapiens
  misc_feature (761)..(761): n is a, c, g, or t
  misc_feature (768)..(768): n is a, c, g, or t
  misc_feature (785)..(785): n is a, c, g, or t
  misc_feature (829)..(832): n is a, c, g, or t
gctgtggccatctttccttacacgtggggaggaatcagcctgagaatgaaaccatcacaggaaagggctgaaagacggtgagtgtgtgctttctaagggcagcatttgggccttggccccagccggccctgaagccagcacaacccccggaacgtctcaatttgtgagccaataaatgcccttgatggtttaggcaagttttcactgggtcttacccgacgtgagcccccactcctccatatggacctgttttggaccaatgaggcatcctcttctgtagtcctcaacacgcggagctccaccactcctgagcagtgtgacctcaggtggggttggggagaggcctcgggatggcaaggaccagggtctgcggccaagcctgtgggtcctgtctccctctaggatgcccctgggacactggtacccatggatgcactgggtgacttgaggtcaatggctttctctctccagacctaggcagaaaaagcaatctgctttgcatcagagaacctcaagaggctcttaatcctgctcttttctccctctgggctccctccgtgatgagctcatctgacctcctggcaaccccgaagggtggtttagagcagggaatcagcctcccgatttacagaaaggataactcaggccagggaagcgacttggacagggtcctgcagggactcagtgaaggaggcttcggaacccagcctgtcttccagcaggccaggaatcagcaaatctggctacctgtttttcatttnatttatntatttattttgagacanagtctcgctcttgtcatccaggctgagtgcaatggcatgatctnnnntcgctgaaactccgcctctggggctcaagcgattctcctgcctcaggctcctgagta

SEQ ID NO: 702693 - DNA, 307 bp, Homo sapiens
gcccatctcagcctcctgagtagttgggaccacagtcatgcaccagcatgcctggctaattttttaaattttgttcttaatagagacagagtcttgctgtgttgttcaggctggtctcaaactcctgggctcaagcgatcctccacctcagcctcctaaagtgctgagattacggatgtgaatcattacacccagcctattaatggttttgtatagcagtcttttgtgggtggtggaagatgaagtcctgtgaaatattgtggggcagaacctgaaatgtgcaaaccccatgggaaatttttgtctc

SEQ ID NO: 702694 - DNA, 238 bp, Homo sapiens
agagaagaccagagttgtcgattctgccctatttatgtttctactcgggcacaacggtgggtggtgtgtgtgtgtgtagcctcggtgtgggttttttcacaagcaatggggaggaagaacaaaaatattctcgggccctttacctcgatctcgctcccccctttcggttcttacggacgggtccccccctccctattgaggtcctggtctcggtactggtattggcctctagagcccc

SEQ ID NO: 702695 - DNA, 337 bp, Homo sapiens
cgggtgaggtacagtcataccacttcctcatactgtaaacctgatacccccatggttgtcagcaactctctacaggtaatctatcctgtatggtgacagttgcttctatcatcaaagcaagcaaagtgcatttctgatgacatcttcagtgatctgtgccatttaacttctcaccacacatggtgaggaacatggtgaaatcgatggggcctggagcctcattcatcatggcatactagatactcatcagttggatacttccaccaatgaagcaagcatatcatgcaaatcttacctatgtcgaatgaaaccatctctgtatctgatcaatcatgtt

SEQ ID NO: 702696 - DNA, 966 bp, Homo sapiens
gctgtggccatctttccttacacgtggggaggaatcagcctgagaatgaaaccatcacaggaaagggctgaaagacggtgagtgtgtgctttctaagggcagcatttgggccttggccccagccggccctgaagccagcacaacccccggaacgtctcaatttgtgagccaataaatgcccttgatggtttaggcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttgccacatccgacctgccgcccagctggggcaagacagccacgcgcggcggatgcaccggccctgaactctttctcgagtagtccccagagatttcaggaagagagagaagaggtaaagagaccagaaacaaagtcttctgcaagcaaagaactgcaacaggccccagctgttaggtttgaggggcgtatggggcaggcgactgaactgcagagttggagccagaggtaccattgctgacccctgagcccaggagccttgagaatactgacagtgttaataataactgcaatcatccaacatatgatgctagaataactggacatctgtgtgcaaaaatattaaacctataccttgcaccttatcacaaaattcactcaaaatagatcatagaccaaaatgtgaaacataaaactaagacttccaggggaaaacaggagaaaatctttgtgactttggggttaggcaaagctttttgctaaagacattgataagagattgaaaaaacaagcagattgccagatgatctttgcaaaacatgtatctgataaaagacttgtagccaaaa

SEQ ID NO: 702697 - DNA, 191 bp, Homo sapiens
catggctacttgactgcgtgtacatgtactgtgaccgcagaagcaacgccagaactgagcagcagttgacaggacatcaagcgtgtgggttggtccgtcactgagctcatcaggctgctgagccatgagggaacagaatgcgtagacccagagggacccacagtcattgctgagaatgagctcctgtgagc

SEQ ID NO: 702698 - DNA, 974 bp, Homo sapiens
ggcaatggctctatcacttcttccctctcaagtcccgccctttcagctacctccaatgctgaggaaacggttgcctaaaaaggagccggcaaaaagcgctacgtggagtccagaggagcggaagtagtcagattgactgagagccgttaaagcgcggtggctctcgttttcggataacgactacagctccgatgtcagtgccggccttcctcgtgtggaggggatctgccggacccgtgcaaatttcaatttctttcccattcgggcccttccctatcgtcgccccctttcacccttggatcatgtccaagaaattttgatggcacaacagaaatgtgtccacctgcctccagtgggacaaccttccaggttatatacggggtattacacgacttcaatgtgactaggacgccatctcccagggtatggaacccatgggtgtatcaaaatcatggcctaagaaaagattcctgtcaaaaattaggtccgatggccatgaccatataggaaatccttacaagtacaactggggaataactctcttttgaggacaaaagagacgggcctttttatccaacccctaagatcacttcacaaaatactccttatcctgcacaaccagcagttggataaaggagccatcaagttgtgtactcaggtggaggccaactatcattgtgtcccagggtttacttctcgtgagctaagtgaacttggtgcagtagatacaattggggtatcatcggccacggaaaccagctgcctaagttgggcgcatgaaatgtcgccgacacttggacgtcacaggattggttgagattcctattaagaggcgtgcgatgagaattatggccaagagaggggaattggttggcgtctgtgtctggccctaaccggtggacacgcgaaaaaaaagtggggcatatcgggggaagatctcgctgcaaacctcgttcctctgcgcgggtggggga

SEQ ID NO: 702699 - DNA, 1063 bp, Homo sapiens
gctgtggccatctttccttacacgtggggaggaatcagcctgagaatgaaaccatcacaggaaagggctgaaagacggtgagtgtgtgctttctaagggcagcatttgggccttggccccagccggccctgaagccagcacaacccccggaacgtctcaatttgtgagccaataaatgcccttgatggtttaggcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttgccacatccgacctgccgcccagctggggcaagacagccacgcgcggcggatgcaccggccctgaactctttctcgagtagtccccagaggtagctgctgcctttcagtttctgcacttgtttattttcaaagggacgttgccagaccacgaggccaccctgccctttcatggtttgttttatgcagatttcaggaagagagagaagaggtaaagagaccagaaacaaagtcttctgcaagcaaagaactgcaacaggccccagctgttaggtttgaggggcgtatggggcaggcgactgaactgcagagttggagccagaggtaccattgctgacccctgagcccaggagccttgagaatactgacagtgttaataataactgcaatcatccaacatatgatgctagaataactggacatctgtgtgcaaaaatattaaacctataccttgcaccttatcacaaaattcactcaaaatagatcatagaccaaaatgtgaaacataaaactaagacttccaggggaaaacaggagaaaatctttgtgactttggggttaggcaaagctttttgctaaagacattgataagagattgaaaaaacaagcagattgccagatgatctttgcaaaacatgtatctgataaaagacttgtagccaaaa

SEQ ID NO: 702700 - DNA, 828 bp, Homo sapiens
gaccagtagatctgaccttgaggaagctgtacaaactgttgagccttttcagccatgaactcttctgcccgtaccccataaatacaattaggtgcttgctgcagaggcatcgggggtctctggccagaggtgacatctgaagcaatcgggatcctgtttggttttgccacatccgacctgccgcccagctggggcaagacagccacgcgcggcggatgcaccggccctgaactctttctcgagtagtccccagaggtagctgctgcctttcagtttctgcacttgtttattttcaaagggacgttgccagaccacgaggccaccctgccctttcatggtttgttttatgcagatttcaggaagagagagaagaggtaaagagaccagaaacaaagtcttctgcaagcaaagaactgcaacaggccccagctgttaggtttgaggggcgtatggggcaggcgactgaactgcagagttggagccagaggtaccattgctgacccctgagcccaggagccttgagaatactgacagtgttaataataactgcaatcatccaacatatgatgctagaataactggacatctgtgtgcaaaaatattaaacctataccttgcaccttatcacaaaattcactcaaaatagatcatagaccaaaatgtgaaacataaaactaagacttccaggggaaaacaggagaaaatctttgtgactttggggttaggcaaagctttttgctaaagacattgataagagattgaaaaaacaagcagattgccagatgatctttgcaaaacatgtatctgataaaagacttgtagccaaaa

SEQ ID NO: 702701 - DNA, 267 bp, Homo sapiens
tatccacacgaggctcttcttcttcctcttcctcagctggatgtactggctccttcccacgtggccggaccctgtgaagcgagtggcctgccacggctgtgaattaaggcgtgctggcgacgcgatcaggctgtgatggagaatgacgtcagctgaacacaaggtgtaagcacttgcacactgaagcttgcactctgagactgtggtccatgcagctgccaactgcgaacctctcaatgtcatcacacagcttccaagcatctcagt

SEQ ID NO: 702702 - DNA, 294 bp, Homo sapiens
gagcatggcggctgtgaccctgtacaggtagcctgaaaactggagggccttcaaggactctcatcagctgctcagtacagcggggctcaggtccgcgtgctctccgaacagcccacttccattttggccaaagcaaccgcagcccatgaactttcttctcgcaaagtttcctgccgtgcaaggtccacagacgatatgaggggtgatgactggattctgctggtgtttgcagagcaagcagccattgcctagcgtatcgtgagcagatgagtgatgcgtgcggggacagtactc

SEQ ID NO: 702703 - DNA, 509 bp, Homo sapiens
ttcctgattgaaatgcagtggaatggaatagggtggaatagaattgaatggagtggagtgagtggaatggaatggaatgtattggaagaaatggaattgaatggagtggagtggagtggaacggattgcaaaggaatgggaaggactggacttgactggactggggtgtaatggagtgaagtggactgcaactggactggagtggagtgcagtggaatgcaatggacatggcactggcatggacttcgactggactggactttgacaggacatggactggaatggactgcacctcaaatggaatttacctacaacggaatgaattcgcatggaatggaatggaatggactggaatggaattgactctcatggaatggatcacaatgcaatggactagaaaggaatgaactcgaatggaacggactcacatggaatggaatcgaatggaatggacttgcaacgaatggactcgaaaggaatagaatcgaatggcatgcaatcacatggaa

SEQ ID NO: 702704 - DNA, 176 bp, Homo sapiens
ggaggtcacagcactcacccagagcagtccagcaggtgacaagcagagcatggacgggtgaagccctaagatgcagatggtgaagaatgttccccagcagcgggcagcagggtccagcatcccggcttgtccagcatcccggctcgtcctgagcccttgctgttccctagccaggg

SEQ ID NO: 702705 - DNA, 386 bp, Homo sapiens
taggcatgtctagcacgaggctgaaatgaaatggttgtagcatgactcctgaagcctcaagctcccgggcacaactgatcctagcatctcagtctcccaagtggctgggactagaggtgcacaccatcacacctggctaattttgaaattttttatagaggcaggtttttgccatattgcccagacgggtcttgaactcctgaggctcaagcaatctgcctggctgggcctatccaaagtgctgggattacaggtgtcagcaaccgcacccagtcaaaggtaaatttttgatagtccttgacattcctttggcttttattttattttttgggaaaggggcaaccagcttggggaatcctaagaagttcaactggcgggcatgcaag

SEQ ID NO: 702706 - DNA, 149 bp, Homo sapiens
ctcccctgtcggtggaggtgtctgtgggaaaggccaccgacatctacgttgtcaatggcacggagatcctcgtgcctgcaccttctccagctgctttggcttcgaggactcactcgaggactacacacagtgacgcattcaagattacc

SEQ ID NO: 702707 - DNA, 821 bp, Homo sapiens
  misc_feature (517)..(517): n is a, c, g, or t
  misc_feature (821)..(821): n is a, c, g, or t
agcggacttcctgccggcgccccctcccccgtggcgccgtctcctcactcccgcctgactgacgagtctaggcgtcatcacgcactacagctctccgagcgagctggctgcagcttcagggcagcgcgggctagcaggcggcggggaggttagggctgtgtagggcgaggtcctcccccttcctcctcgcctaatcctgcatcctccctcctcgtcgtccttcccgccgttgcgtcctcctacgcccttcctctcgtcctccgtcgaggtctcgacgctcagcttgatgagccgagcagacgaatcgcgcgtgacgccgcaaggccgagccgccgtgctcaagggactgatccgagggcgctcatagtgcttgccgagcctgacccattaccaaaagacctggagcgctcatgcgagcggcgcatcagacgtgcgctcgtatcaacgagatgctaagcggtgaaaccagacgagaaattagcgcgagccgccaaggacgtaatcatatcgcaaagangaaagtctcgtcgcgattagtcgcataaaagcaatagtctttgctcgatagctttggatcgaagcatttgcgcctagcaaagacgaaatcccagatacccaaaggttggaaagaaccgcgttgtgcccttatcccaaaggtccctggctacgatctccagaaagaccaggggaaaataggcctttccgagggcgataggtacaattcagaccaatgtggctttttccatttagaaagtaggtggacgtggttggaaaacctaacgaacattcccagctcaagtgaaacacttgagcagtaccan

SEQ ID NO: 702708 - DNA, 116 bp, Homo sapiens
gttacataagaccacatgttgtattattccatttatatgaaatgtccagaataggcaacatacagcacaaattaggttatttgttacaggaggctgggagcagggaaaccgggatg

SEQ ID NO: 702709 - DNA, 170 bp, Homo sapiens
gtggaagtgacatcgtctttaaaccctgcgtggcaatcctgacgcaccgccgtgatgcccagggaagacagggcgacctcgaggtccaactatttccttaagatcatcgtaagtccaggcacttattgatgattatccgaatgtttatttgtggagcagacatttgggtt

SEQ ID NO: 702710 - DNA, 254 bp, Homo sapiens
aggtggacatggtcctgagctctggacggagcaggcaccctgatttcattttgaggtccacatggccccttttgggccagcagctgtggccggtgtatcaagggggcccttaaagctggaacattccagcaagcttcttgggcttttttgcacccggcaggccccctttcctggcaccctcgactttatataaaagttgccctgggtttcaaaaacccccccctgaatgaataaaaggagccctggctgggcca

SEQ ID NO: 702711 - DNA, 492 bp, Homo sapiens
gtgagctttctgaaacagctggtgtagctacatgagcaaccagcttccttcagagagcagtgcttatggacggggagcgaggaaatccctctcataacgttgaaacggttttctaattgcgtaatctaattgataattctaggggtatggcgtaagtacatgagaagccatcacctcagaatggcagctttttatagattttttgtttttttctctcaacaccatgattccttaacgaacatgtttccagcattcccaggtaggccaaggatgtcactacagaaacaccttgggttagacctacagggggtactggctggtgttaacagaagggagggcagagactggtgcggctggccatggagaaagctgacttggcctggtgtggtacagagaagccagctcgattaacatgcttattccagtgactgcttgccctaagcagaaagtgcctctcaggatctatttttgaaattactaccgatgtctagt

SEQ ID NO: 702712 - DNA, 313 bp, Homo sapiens
  misc_feature (1)..(1): n is a, c, g, or t
nttcggcacagctttaaaaaactttcctcagaggtagattaacttttattgaatatagctgttaataagaaattttaaattgattgcatactgtattagttggcttgggctgccataacaaaataccatagacaaggtgttttaaacaacagaaatagaaatttattttttcacaggtttggatgctgacaggttcaagatcaaggtattggccagttagttcctagtgagggctccttcctgccttgtagatgtgtgctcatgcggcagggagagagagtaagctcgctgggtgtctcctcttataaggaca

SEQ ID NO: 702713 - DNA, 295 bp, Homo sapiens
  misc_feature (33)..(33): n is a, c, g, or t
ccccggccccccctttttggggggatggggaanaggtggggggccccccccttccccccccccgcaaaaaataaatatggcccggggaccccccctttttttttaaaagtttttttaaattgtctttttaaaacccttaacccccccccctttttgggggaaaaatggcccctttcctgggggggggcccgggaaaaccccccccctaaaaaaccaggttcttgcccggttggggcacccccccccccccccccccccccccgggttttttttccaattaaaacatttttttgta

SEQ ID NO: 702714 - DNA, 947 bp, Homo sapiens
tttgataatcaaactcccaaagatcaaaggtaaagaaagtatccaaaaactggcaggaggaaaaaaaacaacatacaatggagagctaatacattggtggcacatttttgttggaaaccttataggccaggagagagtggcatgatatatttaaagtgctgaaagaaagaaaatttaccctagaataatatatgaagcaaaattatccttcaggattaaggagagatagagactttccaagaacgaaacaaaaaagttggaggaaattttcattccaaattaaaccgtgtcctacaagaaaatgcctgaagggagtacttcaataaagaaaataaaaggatgttaatgagaatgaataatcacctgaggctacaaaactcactggtaatagtaactacatggcaaaccacagaatattacatcatttaaactgtggtgtgtaaactacttttaacctaggaagaaagactaaatgatgaactaagaaaaataaaaaaatcctacaacagcttttcaagacatgaacagtacaataaaatatgaatagagacgacaaaatgttaaaaggcagggaaacaatgttagggtgcagagtttctatcggttttctgtttgctcgtctgtcagttagtttttgcagtcagtgttaagtttgtcatcagcctttcaagtactgagtcactaggacaaccattggcagcctagtgggaatctaaaatcaaaaaacgtgcaaggatgcacaaaaaaaattgaaagcagaaattgagacatactccgagaaatctcttccaaagagagacggaaaacaaaaaagggggcgttaaagttcccgagggccagtagctaccagtttttcaaagggccaaggggcgttacgcgcaggcgcgctcaccgtccgggacgcttggcttgggaaccttcgggcactcgcccccacatgccgatac

SEQ ID NO: 702715 - DNA, 136 bp, Homo sapiens
  misc_feature (106)..(106): n is a, c, g, or t
gctgtcctcgcttgttggcccagctgactctgcggacgcatggctggtctccatggtccgatgtggacctccttgttctacgatgctgtggcacatggaattcagncagcggggccgtttcggtggcggtcgccat

SEQ ID NO: 702716 - DNA, 569 bp, Homo sapiens
  misc_feature (16)..(16): n is a, c, g, or t
  misc_feature (128)..(128): n is a, c, g, or t
  misc_feature (130)..(130): n is a, c, g, or t
  misc_feature (155)..(155): n is a, c, g, or t
  misc_feature (233)..(233): n is a, c, g, or t
  misc_feature (262)..(262): n is a, c, g, or t
  misc_feature (264)..(264): n is a, c, g, or t
  misc_feature (282)..(282): n is a, c, g, or t
  misc_feature (286)..(286): n is a, c, g, or t
  misc_feature (329)..(329): n is a, c, g, or t
  misc_feature (365)..(365): n is a, c, g, or t
  misc_feature (368)..(370): n is a, c, g, or t
  misc_feature (392)..(392): n is a, c, g, or t
  misc_feature (489)..(489): n is a, c, g, or t
  misc_feature (500)..(500): n is a, c, g, or t
  misc_feature (516)..(516): n is a, c, g, or t
ctgctgtccgcaaagngcgcacaatgaagttcatgagcgccgatgaggtccaggccagcgccacgtagtagccatcgctgccgaacagcagccccgtgagcccactgaggatcattcccacgtatttntngccactgtaggccagctggtgatangtgctcaggtcactgcgcacggtggccaggtagaggcccaggagctgggccagcacctccatcaccacccacaccagntctgttcttgctcacaggcccagcacctncngggagaaccttttctganttcncagttccatcccagctaggagcacgttagttatgaaggccatngtggggatatagaggttaggggcgttgaggttttgnttnnngggcagaggagcatcaagactnttctgcacttcccagttctggtgttttttggggaagatcagcagctctagcttcttggccacgtaggctgttttcacagcaaaaaaatacttgagtntgctcacaganacaaaacggtgcagcnccttgtgcaccatgtgcttcccatgggatgcgatggagctgccataggccaaa

SEQ ID NO: 702717 - DNA, 874 bp, Homo sapiens
  misc_feature (521)..(521): n is a, c, g, or t
ggttcttagtaagattacacatgcaagcatccccattccagtgagttcatcctctaaatcagcacagatcaagagggacaagacatcaagcactgcagcaatgcagctcataaagcgcttgagcctagtcggcatatccccacgggaaacagtagtgattatgccttcagcaataacacgaaagttataactaagactatactaaccccagggattggtcaatttccgtgccgaatgccaccgcaggtacacagagactgtaagccacatgtgcaatatgaatgccggcagtaaacgagtgtgttaagatcaaccccctctccaataaatgctaaaactcacctgagttgtagaaaagctccagttgacacaaagatagactacgaaagtggcttgtaagcatatctgaagcactagcaatagctaaagacccagatctggggattagataccccgactatgcgttgagccctagataccgtcaattcgagttaaactcgaaccaaacatgtgctcgccangaacactacgaggccacaggttaaaactcaaaggacctggcggtgcttcatatccctctagaggagcctgttctgtaatcgataaaccccgatcaactcaccactcttgctcagctatataccgcatcttcaggaaaacccctgtatgaaggctaccaagtaagcgcaaggtacccacggtaaagacgtttaggttcagggtgttagcccatgaggtggcaagaaaatgggtacaattctatccccggaaaaaatatgaatatgcctttgaaattatagggtcgaagtggatttacccgtaacctggaattgatgccttctttaacaggggcctgaagctatacaccgccgtc

SEQ ID NO: 702718 - DNA, 437 bp, Homo sapiens
caaagatacatatacaatctagctcggtaccaggccatgcgtgggaggatcatttgagcccaggagctcatggctgcagtgagctgggattgcacgtgctgcaccccagtcctgggctacagagcatagaccctggtctcttattataaaacaaaaaatacttaaaaaatttttatagacttaaaaggccttggtttttcttttcttttcttttctttttttttgggcatcctaatttctctcattatacacacagaaaagaggaaaacataagtaaaataagtctctgtggtatctttttttttacctttttttggaaacaaaaagtctcgctctgtggcccaggctggagtgcagtggcgcactctcggcttcactgcaacctttgtgcctcccaggctcaagcaattctctaacgcgtgccatcagcacatgcg

SEQ ID NO: 702719 - DNA, 900 bp, Homo sapiens
  misc_feature (264)..(264): n is a, c, g, or t
ggaatcagagcgcggtgagcggcccgagccaaccccgagagcggcggtgcgtccgccgcgcccaggagttggggatgtcctacaaacccatcgccctgttcccagagcacccctggctccagcacccctgggcggggccaccggtcccctacaggaagcgtcctgtcggccgtcggggctcagtgccaggagcggcgctcctttcagaccggtgtttaacgacttgtgaccgcttccatggctacgtgcaggcgatgaagccancggggggcccagggttcccagagcaaacttaagggaccttgctgtcagtcatagaggaagatggggcaaagaggaatcggcgcctacctttattgcttgcaaggaaaggagcggcatatgagcgccttgaagaggaggaggttatcattcccatgcccggggcccctagtcaggagagttgccttggcaagaaggacagaggcggaaggcccggacgtaaacaggaaaggcgctcgggctcaagcgtttggaccttattcgggcaattggagaagaccccggtttctccttgccttcatctcggattggcttaacccattccggggtctccgtgtccgtgtgtccccttgtgtgtgggtccctccaaggacccaaggggaggtggcctcccaggtggcagcactagggaaccccccaaaaacaggagttagcagcgaggtcccaatgattccacccatgaacttgcgaagttgttgcccacggacatttgggggccctaccgttcaagccttccagattctccattggtccgagcttttccccagaggcagggctggacctctggctgtgctggccaaagcctcatctggggctgcaaatgcgtaataaaagttgggtgttccacaaaacacaatg

SEQ ID NO: 702720 - DNA, 178 bp, Homo sapiens
tcaagatcccgggtcccatgcacagttgatgatgtatgtgttaactgggtctaatagtttcccacatttctcagtgttgccaatggcaattctgtagtatttctcttgcccttgtatatcctggtagatagggttgtaaaacataggatgcttgactgggactcagggttgagatatt

SEQ ID NO: 702721 - DNA, 132 bp, Homo sapiens
tgtgtgaggcccgctggtgcttgtgcacacgcccttctcatgccgctcgcacaggtccttataggactgcagcagatccaagaagaagttcagcttctccaccacgtcgttctcttcctgcttaccctgttg

SEQ ID NO: 702722 - DNA, 820 bp, Homo sapiens
  misc_feature (192)..(192): n is a, c, g, or t
  misc_feature (243)..(243): n is a, c, g, or t
  misc_feature (303)..(303): n is a, c, g, or t
  misc_feature (309)..(310): n is a, c, g, or t
  misc_feature (424)..(424): n is a, c, g, or t
  misc_feature (454)..(455): n is a, c, g, or t
aggggctccgaacaagccatcatcacgctccgcggtggcgcaggcaactggccggcctctgggcccttcctggggcatcgtgggctgaaggtggtgggtggctggtcaacaatcatcttcaatctaacgaagaaagcggccgggaaagcccgaagggacggtccctggaatgaatgaacgaacggccgcggntactgtgcaaccccctggaaagaaggcaaggcggggcaggcaaccacgaanatgagacaaaggggcaaagaaacggtctcggccacgaagggaaactcccttccctggagnggcagnnggtgggcccggaagggaacggcgtctccctgtgctctcgggcggtcttggcgagccggacgggcccgggaggtctcaactctccaaggtgggcttgggcacaagaattccacanaggttcatcaacccatccttataaggagannaaacgccaacccccggtatggaattcccaaatctaatatcaacgttccgtttcacttattgttaacacggttgggggttattcgtctcaattcacgggacattcctggttcccttaaggacattttttaccgttcctggaaggtggtttcaacgaagaaggcccgggaagctgtgtgtgcctgtgcgggcccggtctggtgtgctttcaaggcctctggggtctgaagtcatggcctgggtgggcgggacaaggcttcttcactggggcggagtcagtggcaaggtcttggccctttgggggaaggcccgggtccacgggggcccgggtctggctggtctgagccatggtgcctggttggccttc

SEQ ID NO: 702723 - DNA, 300 bp, Homo sapiens
acgctgttcttttatttttcagactttgttctttttgctttttagttctggggggttcaatcgatatatccacaagctcagagattctttcctcagtcatgtccagtccactaatacactgataaaaggcattcatttttacacagtgctttcgatttctaacttttttttgttctttcttagaatttccatctttttgcttacattgcccatctgttcttgcataatgtccatttatccattagagcccacaacatattaatcatggctgtttaaaattctcagtctggtaattctaag

SEQ ID NO: 702724 - DNA, 867 bp, Homo sapiens
cactaagcctggctgagacaactagtttcccttaactcattggaattctctaggattaggagaattccacagagcctatatgatattatagcgtcaaccatttatgtataccaacatggcatacccgtgtacaatctagcgagttatttccagagatttgttttaacggagctagtcttattattcacgggtagaacagttcatgattggactctgctagttaatggagaacaaatggagcttctaataggtttgggaggtttactggtagtaactattctaggaaatatttatgtctcaaggtgatgttcacatgggttctttagaaggaacattagtcaatgtgtgatggattgaactctatatagtctttctcctcttgtgcgtgtacggaaatctgacctgcaatgtcagttgatgtgacaagagatacacgaaagcacagtcattgttaaatatctaatagcagattccttgtctttagaagaacatttaggcataacgaccttctacgatggactgtctttgctggaatctaacaattagctcatattccatgaggaaagagtggcctagcgaattatttcatgttacctagccttctgaacgcgtactcacttgatgtgtcctaacactttgaaactaacctttgtctttctttgttgcactgacagctctaacttccaaactatttacgtatttttctctttgtaaactggtcagaacccgtgcctttttgaccattagagttctgtgcctacatatcactcttatgtacggtcgagaccagtcgctcgaagtgtatgagccagtgccattcatgatgcgcttatactggaccgatgctccagggtccacgtcttagac

SEQ ID NO: 702725 - DNA, 171 bp, Homo sapiens
ttaggcaacctggtggtccccgctccgggagctcaccatattgatgccgaactcagtgcggacacccgatcggcatagcgcactacagcccagaactcctggactcaagcgatcctccagcctcagcctcccgagtagctgggactacaggcacgcgccaccgcgcccggc

SEQ ID NO: 702726 - DNA, 161 bp, Homo sapiens
tagcacagtgttggacaggagcacccatgtcctgtggagtgtggagtccccctcatccaggtcggtttggaacactgatctggaagctcaggacctcaaatcagccgtgcaatggagaacattttacgccgatgttgtaatttttatttacattacattac

SEQ ID NO: 702727 - DNA, 889 bp, Homo sapiens
tcagatggcgatcacactggaagcagcagcccgagacaccagagaccagttcttggaatactttacaacgcccattggaccaatgagtgatcaacatccatttgatgcaggagccagtggttttgcagctctatcacccgaattgtccagcagaaggatctccccctgacacgtttccaggcagtggtggcttctagctgtgggacgtctggcagacaagtcagtgctagtatgtaacaatgccatccagctgctggccagatttatacatagaccaataatcctttctcctgcaagctatagatgatgctgaccttgccaggaccacatgcatcacaggcagcacccagaaattaccagcgcatgagggcccagaaggcgaactgcagcagcttctgcagtgctggacccagaggaggagtgggaagccatgcatgccagacgtagaagtctaccctgcagcagattctacagacttccccagggagcggcggagatccctgagcaaaatagccaatacagagacaactgaagatgtgaacaggacgcatcatatcacatgcttggccaaaagctagttacaaaaaaggccaatcattctcactcgagaaagcaaaggccacttccaggagtcagaaccattcaggcatatagacccagaggagtcagaggagcacccaggactagcaatatcaaaggactcatactacaaaggaccaggaaaattccagcaccagaaaagaatcccgaaagtctcaggacacatggaccacggcaacacggatgacaatcaaacaaaatgatagaacgagaaacacggaaagaaaacaagcagcgacaatggaaaaataaaaagcacagaacccgaaaaaaagacagaaaaacgcat

SEQ ID NO: 702728 - DNA, 122 bp, Homo sapiens
agagggtgggtcgttttagtttggcaatcttctcttttccttttttggctttagaagaagcaatgtccacagaattaagaggatgtcaaacagggctgactttgggttaaagggttttctat

SEQ ID NO: 702729 - DNA, 214 bp, Homo sapiens
ggggggggggaaagggggtttcccccccttttttcccccccgggagccgcgcccttttttttaaccccccccccctggggggtttttttttggggttgggggggaggggggccccttccccggggggggggggaaatccccccccccgggggggggggttttttaaggggggggggggggggccccccccggtttttccccagggttttttttt

SEQ ID NO: 702730 - DNA, 330 bp, Homo sapiens
gagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagccctgggcaatgtagcaagatcctgtctctacaagaaattttttaaaaatgagccaagtgtggtggtgcatgcctgtagttccaagctactcaggacactgaccgtaggagggttgcttgagacttgagagttgggaggctgcgatgaa

SEQ ID NO: 702731 - DNA, 159 bp, Homo sapiens
cgatacgttgctgtgaacggggaagtgacgatacgggaatggacatgcagtcgttcaaaatgataacaccaaggttgtctttgtacggtgcgatgaccccggcgttgctatttaccatgctgtgcaatataacgaattaacggtatcgcgtgataatgg

SEQ ID NO: 702732 - DNA, 467 bp, Homo sapiens
aatactagggctagagttgctgcattgctggtcgcaggaatctcgagaggcaagagacgtgtcctaacttgctattaggacaaatgtgacagtcaaggaaaggattattgggagggagaaaaaagaattaggcagtgccaaagctgaagtagatgctggtgtcgggactagttggtctctgtctgctgtcgcgttccagggattggagccaaagtggtgaggtgagggatcatgtaacttgcagtgcgagcccaggatggtaggatgcagggttgagggttatgatagagaatgattccagacagaagtgatgaatgtcctgtgttaaaaggaatgcaagctatacccagactggaaacatagcatgcaaagcactatctacagtgattagagatcctttcattgcattcatggtgtggagtgtgaacatcggcacccatagtgtaatgtatttatacacactagtt

SEQ ID NO: 702733 - DNA, 133 bp, Homo sapiens
  misc_feature (132)..(132): n is a, c, g, or t
agtctgccctccccgcaaaaactggctgagctttgcccctttgctggctgggccctagaagagatggaatgactcactggattaatacatttgggaagaactttgtaatgaaaaataaattttttaattctna

SEQ ID NO: 702734 - DNA, 472 bp, Homo sapiens
gcttcaataccctgtctcactgtgggagggagcagaggatggagctgcccggatccttcagggcctgggcttccggcagggctgagctccagaatggggtgggatcaccctctggagataagacctggacctggctttacccaaaccccaccagtgccctactcccgcaatcccccagccccagcacccactcccagcttccagcacagctgtaattggggctgagggtaacgaccagcgccaaccccagctgcggagggcctggcatgtgtgggaaaaagccggaaaaatacattttcccctaaagacttgtaagaaaattctcactgatttttttccttttaccccaagctttcacagcactaaatatgccacacttagtaattttacgagcaaaccaaactatacatcacacggttttatgttcctaaattaacaaaaggactttaaatctatatggcgctcttaaaag

SEQ ID NO: 702735 - DNA, 398 bp, Homo sapiens
  misc_feature (268)..(268): n is a, c, g, or t
  misc_feature (303)..(303): n is a, c, g, or t
  misc_feature (343)..(343): n is a, c, g, or t
agattacaagttccaaactcagccaggaatgtggctcacacctgtaatcccagcactttgggacacctaggtgggagcatcgcttgaagccaggagttcaagaccagcttgggcaacgtagtgacgacccctatctctacaaaaaataaaaaaattagctgggtgtgatggcacacacctgttgtcccagctactcaagaagctgagatgggaggatcctgagctcaggaggtcaaggctgcagtgagccgagattgttgccactgcnttgcagctgggggtgacagttgcaagaccctgttnttcaaacccaaacccaaacccacacacacacaaacacacntttcacacacacacacacgggggttcccattggttggccggggtttccccagggg

SEQ ID NO: 702736 - DNA, 649 bp, Homo sapiens
aaatcatgacaaaataaagaaaaagagcagtatatggctaacgtgttaagtagaatgttgaaagaccctaaatagatatgcttgaagccacatcacaaagaatcttgtaagacatgttaagaacttcaagtatttctctgaagacaagagacagggtttactttaaggatcacaaggaccgtcggtgagaagtgactcaggagcagagaagagatagaaaggcttttcttagatcaagtaaatatcatggtgacctactagcctaagaaaatagtggtaaagatgaggaatgaggatattcaacacctatttaggagacagaatgatgagggcttgatgatttattgcatgtgaacactgaaaaagaaggaaaattttctctcaatttaataatttggttagttcagcagaggggaagaaataatttcaaatattttaatgtttgaaatatttgtttccagatgttttgagacagtgatatgaaggttctgaatagaaaagtggatatgcaactccagatctcaagaaaaagtgatgaactaaattttaaatttggaaataacatatagattataattgaaaccaaagtactgggtagggtaacattcaggataattgcctgtttgcaaacaatgaaagctaatttgag

SEQ ID NO: 702737 - DNA, 373 bp, Homo sapiens
  misc_feature (127)..(127): n is a, c, g, or t
  misc_feature (180)..(180): n is a, c, g, or t
  misc_feature (183)..(183): n is a, c, g, or t
  misc_feature (265)..(265): n is a, c, g, or t
  misc_feature (315)..(315): n is a, c, g, or t
  misc_feature (337)..(337): n is a, c, g, or t
  misc_feature (348)..(348): n is a, c, g, or t
gctctcttggccacagtgcacagcagtgaggatgggccactcccagtgttaccagtggagggtgtcaaggtttttagcatcttgaaaaatgaattggacaaaatgtacaaacaaagcaaggaaaganggaagcagtaaaagcagacatttattgaaaatgaaagtacactctacagggtnggngcgggcttgagcataggggctcaagagccccattacagaaatttctagggtttaaataccctctagaggtttctattggctncctggggtatgccctatgaaaagtggaaatggttgatgtaacattacagngttatatactcggatttattgncctgtgtaaantagatagtgttatttaccttggaca

SEQ ID NO: 702738 - DNA, 1321 bp, Homo sapiens
  misc_feature (161)..(161): n is a, c, g, or t
  misc_feature (684)..(684): n is a, c, g, or t
cgatacttcttatttgaccttggggttctctgtgtatatgtggtactctctgtgttggcctttcgtgtcacgcgtgggcacaatggtgggtgcccgtgtctctcacaatcgttggtggttttctacggcccaacttgagttttgtgggcgcatatactggncgtggccacgcaagcacaggtctcccagtggggatacggccagtgttgtccccccttgtcaccgggcaacactcggaccccctgggcgcccacgtgaccccctccggccccccgaaagttggagggaccttcccccccgcaaggagaaaaaagtgacccaggcttggaccccttaggaccccccaccagtgaaccttctcaggcttaggaagatctctgcaaggcccccccgggagacctggacacaggcctgctctctgttttctcccagggtcacgaaacacggacccggcgtggaaagggaattggggtcccaccttgtgaaatgccagtcatgtcacacaggctctgtccaattggagaggtgtaacacagccaaagcccacgaagggctcccacctaatggacttcacaaattggggcgtttggaaatttgtagagaaccttcttaaacgttgtcctctttcccacgcccccccgaaaagttgtctgtctccactgttctataggacactcccctcgngcaccacaggtgagagttccctaagagggcttaacacgcgggtttctctggggagaacccactctccacaggagagccttccctcgtgcctctcgccacggctgctctgcacactgtcacaccctctccacagtattacacaccccccacactcgggagacttgaggcctctggtgtcccacacacagggccacacctcggcgcacacccctctgggcctctggctacagtctctcacagactttcgccgcacacacacaccccacaggaggcaaccacctcccacgcgcccgcacccactcgctcggtggcgctcccacatcacagctataacacacccacacgtgcacactttcacatgcacagggtgaaaacacccacagtcacctcgtggagaggctctcccacaggtggcacagccacagagaggcacacctcccagaagaagaaggggcactaaaactttcctctttcctgcctagaaggccccaccctcttggtgcttttccacgaaatcccgtataacaccctgagttaaactgaggcactccacctttctttcacgcacgactgatcacggacctccacagcccctgagccatgtataacccccaagaaataatttttagaatctcca

SEQ ID NO: 702739 - DNA, 152 bp, Homo sapiens
tctagaggatcccgaggagagagttcagaatgttccaagagtctagccgcagccccagacaccatgagctgagggtcgggatggggcatgcctccctggtgcaatcggcactggccccccggcccttgtagtgctgtcgtgaggtctgtctg

SEQ ID NO: 702740 - DNA, 1088 bp, Homo sapiens
  misc_feature (1088)..(1088): n is a, c, g, or t
ggccgggatgcggtgcgcctgtgctgtgatcctccttggcctgggcagaaagcttgtgtgagaccaatgcaatgtcaggagtgtgtgccatgttttcttgagcaggctgcccagagggcccacactctactgtccccatccatcagccaacaatgccacctttgccctgggtgccagtggcaagctacaccaactcctcacaacccttcctggctaggagagctgcagctttagcgcggcagtatgcccagcatttagtgccacccgcctcatccaaatgatgacccttcctggagaaccgtggcccagcagcaactgggggcagtggagtgggagtgaaggaagctgtgtgaactcgcagacctgaggagaacgtgcttgtgtgcgtgggcactctgttcaatggccatgccgttgatgacctaccatcctgcgggaggtcagcgaggagcacaaactggtcccccaggctcctcggagtcacatacatacacccagatgacggagctggtcttgtgaagatgaaccttgcaagcgtatcaaagctaaaagtgcaccattgaccgtgtcaaagctggttacggggacttgtcctggctgtgtcagagctccgtgagacgacgatcgggaacgtaactggtggaggactatatgctttgctgagcttgactgcaccagaaagccccgaccaccactttgacaccagataggtaagtgcaacctggtgtccgagctgggccttggatggccagtgaatggccagagccttgctggcacccaagggtagctagatggaaaagagctcagcccggcgcagcataggaggaccaacaggcgacacacgcaggagaagccaagctcaacgagtacccagagagtagaaccatcagtggcaaccatcccttaagagcagacggaaccccacacaccaaaggagaagccaacacagcgaagggccacacactacaacacaaaaaaacacagagagcacaggagagcgcagataacacatccggacagaagcaccactagagagaagaccacagccagcagcagcacacaaacaaggagcacacacaagcagcccn

SEQ ID NO: 702741 - DNA, 394 bp, Homo sapiens
ctgcaacgctgtgcctcactgctgtctcccatcacacatctgactcttatgaactctcggcttcagacgctccccaggatgttactgtgactgaacggggagtgaacaaggacggaagaagagacgcgaaggggggctccaaacccatcccaagttgattccttcatgatgtttccaagaatttaaagaataagtggtgaggctgggcgcagtgactcacgcctgtaatcccagcactttgggaggccaaagcaggcagatcacttgaggtcaggagttcgagaccagcctggtcaccgtggtgaaaccccatccttactaaaaatacaaaaattagccgggtgtggtggtgcatgccggtggtctcagctacttgggaggcacagattgcagt

SEQ ID NO: 702742 - DNA, 345 bp, Homo sapiens
gtgtgtgatggcacgatctcagctcactgcaacctcccccccacaggttcaacgctaacttctcccgcctcatcctcctgatctgctcagactacaggcgcgtgccaccatgaccggccaatcctttgtactttcagtagagactgggtttctgcatgctggtcaggctcgcctcgtactcctgacctcactgatccacctgcctcggcctctcgcatgtgctgtgacgtatcaggcgttagcgcccctgtcccggtctgaatgtcctcgtttctcaaaccgcaattgggatccactagcttccttccttgccagcactcccctggctccccaggctctggtcgg

SEQ ID NO: 702743 - DNA, 366 bp, Homo sapiens
ccagttacaacagctcctcaatgaaactcatgttcaaacttaatctccaatgtggcagtactgagaggtggggcctctaagcgtggttgggattaacctgtcaatggattcatggattaaagggttatcaccggagtgggactggtgacttcattagaagaggaaggatgacctgagctggcctgtgaatatgctcggccccctggccatgtgacacccgcgccaccctcagggctctgcagagtccccagcagcaagaaggccctcaccaggtgcagcccctcaaccttggacttctcagcccccagggcttgaacaaataaattcttttttaaagtaaattacccagtttcaggtattctgtta

SEQ ID NO: 702744 - DNA, 254 bp, Homo sapiens
tccctgagattgggtttgctattacccagtgcttgagtcagtggtgtgatctccgctcactgcaacccccgtctcccaggttcaagcaattctcctgcctcagcctcccaagtagctaggattacaggcatgtgccaccacgcccagctaattttgtattttttgggagagacagtgtttcacctgtgttggccagtgctggacgtggaactccgtgacctcagtgtgatccgtcccaccctggaccgttcaat

SEQ ID NO: 702745 - DNA, 364 bp, Homo sapiens
  misc_feature (231)..(231): n is a, c, g, or t
  misc_feature (303)..(303): n is a, c, g, or t
aaatgtgtgttcaagggactatcaatgttgggttctcctacaaggctctggatggagagcagaatggtcctgacatcatacagggctgaccacttttgcttcacgatgtccaggcctatgttaccctgggtgtgcactttagggtgatagcaaggcgtgaggaacttcactgtgggcgcattgccagggtagccactggggaactctatcgagagcttataccctgaggtntttattatcttgttccagcctgcttcatggatggggccctaacccgttttttcaaaagggggtttggggganaaacctttttttgggggaaatttttttttttttaaaaaaagggggggggggggggaaaaag

SEQ ID NO: 702746 - DNA, 109 bp, Homo sapiens
ggcagtgcacgcttgatgctgttggcgtctctgtaggttcccctcccactactagctttttgctgacttctagcagctcgctaacctcgccttaacccgagcgctacca

SEQ ID NO: 702747 - DNA, 559 bp, Homo sapiens
gctcctgaatgggacggctgtgagggcggagggtctctctcagacggggcggctgggcagagacgctcctcacctcccagacggggtcgcagccgggtagaggcgctcctcacatcccagacagggcggctggggcagaggcgctccccacatctcagacgatgggcggccgggcagagacgctcctcacttcctagatgggatggcggcggggaagaggcgctcctcgcttcctagatgggatggcggccgggcagagacactcctcaccctccagactgggcagccaggcagaggggctcctcatatcccagacgatgggcggccaagcagagacgctcctcacttcccagacggggtggcggccgggcagaggctgcaatctcggctcttcgggaggccaaggcaggcggctgggaggtggttgtagcgagccgagatcacgccactgcactccagcctgggcaccattgagcaccgagtgaacgagactccatctgcaatcccggcacctcgggaggccgaggccggcggatcactcgccgtctaggagcgtaat

SEQ ID NO: 702748 - DNA, 1704 bp, Homo sapiens
cttagttctagatcgcgacggccgcccttattttttttatttatattttattattatttttttattatatatttatattattattattaagagccaccttctcctcctaacaataagggggcatccctagagaaagaagcgcgctccccacctatatatcatggtgtgtaaccctcatattattgtattcttattatattatatttcttctctattctctacaacagggtgcgtttaatgtggagaaagagagatgtaaaagagagaggagagagtgcgtgcgggccacgcgcgcgcgcgccgtggtggagaacacaccagtgagctcacgcgcgccacacctcacacaacaacgcgcagaagcacgacgacgcgacccgcgggcgtgacacacgagagagagagggggggcgagggacgtcgagagtcgctacaacaacgcagagtgtgatttatgtatatatactacaacagaagacgagagtatcatataacaacataaagaagcgtgtctttctcttgttgtttatttttttctcaaaacacagaaaacaaaatacacagataacacatagctgcggctagaacacacaccaaaccacacgatgaagaagaaaatcacattatacagctgacgcgagaggcgagaagccacagataaaaacatccaaagggactcgacacacgacacaaaacaaaaaacacggagagaagcaaaaacaaaaaaagaagaaggaggcagtatacatcataagtgacgtgagcagggagaacacataaacaaaatagaaaaataaaaagcagaaacagaaggacagaacacacagtaagacggacgcgctatagcagtcaatgactataataatcaaacaacaaggaaaaagaaaaagaagatgtaatagcggtgacgaaaaacaacaacaacgcagaaagaaaaaagacagaagatgaggcggaagaaaacatcacaccatgaagaggatgacgagaaaagaaaacacactcaaaaacaaaaaaaacccaaaggcagcacggagacgcagacaagacacagcagacaaaatcaacaaaaaatcaagtaggagagcagagaacaaaaaacaataaacaacatcttacactcacaccgcaccacacaaggactattaatcgatgcacgtgagcaaagacgatacttcaaacagagagcctggaacggattacgcccacatagaaacgaagaaatatagatataatgtcgcacaaagaacagacgagtcgagccataaaacataacacaacagacgacgagcgtacatacataacaaactcaaaccccaaacaccaccatctcacacacacaaacatatacaaataactaatatacttagcagcatactcaacatcatataataatccacaaacttataattagatataatgagaactataactacacaataaactaatctaatcctataacttaaataataataataatactatactaacacaatactacaatctctctaatttatttaactatacagcacacaagcaagaaaacaaattacaaaaaatatataataaaatacatacaaataatatacatacacacacaaacacaaactccactacccactcacaatagctaacccaaattatcaaaaatcacaatctataacaaccaacatacatacacaacccgaaatcatcattcccacc

SEQ ID NO: 702749 - DNA, 1198 bp, Homo sapiens
  misc_feature (288)..(288): n is a, c, g, or t
  misc_feature (401)..(401): n is a, c, g, or t
gatgatctatgaagtgaacactgcctatcagtatggtgaaaactcgcagcaccgattgtaccctcgcataaacatgggggcgcgtcttccagagcgcttcctaattggactgtctcgaggccatcaggccgagtggtgtactattgctcctgtcgcatgtctctttagacgcctaccctccaatatctacgagtctcttagcgtacacacaaacaaacacgtaaacccacttataactcaactgcactgggcgactatctgctgaccagcgaagaaggatgccaccantaactcaaaggagggcgatgcaatgaacatgcgcaatcccttggttgcatgattaaagggggcacgtcccgacgtacacggtgggattacatattcctatatgtttgtaattntcaaccctgtacagggaaaaacctgtccggtagaggaattatctgaccatgcggaagttatgtgttccatgggcaagccccctatgtgtgatcgcgatggctcacgaagagccgatgagacgctctcttttgacctggccacttctcacggcacatgagtcaagggtgccgcacgctggtagacccccaagaaataacccaggtgggggagttggatttccccccgggacttccattatgtcgcggcccattcagaatatgggcgatccccaaaaaatacccataaaacaaaagggccacataaccctagataaagttacaaattccgtcccgagaccacggtgcaacggggggacaaggttggtaccgagacttgcacaactccttcgtaagggggaggtggccatccgccattggcggagattccgtccatatttaacacggcaatagggaaaaacggaaacgccgcagggagtgaacaccctcctataatactcttagagagtttgtgcgaggtcacgggcaaaaacccttgtacgttcttggaaatctaagttctagagttctgttggttaagcgattgagcaagactacggttgcagttgagcattcttggtcaaacacgcacccttcgggctttaaggcatggaaggcgcctctccttcaacgttaaaacggtcacaacggtggttctggtcagtcatgtccattcacgcccatttttccttatttgctcaacctggtttcccacgaggaccgcgtgtttattctcccctataacggttagtccctcacga

SEQ ID NO: 702750 - DNA, 513 bp, Homo sapiens
  misc_feature (437)..(437): n is a, c, g, or t
cagcggagtgaggatcaactgtgtcgctcctgggaccatttactcccagactgctgttgacaactatggcgaaatgggacaaaccttatttgagatggcctttgacagtatcccagctaagcgccttggagtccccgaggagatctcccctcgtggtatgtttcctgctgtcccctgcggcttcctatatcactggacagttgatcaatgtggatggaggccaggctctgtacactcacgccttcagcataccggatcatgacaactggcctgtaggaagctggggacctttctattgtcaagaggataaaggaatcttttaagaagaaagccaagctctaactaagccaaggaaacagccacccatcttgttcctgcgtgccttagcgccttgagaatgtttcctacttcacaagagcttatgatttctgtgtgtngggggtgggggatcactttaatgttaatagctttatctttgcaaagactgctcccaaaataaatgtctcttcctgt

SEQ ID NO: 702751 - DNA, 557 bp, Homo sapiens
ctgtggatacgtgacagccatgcctgagcagtgtgccagctcagaagctcagtgcccagtgtggatggatgcagatgcattcgagcacattaaacaaggcagtgacgcatacgatgcacagacctatgatgtggccagcaaagaagagcaacagtctgcaaacagactctggcaaagatcaggaagaggaggagatagaggacaccctttatggacacagcaggagcaggaggagttcaaaggcagcagactgtggagcagctgaagccagaggcactcgatgtcgggcagcagagcacccttgggctttgatgagatggcagtggagatccaaactgtcaaaacagaggaagaccaagatcccagaacagacaaagccctataaggagactgctaatgaggaaaccagaaagaagcggggagtctaccattcatacagttcatcaattcctcatggacacgatcttccagccctttttacacgatgtcagtgagctaagacaggaagctggagagagaggtggaaatgtggcagccacgtgaatctggaaacccag

SEQ ID NO: 702752 - DNA, 193 bp, Homo sapiens
gatcgagctcggtaccgtagcgctgcatggtaactgcctctccatcctgattttccacatggttgcaccaatttacattcccaccaacagtgtacgaggattcctttttctccacaccccccctagcacttattgtttttagactttgggatgatggccattctggctggtgtaaggtggcgatgacctggca

SEQ ID NO: 702753 - DNA, 814 bp, Homo sapiens
  misc_feature (533)..(533): n is a, c, g, or t
tcccgtggaggggctggctgttcccagagcagtccactcccccacttgcatgccttgcctggactcttttcttggagggaggtccctttcctctacccatctgaattttttttcttccaccagtgtccagcttgcctttcaccatgggcctaatgatggaaattacagttattctgtatcttcaaacagaaccaagcaaatcctctgagcttcattcatatgggaaattttctttctttcttttttttttttggagagggagttccgctcttgtggcccaggttggagtgcaagggtcaatctcggctcgcttgaaacctccacctcccgggtccaaagagattctccggcctcagcaggaggattactggtaatcccaagtatgcttggagattacaggcctgcgccaccaagatagctaatttggtactttgggtaagagatgcgatttccacccggtgtgggctaggcgggtctcgaactcttgacctcaggtggttccgccctcctgcgggctcccaagggtcgctggnagatatacaaggcatgagcaacaggtgccgggacattatgcgaaaaacttcttgcggcggcgactaaacctattcttccacaaatagcattgcttttccggaacttttcttcaggggacaaccacgactcttagctccctcaggcctgtcgaaaattcacgattcggggttaagcatggaatgtgcggcatagttcgcttctcgcacctggctacgcgttctgtcccctgtgaacctgttgcattcgacttcgttgctgtgggcgtgcactgtcccctttg

SEQ ID NO: 702754 - DNA, 206 bp, Homo sapiens
tcagattatgtccattccattccactcctttcctttccattgcattccattccattcgactgtattccattcgagtcaattccattcaagtccattcctttctagtcatttaaattcgcagtacattccaatctctttccattccatttattgttccattccatgtggagtccattccatgcatagtctaacatgcaatcatgggt

SEQ ID NO: 702755 - DNA, 690 bp, Homo sapiens
gtgagccactgctcccggccgtaaagttaacttctgaggcatttacatagcatttttttctcttgttctcattaacttgtttaatagcactttttattttggatattaatgtaatgtgtaatgttttatagcgtcttaataagaaccataggatttgctgtatctctttaataggtggaatctggaattgaacagtgttgttcagtttccttttcgttggtgtttgacttaacatgcactatcctggtctttctaacacctgaggccagtaattatccacacagtacctttataaggtagggggtggtatcaacatttatagataaattccaacttattgaagcctcactttccttaagcaacattcagggtcactaaattgggagaactgtcatttagccagaagtctgactccaaagttcagactttggagtataaagttcctccattataccccaggttcttgacatattgttagtgtaagaaactttgaatgataaattgagcttttgtgggtttttgtttgtttgttagttttgagtttgacaaattctcactttgtcacccaggctggggtgcattggtgaaatctcgactcacttcactctcaatctctctgactcaagcaatttttctaccttaactactttctaaataacttggactattaacactttccaccacacccca

SEQ ID NO: 702756 - DNA, 103 bp, Homo sapiens
ccctgctaactttgctgtaatttttttaaacgtcttgtttttaatatagccaactatctccatactggctggattaggttaaataaagaatttttttgttcca

SEQ ID NO: 702757 - DNA, 855 bp, Homo sapiens
acagtatcctgaaaactaggagggcctacaaggctctacatacagctgctcagtacagaggggctacagagtccagcgtgctctccgcaccaccccacttaccatttaggccaaaacaaccgcacccctgaatttctccgcaaatttcctgccggcaaggtcccagccatttgagggtgatgatggattctgtgctgtatgcagagcaacgccattgcctcactatgtgagcaatgcagcgcagctgccggggcaagtactccccagaggccagccacccccagccgctgcgctcagcaccgggctgcaccccttgcctcgcatctcccgatctcactgcccccagaccaccccacctgggctgctacccccacccttgggcactcactgcccacccacacacccacaaccaggcccactgacgcaactgccacaaacggacgcgcaacctgacggcctcctcctcgcgccctgcccgcccccccccctcgcccccccccccgccctccccctgcctgcgcgccccccccctcacctccgcctgccactcaccgccgctctggcacacctgcccgccggctcctctaccacacagtcctcaaaaccccccctcccccgcccacgcccacccaccaataccacacccacctcgctccatccccctcccatcaacccccgcccccagaacccaagacaatcccacgcccccacagcgcccaccgcagcgccaccaacgacccacctccccctctccccacctcgccacccccccccccccacccgccacacacccccacaccgcacaccgctcccccccacaccaccctacccccacccccacccccccccaccccc

SEQ ID NO: 702758 - DNA, 233 bp, Homo sapiens
gcgaaaagccacagtgtgcacaactggcatgctggaggcaccccttggttctgtgccttggtgcctcatattctcatctgtcacatggggatattcatagccccacttaaaaccccttgggtcctcatcattctcatcatttcacatggaggatattagatagccagcaagtagcatcatgcctcatggtggtttgcttgttatgggttaagattgctccaacagtgcacaat

SEQ ID NO: 702759 - DNA, 117 bp, Homo sapiens
agctggtcctgctgatggatgtgccaccgcgcgatactcgccggggaacagcttcgctttggtgacaccgtgcatgaccctgaaggcgactccatgcgtcactcttgaattctgccg

SEQ ID NO: 702760 - DNA, 671 bp, Homo sapiens
tctatgatggcaccccgataacctcccttggttactcccattactccagttactcagttgacactaatgcaggtgctgctgtgaaggggttttgcagatatattttaggtcccccatcagttgactttaagatggggattatcctgcttggactgtcctaatcaggtaagctctgaaaaggacggggttcttcctgaggaagactcatagtgcagagggattcagtgtgaggggcttcctccactgtaggctttaaaaatggagggtcatggggaaagaacactggtggccaacaggaattagaagcccttcccactgtctactctgatagcctgaaggaaacagggaccttagtcctataaaaattgccagaaaccggattctgccaacgagctctatataagcttgggggagaacccgaatcttaagatgaggatacagctttgagaaatcctgaacaaagaatctatcaactaggcctggatttctgatgaaggaactgtagacaaataaatgggtgctgttttaagccacttagtttgtggtaattggttatgtactaatagaaaattagtaaacagattcaatagctaaacatacgacatgttctccactgcaatgaatttatgaactgatatgcaaagtagttgcataaaaccgaatgtttccta

SEQ ID NO: 702761 - DNA, 1127 bp, Homo sapiens
  misc_feature (946)..(946): n is a, c, g, or t
gcgccagaccctgcgccccgcgctctccggcccgtcgcctgccttgggactcgcgagccctgcactcccgccctgcctgttctgctgccctgatgtatggatgctgcttgtgtttgcgaagtgcaccctggcacgctgccccgggcctgggcctgtgaccctgcggctgctgggtggaccagcgtgtcctgcatgagcctgctcctgcctgtgatggatgctgctactgtacccctgcgcctcctacttccatgttgctgtgcatgcgtggatgatcaagcctgcacatgctgtgaatgatgcttggcttacttggagtgcttggatggtaatgtagagtgaagcatgctgcttgtgagtgacggaacgtcttccccctgtgccatgaactacctggatcgctacctgtcttgctgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgtggaggtgctggtcctagggaagctcaagtgggacctggctgctgtgattgcacatgatttcctggccttcattctgcaccggctctctctgcccgtgacgacaggccttggtcaaaacgcatgccagacctttttggcctctgtgctacagattatacctttggcatgtacccggcattcatgatccgcacgtgctgcatcggagctgagtgccggcctgggtgctggtcctggtcgggatgagctcccggagctgttggcacgggtcctcggcctggattggctcgcttgggggccttaggaagcaaaatgaaagctgcccccaggggaaaccccagggaatacgctcgaaaaagatcaagtccgtggtccatagccccgggnggtcctcacagctagggtcaatgaaagaaaccctaaaagtgatagctaaccagtgccgagcaagcccgttggtgacacaacaaggggggcgacgccccatcattgagcaacactacaggtggcgcacacacaagcgtcacaaccgaccggcagcaatagacgcctcactacaagtaggctc

SEQ ID NO: 702762 - DNA, 843 bp, Homo sapiens
  misc_feature (236)..(236): n is a, c, g, or t
  misc_feature (252)..(252): n is a, c, g, or t
  misc_feature (385)..(385): n is a, c, g, or t
  misc_feature (441)..(441): n is a, c, g, or t
  misc_feature (453)..(453): n is a, c, g, or t
  misc_feature (607)..(607): n is a, c, g, or t
  misc_feature (615)..(615): n is a, c, g, or t
aaacttaagactaaatgtcaggtacaactttcccataaatcctttatgatgattcctcctacttctactatcacctttacctctatcataatattctgtcctctactgatcttcacaatagcctataccttcccaacacatgggactatgtctttgtatccttagcattcagcacaaagtatatagggctcaatatacacacaaacactgagatactgaagctcctgtccatacanccaccctttctttttntcctttcatgtatttatccatctatcctcgtacatgtatttagggcccattatagatgataaatcatacaagaaccaggaatacaaagatacatggtctccaattgagaatttcagtagagtatatgtggtangacatcatctctagaaagtccaagataaaatgcaaatatacaatcaataaattttngagcatttcttntaagctaagtactatgcatggttctagaaatacaaagattaataaaatccatcttctgatcccatagagctcttagtctattggggaaatatatatatatacatatacacacacacacacacacatacacaaataactacatatgaaacataantatatatntgagtaactataatttttgtgttttttttttcctcttcacaaatcacaaataactacaatataatgaagacttgttaatacccaacaatgctagggaccagtccacgcaaagaattttcgcaccaaaaataacaatagttccctattaggaagcactatctgatagtcaagagaatcctaggatttttttttacctaggctcatgactgcttacaacagaccataatc

SEQ ID NO: 702763 - DNA, 570 bp, Homo sapiens
agttgggtgaggtgaggcaagattgtattccgttttggttacaagctgggaacgggccctaattttttgcagtttggggaagctgccattgttaattgggttcttggcaagcccatgtgtgttgagggcttttcacactatccccctttgggtcgttttgcggttcgtgatataaaacaaacagttgcggtgggtgtcatcaaaccagtggacaaaaaggttgttggggctggcaaggtcccccagtttgcccagaaaggtcagaggggtaaatgaattttttccctaatccccgcccccccccttttaatcagggggggaagaacggtttcagaactgtttgtttccattggccctttaagtttagggggaaaaggctgggtaatgataccaatgccttgttaccccttccggaggaagggaggaaggttttggggccccctttggtttttttttttggggggggcggttttaaggttttagtttttaaaatcgggcctttttaaggggaaccacttggcccaaaatttgtcccagaattttggggccccttaaaaaagtttaatggga

SEQ ID NO: 702764 - DNA, 304 bp, Homo sapiens
gcgtcaaaagagaatagccttgaggccaggtgcagtggtcacaccctgtatcccagcactttgggaggctgaggtgggtggattgcttgagcctaggagttttaagactaacctgggcaacatggcaaaaccctgtctctaccaaaaatacaaaaaattagttgggcatggcattgtgcgcctgtagtctcagctactcgggagactaatgtgggaaacacctaagccccggaagttgagactgcagtgaaccatgatcgtgccactgcactctagcctgagagttggactgtgaccttgtctc

SEQ ID NO: 702765 - DNA, 861 bp, Homo sapiens
gcctggtgatagctggttgtccaagatagaatcttagttcaactttaaatttgccaactcaacctactgccaaccaagacctgactggcacgaggaaaggtgcaataatgaagagttttcttctagttgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaacctg

SEQ ID NO: 702766 - DNA, 843 bp, Homo sapiens
gggatttttcttgggtcttctctacagctgacaggccaactcaacctactgccaaccaagacctgactggcacgaggaaaggtgcaataatgaagagttttcttctagttgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaacctg

SEQ ID NO: 702767 - DNA, 952 bp, Homo sapiens
  misc_feature (318)..(318): n is a, c, g, or t
  misc_feature (735)..(735): n is a, c, g, or t
  misc_feature (738)..(738): n is a, c, g, or t
  misc_feature (740)..(740): n is a, c, g, or t
  misc_feature (744)..(744): n is a, c, g, or t
  misc_feature (747)..(748): n is a, c, g, or t
  misc_feature (756)..(756): n is a, c, g, or t
  misc_feature (760)..(761): n is a, c, g, or t
  misc_feature (793)..(793): n is a, c, g, or t
ggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccggtggccaacggggaaggttcttccgaatgatccagtctttcttgagcctcatgaagaaatgacactctgcaaatactatgagacaaaggttattggcaatnctgtccggtgtttaaagccagcaatgccaagatctgtgtgtgggtacggctgtgtatgtatttcaaacgtttttatcttaataacctcagtaaatggaatatcacccccaaggataataatggctcacttgtgtggcatttttgtggccttgcaaaggtagatgaacttcacttgtatctagtcctcagttgtgttggaaaaccctccgggagaagtccctctgtggaccagggagaaggcactttgaaacagatactgggaatatgaactactttcttatacagcaacttaattttccaccttattgtcacaatcttacagaccattttgaggggttcctcatcgattaaagaccgtatccatattggggatccagagatttgaggaaacaggtgatgacttcttataagaattgngtngncggntgnntacctttntaanncttccaatggctggtggcattattagtgcccngggggaaatatgcaggtttactagagttgtggtaaagaaaatgtggcaggtatattatggaggggagagttaaaattaacacctgtatagtgtgtgaaaaggggggtctggtgtgtcaacaaagggaggtatgttcaccaagagggggggccacggtat

SEQ ID NO: 702768 - DNA, 370 bp, Homo sapiens
  misc_feature (141)..(141): n is a, c, g, or t
tctgagacaccataacagtgtgagatgaaatattctgaggatcaatgtagctgtggtgagtcacagaggtaacagaatgtgtcaggcagaaattgtgggcatagagaatatttcaggatgaactatcatgggagtctagangcttctttgagtgcaaaaaatagaaggtctaggatactggcattgaataaatagttgaagagttagaggatgttgtcaaggatggtccatttataggacatatattgttgagatgggctgatggaaatatttaagaatgtgccacagacagaacgttcaggtggtgatctgggctcatagaagccacactgatgaagttgagagacctgggccattgtctgggttggga

SEQ ID NO: 702769 - DNA, 198 bp, Homo sapiens
  misc_feature (7)..(7): n is a, c, g, or t
  misc_feature (11)..(11): n is a, c, g, or t
  misc_feature (18)..(18): n is a, c, g, or t
ctggggnggcnttcctgnaagctagacacccttacggtgcccgcgcatgtcctacgacttccgtcggacccttagtcatgtgcttcgcgtcttcttcttttattttctggctctggttggtctctttcctgtcgcttccttcctaatgtgtgttcagtgtctctccctcccacaataacaaaaacacaaacaaaaaat

SEQ ID NO: 702770 - DNA, 198 bp, Homo sapiens
  misc_feature (198)..(198): n is a, c, g, or t
atagcagcagcgctgatacgcctagatatgaagacggtctattgtgttcgactaggcatattaaaggacggcgggggcatcgtatgcgcgctgagtggaatcttggacggcgcagaagacagagcgaaagctttgccagaatgttttcttcatccagaacgaaagttggaggttcgagtggagtggggtgggcaagcn

SEQ ID NO: 702771 - DNA, 293 bp, Homo sapiens
  misc_feature (2)..(2): n is a, c, g, or t
  misc_feature (6)..(6): n is a, c, g, or t
  misc_feature (113)..(113): n is a, c, g, or t
  misc_feature (128)..(128): n is a, c, g, or t
  misc_feature (182)..(182): n is a, c, g, or t
  misc_feature (198)..(198): n is a, c, g, or t
  misc_feature (219)..(222): n is a, c, g, or t
  misc_feature (244)..(244): n is a, c, g, or t
  misc_feature (247)..(248): n is a, c, g, or t
  misc_feature (250)..(250): n is a, c, g, or t
  misc_feature (257)..(257): n is a, c, g, or t
gngggncacttttagagtaaactgtatcactggtttggaaaagcagctgccttcttggacacttaaaacactaaatcacctgaggagttctatttccctgacagttcgtggcntgatatttattaagnggttttttgtgtttttaacatactttgactttaaaattagtttcccttcagttnacttacctcactatanagtaaggaacagagaatccannnnatttattagagtattcataggnccnnanatttatntcttacatctctaaaagaaatgcaaaacccctgtcc

SEQ ID NO: 702772 - DNA, 142 bp, Homo sapiens
cattcaggtggcagactgtccccatcacttgtcaatgataaacatcgttgcagacagacatctgggtgggtgggtgagggggccggtctggtcggaacagatgacatgaggtgcagcccagggttctctagtggagggcaag

SEQ ID NO: 702773 - DNA, 169 bp, Homo sapiens
ttaccggtcctgggtcccccactcctgtcggtgacatggagaaacaaatccaagtcatatcccagaagagacagtatcgtgcgcttcaggagatcgctcagacgtgcattaccgtcaggtgatctgccttgccttggctatccccacgtgctgggattataggcgtaag

SEQ ID NO: 702774 - DNA, 876 bp, Homo sapiens
  misc_feature (260)..(260): n is a, c, g, or t
atgaccccaatagcgcaaaattaaccccactactaaaattaattactacacagtcactcatcgactctccccactcccataccggaacatcttcgcgtatgatgaaactttcggtctcactcctgtggtcgcctgtatgattcctccaaacatcatcatcaggactattcctagaccatgccactaatcgggcagtacgctctacaaccgccttttcatcaattcgcccacatcattcgagcagagtaaattatgcgtcnggagttcatccgctaacttcaccgactcacatggtcgctatcaactatctctcttcagtctgcctcttccgtagcaacatcggtcgagggcctatattacggatcatttctctactcagaaagcctgaaacatcggcataatcctcctgcttgcaatataacaacagccttcataggctatgtcctcccgtgagggccaaatatcattctgaggggccagcagtaattacaaaggttactatccgccatcccataacattgggacagacctagtacaatgaatctgaggaggctactcagtagacagtcccaccctcagacgattcattgaacctttcaccttcatcttggcccttcatatatggcggcccataaagaagaaatccaacttcctaactcttgcaccgaaaaacggggaatcaaaacaaaccccctagggaatccaacttcccattccggataaaatcaaccttccagccctttatacaacaattcaaagacgccttcggatatatcttcttacattctctcctaaatgacattaacactattttcaacaaacctcctaagggaaccagaaaaatttatcctagacaacccttaaaaaccttccaat

SEQ ID NO: 702775 - DNA, 1121 bp, Homo sapiens
cggagactgaagccggagccgggttggacgtctgtgacgggggcctgtgccgtgagcttggcgtccggcagacatggggatcgaccgagcgtccacagctgagacttccgcgaaggcggtgagtccagctcaccaccaagacgcagcccgtgcatagccaccgatgattgccttatgggaccagcttcttgggcatgcacagcagccacctcggttggcaggatgttgctttgcacttgggtgccaggcaggcagtagattccaggagctcgtgcgcgtgaagagtcagacctcctacaacttgggccaccctgtgactacaaaggccagtgtgatgaaaggctgtgctggcagtgggagcttgatgagtggcgttgccactacgggagaaagggagaagctagatcggtcgctgtaacgtgcgagccccggcttgcatcacccggccgttgcctgcccgtagatctttgcaggacccgcgacttggtaggtggccttcttcattgggtccagagttgccctgggggcaggggctcgagggtacgggcccaggggagaccgcatgcgcatgattggaggccattgcccagtgggccgcttggcgcgagatccccttgctccttggaccattttgctgagccttgctacttacttgtcccgggacttcaccggctttccacggagcccgagccaggcatgggtaagcgaccgtggttgtgaaacttccgcgctaagaaagagagcagttccggacgtcccccttgggaactaggacgtggttcaaacttaacgagtcctcgtgggaagggcctaggggtgctagggggcttcggcgtcgacctccaccaccgagatccttaaacttactgttcccacaggcctaatttgaacctcggtggagtgggatcgctttgcgtttgaacaaacttgggttgctttgacgagttgcgttgcatcacggaaggggccagatggtaaccctgggcccccactagcttcccgggaaaaacggtgtgcaagggagctcagggcccattggggttcacaagcgtacgtattatggtcccacaggggaggaactagaaacgattgcccctttggaccccttcttcatgcttcct

SEQ ID NO: 702776 - DNA, 894 bp, Homo sapiens
ggtttgggtgcaaggtaggtctgattgagcttgtgttgtgcgtgaagggacagcaccgtgggtctagcgggagagagtccctgagtgtgagacccgtcttccccggtcccagcccctcccagttcgccctcagggacgtgtcgacttccttgggtccccgtacggcgacagccgagtgggctgagagaagcgaaccagcgagtgatcgaagttggttagcgtcgaaatggctcggctagatagatggtggtccaacgattggtgaacatgctccgattctgcctagtagacatgatgtcatgagtatctagatcgagcttcaagggtgcagttcaacgcgtcttcacacttgttctaccacgagcacgctactgagcatcgcgaaaagatgcggacgtgcatccggacgtagctaggcttgccacgagagccctggtgtcctcgcaggggagcgccaggacatccgcagtgtcacgtgccttcgttagtggggcacctagacaatgttgtcacaagcagaactaccaagagcagaagatttgacggacattctccttgggaagcgcaaagtcgcattgtgcgccgtccccaagggtacccccaaagctgagctaggctcattgaagccctcgaggtccaaccagcacgcttggtgcgtgggagcatatttgtggccgagatactttactagcgctaacatgcaaaggagtttacagaaagcgccagacacgtcaaatgaacagagtctgggagaaaggggaactccctgaaacaggccgctggaaggggtttttaggacaaatgtacttaagcagtcacccaccgtcccaggaaggacagatggattgaacgcgcaggttgctgaaacgattgaaaggttgtcttctcagaagg

SEQ ID NO: 702777 - DNA, 166 bp, Homo sapiens
atcaggcgaagatgtggcccaccctcgggttggccctgctcgggtctcagatgcctcttccttctttggtgagcgtattttgcaaagccgtgtatgtggcgatggcattccccaagttagagcctttccaccactcccagagtcttcgcctgatgggtaccgagct

SEQ ID NO: 702778 - DNA, 965 bp, Homo sapiens
gcgccgcttgtgccagagccaggatactctttcgttgtctgctggtgtagctacacgtgccccggcccttttttgtgtcccgcgacattagaaacagtggttggaggaagtctcccgtcggggcaagaccaccgcccttcttgttgcatacatgaaccttcttgtggggggacacccccccgtctctctgcctcccctcgttctctgtggggggcgagcacagcgcaggtctcttatctactaagtgtgtgtggagagggggggacccactctctcttcctgcgcgcacaatggtgtgttttctcgctcgtggcaccccctcctgtggttgtgctggctgttcctccatacccccgcacgcacgacaggaggggtgtggtttcttgcccgccctcgctgctgaccacttcgcggtgccactccgtgtgtttatacatagcgctggcggggggaaattgctccgctcttctctcctctgtctgttctctctcctaagtggggctgcaccccccccgtgggcatgagttagttttttcttccccccagattgttgtgtgttgctctccccctcgcgcgcgcccacgggggtgccccgtatatctctcccctcgtgctgcgcagcaagattgtttgtcttgttaaaaaaaaagacggtgttataccccccgcgcgcccccctcgtggggtgaggttccccctccccgcaggggagcgccgcccgcgggggcacccccacgggggttttacactccgggcggcgttttttttcttcccccctgctggcgcacagggaggtcacatctggctgcctcacttctacacagccgttttttttctaccgtctccttattttttttttttttttcccccccccacctggcgcacacattttttttgagctttttttttgcccaaaactcttttttccttttttagggagaaacctttttaatgggggtccccca

SEQ ID NO: 702779 - DNA, 162 bp, Homo sapiens
ccgcgtgtaatgtgctgcccctacaatggagatctcttggagccccccaggccatacagactgctggctgcaaagccagtcctccacatgcaccacccaggccaccactgcccctggagctggtcacactggagatgctgctgaagccagagtggatgaccc

SEQ ID NO: 702780 - DNA, 851 bp, Homo sapiens
tgccccagttgtggttgtagtgtgtcataatctctgatcattaatcctagtgactgagtgcactattcagtattaaaaaatatgattaatagagagagctgtcattgagtcccaaaatgaattgcaagttttaaaataattattataaaatgtttgctaacccgaaaatattactaggcatgagtgtgacctctctgatttggtcaccttgtagaacttgagggtgtcaggggcgatctcttaagagttatcagtcatgatatccagaagtatagatgtatccaatgatggaagtgacaagtgaaagtgtgggattacaggcgtgagtcaccggcccggtcaagcccttgggataatatctggaatagcatctgtaaagctgagtgttcgacctctgttattcttcttctcctctttacatctggttgctgatgcgtggtgtaaagctgcacctgtggggggacctctcatgcagacttgccatattgcgggagtattggcactgatgatctttggtggacctttcttctctttaaaagatactttcaaaagggagcatgtgtgatgcaggtgttctcgtctaccgattgagaagttcagcttcaaaagttactggcagttttagtcgaggaactggtaagagataagggcatgttctggaaagacgtaaggattggacggtaaccctaggttgtgcgaccagtggaattttatttgcagaatgggggtgaaataggtaaaaaaaaggtttttctgaagagggagggaactttcaacgggtggggccagttaatttaggagaggtcatataagtgggaaaggggggggatttaacaggggggtatatgagg

SEQ ID NO: 702781 - DNA, 155 bp, Homo sapiens
aagatctcacttcacgaccaagatgctgagtgtgtcagagcccaaacctcttcatccactagctggtacatgctggtccacaagcacaccatgctggggccatgtgaaccaccaaggccacgggggcatctgcctttccttggtacctctgaaag

SEQ ID NO: 702782 - DNA, 261 bp, Homo sapiens
agcctgctgttctcctcctcgtgactatgaccaagtcttactccttcctggaccttcatttccctacctctcacatacacagtgggctggatgctggatgcaaagctccctcgtcacagccccaaagacaggacttgaccatctcagtgcaatgaccctgtggtgccttctcccgaggacctaagagccccctgagcgcttgcaaacactgcagacaaagcgagccctggcaccagctccctgcctgcctgttctgtgaag

SEQ ID NO: 702783 - DNA, 180 bp, Homo sapiens
gaaaacagaatgggtacttgagtctgaagctttagtgtgcaggccacatgggcggggcagggggtgtcaggccctgtgaccatgcccatggacgagaaacagcagggagcagaacactatcccaatgaaagaaccttacggtaggacctactggaagggcgcaaggggttggcaagcaag

SEQ ID NO: 702784 - DNA, 2351 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702785 - DNA, 2564 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatgtactgggggagtggggtgtgcctgggcccagaaagcaccttggagggaggggtctgggctgggtatcaccttgcgggggtgtcatggggccaggaagctcagtgggagggaaatccctggtgggcactggagggctaggaaagttgtggggggcccttcagccccctaccacaaagttacactgaggctccccccaccgatgctgcatacagatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702786 - DNA, 310 bp, Homo sapiens
attcagagaaaagggaaatcttgtacatagttgctagagatgtttaaattaatacagccattatggaaaacggtatggaggttcctcaaaaaactaaaaataagattaccatatggctcagtaatcccacttctgggtatataaccaaaggaactgaaataaatatgtcaaagggatatctgcactgccatgttcactgcagcactattcacaatagacaagatatggtatcagcctaactggctatcaacggataaactgatttttttaatgcagtatatatacacaatagactactattcagccttaa

SEQ ID NO: 702787 - DNA, 325 bp, Homo sapiens
  misc_feature (15)..(15): n is a, c, g, or t
cttttccagcttaanttattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctc

SEQ ID NO: 702788 - DNA, 2690 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagctaaaaaaaaaaaaaaaaaaaaaaagaaaaaaaaaaaaaaaaaaaaaaaaggggggggggcaaaaaaattcccccggggggcccaatatttgcggcttcaccccgcctttctgtgtcagcaggtgggcccccctaagggggacccctatattaaaaccaagagggcacggcgccgcacttgtacaacccgctcggcgtggtggaaacacggtgctgccgtgggaactcctgcgggagggccccctctctgggtgcggtgtgccacatacgtgggcacacatctccatgaggagtttacggccgagggcaaccataacgttggggctcatgcgtttacacgcg

SEQ ID NO: 702789 - DNA, 2868 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagctaaaaaaaaaaaaaaaaaaaaaaagaaaaaaaaaaaaaaaaaaaaaaaaaaaaagagggggggacacacaagaaacccacaagggggccccaaataagaaaaccacaatatatggaaaaggggcccaaaaggagccaaaaacaggagccaggaccacgaattaacaaaaatgtgaatggaaaaaaccgagtagcaatcgcaacacttgaaaagagcaccaataacctcgcagggggacaaatattgcgacaaaaccactaagagatataaaacacctagggacaacattacaattaacaggtgctaacgggtgagaaacacaacaggaatctatagagcgggcgagagaaaatattcagcaagagggtatagtttgagaatttcagggggggatagtaatatagagaagaagaacaacataggagaaaagaagaatgagacaaacagagaacacaagataaatcaagaaaataaaagaagagagaagagaagaaaaagaggagtaaataaaaaaaaagc

SEQ ID NO: 702790 - DNA, 314 bp, Homo sapiens
cagcacccccaaacgccagcctctcctttcttcccatccaccagtatactgcgggcgcatttctggtctttgtccaacagtgaacaccatatctggtgggatatgcctatccagtgccacagcggccacctcaccccatgcatctctgttttgcccgtcagtgctgggacggaccagctaagggcacgtcccagctgtctggcagataggtgggtgggaacagagagggcgagaatgccgtactaagcttctgcctggggatcccccacacgacctgggtactgccttgggaaaacctgtcttaagtaccacta

SEQ ID NO: 702791 - DNA, 2670 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaagatatcctctgccccttgccatctacctgtgaccagcctccagtctcctcaactctaggctggggagagtcttccatcctgatggggggtggggtacgggggtgagccctgggtccccctctgggcagatcccgttacacctcttgttggggtccttgattgggctacgctctggaactgtggatgcagctgcatgaggctggaatgggccttgaggagcccgggggtgcccctggccccagtgtaccccttcccccatcacaggtgatggacccccttctgttgttggaatgggcttctggggtctgactggtgtttagtgttgcaacttagcctcagctggtgggatggtggtggtctttggggatcccctggccccagggtccatctccaagagcctgtgtgccctgcagggtggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta
